United States Patent 11,098,302 (IDENTIFICATION OF POLYNUCLEOTIDES ASSOCIATED WITH A SAMPLE) - sequence listing, part 11

SEQ ID NO: 35134 - DNA, 600 bp, Homo sapiens
  misc_feature: GYAE6OF02G1YCG.30.67.G01.1.454.CMB.1.raw
  modified_base (295)..(295): a, c, t, g, unknown or other
  misc_feature (295)..(295): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggtcgagtcaggacatcagcaactatttaaattggtatcagcaagaaaccgagggtaacagacccctaagcctccngactccacgtatgcttgacaagtttggaagttcgggtaccctagtacaaaggatttacgagtggactaaggtcggaattcgtagggaacctagtttaacttttaactttaaacctaataacccaactagcacggtaccgaagattattgcgtagctaagtattaactcgtactaactaattactagtaactaaacgttctaccctatttacaccgttttccgacccgtagggtaaaccctaaagtacggtaacgtaagttaaccgaaacgtaaccgtttggtacggtacgttacgacgttaaccg

SEQ ID NO: 35135 - DNA, 760 bp, Homo sapiens
  misc_feature: GYAE6OF02FFMZJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctctggggctcctgctactctggctctcaagtgccagatgtgacatccagatgacccagtctcagcgtccctgtctgcatctataggagacaggagtcaccagtcacttgacctaggcgagtcaggacatcagactaacgttattaaagtttgtatcgacgactagaaaccgagggaacctacgacccctaagtcctcctagtactaccgtacgactgcttagacgtatttagggtaggttcgggtccaagttcgaacgtagtaccgaggtacggacgtaaggtggtacgtccggtaggtaaccgtaacgttttaacgtttttaacccttaaaccttaccgtaaaaccctaacccgttacgaaccgtaacgggtaccccgggtaaaagtacgtttaacgttacggtaccaacggtaaccttagtttaaacctttaccgtacggtttaccaaaacgttaagtttaacgtaaacggttacttaaacgtaacccctttacccgttatttaaccccgtttacccgttttacccgggaacccgtttaaccggggtaaacccgttaaacggttaacggggtaaccttaaccgttaaacccgtaaacggttaccggttaacggggttcccggtaccggtttaccgaaccctttaaccccgg

SEQ ID NO: 35136 - DNA, 698 bp, Homo sapiens
  misc_feature: GYAE6OF02GUENI.30.67.G01.1.454.CMB.1.raw
  modified_base (186)..(186): a, c, t, g, unknown or other
  misc_feature (186)..(186): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctncatctataggagacagagtcaccatcacttgccaggcgagtcgaggacatcagactaacttaatttaaagttagtatacagacaacgaaaccgagggtacacgacccctaacgtcctccgtagactaccgacgtactcggtcttgtactaacgtttagggtaacggttcggggtacccagtacgaagtagttacgaggtcggacgtaggtaggtacgttcggtagggtacttaagttttaccgttttaacctttaaacctaacttaaaccccgtaaaccttcggacaacgggtacggtaacgtaacttagttacgacgtaacgtacgttaactttagtttacctacgttactaacctaagtttaacttagtaactttaaccgttacctacccttacgtttacccttacggtttacccggtaccgttaaccgggtaaacctaaagggtcggttaactaacggtaaaccgtaaacggtaactttcgggtacggtacgttaccgtacctaacccg

SEQ ID NO: 35137 - DNA, 784 bp, Homo sapiens
  misc_feature: GYAE6OF02F8U4A.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccacgccgtccctgtcctgctatctataggagacgagacgtccaccactctacttcgccgaggcgtagtacaggacactcacgtactaactttaatttaaagttagtacttcagacaacgaaaccgacgggacaccgaccctagcctacctacgacctacccgagtactcgtaccgttagtaccgttaaggtttacgggtaacgggtttccggtaccctaagttacctaaagttacgttcgtaacgggtcggaacgtaggttacggtacggtcgtacgggtaactttaagttttaaccgtttttaaacccttaaacctaaaccgttaaacccgtaaccgtacgtaaaccgtacgggtaaccgtaacgttacttagtacgtaccgagttaactaaatttcttaccgttacgtaaaccttactaaactttagtaaacgttaacttaaccttacccttaacccgttttacgttaccccgtttaaccggtttaccccgggtacccgttaaacggggttaaaccctaaacgggttaacggtaaacccgttaaacggttaaccgtaaaaccggtacgggtttaccggtaccgggtacccgttaaccgtacccttaaccgg

SEQ ID NO: 35138 - DNA, 537 bp, Homo sapiens
  misc_feature: GYAE6OF02FG7A2.30.67.G01.1.454.CMB.1.raw
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (283)..(285): a, c, t, g, unknown or other
  misc_feature (283)..(285): n is a, c, g, or t
  modified_base (290)..(292): a, c, t, g, unknown or other
  misc_feature (290)..(292): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctcgagagcacagccgcctggctgcctggcaaggctacttccagtagcgtgctgaggcggntggcaaggcgacatagctngntacgngatgctacgtgattcangnnnactgnnngcntntacganggactcnagcagngtcgaatgaacgngacgacgattgatagacgtacgcgtacgtacgacgtactacgtcgtacgtgtacgtacgtacgacgtacgtagtacgtacgtacgtacgcgacgtacgtacgtacgagtacgtacgtacgacgacgtacgtacgtcgtacgtacgtacgtcgtacgtacgtacgtacgacgtacctacgtcgtaccgtacgtacgtacgttacgtacg

SEQ ID NO: 35139 - DNA, 800 bp, Homo sapiens
  misc_feature: GYAE6OF02HQ3B1.30.67.G01.1.454.CMB.1.raw
  modified_base (102)..(102): a, c, t, g, unknown or other
  misc_feature (102)..(102): n is a, c, g, or t
tcagcacgctacgtcacgaccggtgctcgatttagagtatacatattgggtttgggggagtcagtcccaaccaggacacagcatggacatgagggtccctgntccagctcctggggctcctgctactctggctctcaagtgccagatgtgacatccagatcgacccagtctccagccgtcctgtctgcatctagtaggagacagagtccacctatcacttcgccaggcgagtcgagacatcagactaacttagttttaaattaggtactacagtactaagaaacccaggggaccaaccggtaccccgtaacgtccttaccgtacgtacgtaccctaacggtactggtccgtttactaccgttaaggttttacgggtaacgggtttccggggtaccctaagttaaccgaagtacgttttacgaaggttcggacgtaggtacggtagtccggtagggtacttaacttttaactttttaaacccttaaaccgtaaacttaaaccccgtacgttacgaccgtaacgggtaacccggaaagttagtttacgttacctacgtaacgtaccttaaacgttacgtttaccgttacgttacctaaaacttacgttaataacggttaaactttacccgttaccctttacccgttaaaccgtttacccgtttaacccgggtttaccccgggttaaacccggttaacccggggtaaaaccgttaaaccggttgggtaaaaccctaacccggttaacggttaaaaccgggtccgtttaacgggaccttacccggtaccgtacccgttaaccgg

SEQ ID NO: 35140 - DNA, 668 bp, Homo sapiens
  misc_feature: GYAE6OF02GOQHL.30.67.G01.1.454.CMB.1.raw
  modified_base (259)..(259): a, c, t, g, unknown or other
  misc_feature (259)..(259): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagnagaacagggacacgccctaagctcgtgactccacgatcgtcttgctaacgtttggaacgttcgggtacccagtcaagtattcgagtggacgtagtgacgtcgtagggacgtatttaacttttttaacgttaaacccaacttaaaaccctaaccgttagaccgtaaggtacccgaaaggtaacttagttacgacgtaagacgtaattagtttaacctaggttacctaactaaattacttagtaacttaacttcccctaaccttagttacccgttaaccggttttcccggtacccgttaacggggtaaaccccgtaaaagtttacgggggaaacgtttaaaccgtaaacccggttaaaacggtaacccgtttagggtaaccgggtaccgttaccgtacccgttaaacccgg

SEQ ID NO: 35141 - DNA, 701 bp, Homo sapiens
  misc_feature: GYAE6OF02HI9CP.30.67.G01.1.454.CMB.1.raw
  modified_base (196)..(196): a, c, t, g, unknown or other
  misc_feature (196)..(196): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctatagganacagagtccaaccgatcacgttcgccgaggcgtagtcgaaggacatcagactaacttatttaaattggtactcgagcgaacggaaaaccgagggaaccacgtacccctaaggaccctcctacgacctaccaacgtcgtgtacgttagtacgttaagtttcgggtaaggttccggggtaccctaagtacgaagtacgttacgtaggtcggacgtaggtcggtacgttggtacggtaattaacgtttaacgttttaacctttaaacctaaccttaaaacccgtaacgttcggaaccgtaacgggtaaaccgggtaattacgtaagtttcaaccgtacgtaacgtaacttaacgttaccgtacgttacctaaagttaatagttaacgtaattaacccttctaaccctatttcctaaccgttcccgttacggtaccggtaaactaaacgtacgggaactaacgtaaccgaacggttaacggtacggtacggtacctacggtaccctacc

SEQ ID NO: 35142 - DNA, 702 bp, Homo sapiens
  misc_feature: GYAE6OF02JSM15.30.67.G01.1.454.CMB.1.raw
  modified_base (162)..(162): a, c, t, g, unknown or other
  misc_feature (162)..(162): n is a, c, g, or t
  modified_base (170)..(170): a, c, t, g, unknown or other
  misc_feature (170)..(170): n is a, c, g, or t
  modified_base (204)..(204): a, c, t, g, unknown or other
  misc_feature (204)..(204): n is a, c, g, or t
  modified_base (694)..(694): a, c, t, g, unknown or other
  misc_feature (694)..(694): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactcgtggctctcagtcgccagagtgtcgacatccaantcgaaccngtctacagtccgtcctgtctgacatctaatgganacagacgtcacatcgacttcgccgagcgtagtctaagcatcagactaacttaagttaacgttaggtactacacgaacggtacgaaacgacggaaccgtaccgtacccccgtaagtacccaccggttacaccgttacccgaaggttagttaccgttaccgttgtaaccggttaaggtttacggtaccgggttaccggttaccctaacttaacgtaacggttactttacggtaacggtccggttaggtagttacggtacgtacgttagggtactttaacgtttactttaacccgttaactaacgtacccgttaacggactacggaaccggtaaccgtaagtacgttactacgtaccgtataacctagttaacttcgtacgtacgtactaacgttacgtattaactaacgtcctactcgtaccttaccgggtaccgtacgtacggtaaacgagtacgtaacgttcaaacgtaccgttgtcgtaagcccgttanaccgtacg

SEQ ID NO: 35143 - DNA, 720 bp, Homo sapiens
  misc_feature: GYAE6OF02ISOHZ.30.67.G01.1.454.CMB.1.raw
  modified_base (139)..(139): a, c, t, g, unknown or other
  misc_feature (139)..(139): n is a, c, g, or t
  modified_base (172)..(172): a, c, t, g, unknown or other
  misc_feature (172)..(172): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
tcagcacgctacgtcacgaccggtgctcgatttagagtatacatattggggtttggggggagtcagtcccaaccaggacacagcatgggacatgagggtccctgctcagctccgtggggctcctgctactctggctcanagtgccagatgtcgacactccaagctagacccngtcctccagccgttccctgtcgtcgacatcgtaagtaggagacagtacgtcaaccatacacttcgcagggtcgagcgaacgactatacagacctaaaattaagtttaagtcggttaanagaacgagtaaacgaaaccgngggaacctaacggtacccgtaacgctaccgtagaccttaccgacgtatccgtacttacgtaacgttaaggttaccgggtaacgggttccggtaacccgtaagttactaaacggtactttacggaaccgggtgtaacccggtaaggtttcgggaaacctttagggacggttaacttaaaggttttaaccttttaaaccgtttaaaccaacgttaaacccgtaaccgttacggaaccgtaacgggtaccgtaagttaactagttacgactagtacttaacgtattactatcgtaatacgtatacgtaacttacgtccctagtaccttacgttccctacgtaccggacgttaaacgaacggttagaacgttaccaacgttaaacgtcgtacggtaggtcctacgtaacctac

SEQ ID NO: 35144 - DNA, 590 bp, Homo sapiens
  misc_feature: GYAE6OF02HYYJ5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagatcaccatcacttgccaggccgagtcaggacatcagacaacgtattttaaatggtatcagcaagaaaccgagggaccacgacccctaagcctccgtagactaccacgtatcgcttgactaagtttcgggaagtttccgggtccctagtacaaagtctttacgaggtaggctaaggtggatcgttagggaacttaatttacttttaaccgtttaacctaaacttaaccctaacttacggaacgtacgtaaccggaagtattaacgttgacacgactaatacttacctggtactaactatatagattaactccgtacctattacctacgttccgaccgtacggaactaagtgaactacgtacgaacgtacgtcgtaggcctagactaaccg

SEQ ID NO: 35145 - DNA, 791 bp, Homo sapiens
  misc_feature: GYAE6OF02FUEW7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatccacttcgccgaggcgagtacaggacagtacacgactaacttaatttaaagttggtacttacagacgaacgtaaaccgagggaccaaccgtaccctaagccttccgtagactaccacgtatcgtcgttagactaagtttagggtaacggtttcgggtaccctagtacgtaacgtattacgacggtggtacgtaggttacggtacgttacggtagggtaaccttaaggttttaaccttttttaaacccgttaaacctaaaccgttaaaaccccgtaacccgttaacggtaacccggaaaccgggtaacccggttaaacgttaacgtttaaacgttacggaaccgtacggttaaccttaaagttttaacctttacgttaacggtttaaaccctaaagttaaacgtttaacgttaacgtaactttaaaccttccctttaaaccccgttaactttacccggttaacccgtttcccggaacccgttaaccggggtaaaaccctaaacggttaacggtaaacgttaaccgttaaaccggtaaaccggttaccgtacggttacggtacgtaccggtacttaacccgg

SEQ ID NO: 35146 - DNA, 625 bp, Homo sapiens
  misc_feature: GYAE6OF02GA2E5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctataggagacagagtcaccatcacttgccgaggcgagtcaggacatcagctaacttatttaaattggtatcagcagaaaccagggacagcccctaagcctcctgactccagactcgcttagactaagtttggaaggttcgggtccatcgaagtacttcgaggttggacgtaggtaggacgtcgtagggaactatttaactttttaactttaaacctaacttaaaaccctaacccgttcggaacctaacgggacccgtaaagtaacgttgtttaacggctaacgtactaagttatttaaccgttagtaactaacttaagttaacgtgtaattaaccttcctaccttacgtttacctacgttttccgacccgttaacggtaacaaaggtcgaacgtaactaacaaacggtacttcgacgtacgtacgaccgtaaccg

SEQ ID NO: 35147 - DNA, 621 bp, Homo sapiens
  misc_feature: GYAE6OF02FMKOC.30.67.G01.1.454.CMB.1.raw
  modified_base (457)..(457): a, c, t, g, unknown or other
  misc_feature (457)..(457): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
tcagcacgctacgtcacgaccggtgctcgatttagagtatacatattgggtttgggggagtcagtcccaaccaggacacagcatggacatgagggtcctgctcagctcctggggctcctgctactctggctctcaagtgccagatgtgacatccagatgacccagtctccagcgtccctgtctgcatctataggagacagagtacaccatcacttgccagggcagtcaggacatcagactaaacttaatttaaattggtaactacgagcaaggaaaccgaggaccacggtacccctaagcctccgtgactccgacgatcgcttagcttaagttgggaacggttcgggtaccctatacgaagtacgtttcgaggtgacgagtacggatccgtaggaacttatttactttaacttaacaacttaaccgaactgaccgaaggcccggaaagtctagttanacgagactaattntaacgtntactaactaattntagtaactaattcctaccgtattaacccgttacgttccggacccgtagggtaaaacccgaagtttcggggaaactaaccgttaaccgtaaacgggttaccgtaagggtccggtagttaccgaacccgttac

SEQ ID NO: 35148 - DNA, 702 bp, Homo sapiens
  misc_feature: GYAE6OF02GM22H.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagtcaactaatttaaattggtatcgagacaacgaaaccgagggacacggacccctaagcctccgtagactaccgacgattcgacttgacttaagtttacggtaacggttcgggtaccctatacctaaaggtactttacgaggtcggtacgaggttcggagttcggtacgggtaacttagttttaacgttttttaaacctttaaaccctacgtaaacccttaaccgtcggtaacgacggttaaccggaagtaacgttagttacgactaggaacctaattaagtttacgttacgttaacctaactaaacgtttaagtaagttacttaaacgttccctaccccgtttaattcccgtttaaccgtttacccggtacccgttaccgggaaaaccttaaacggttcggtaacgttaacgtaaccgtaaacgtacggtttaacgggtacgtaccgttacggacccgttaacccg

SEQ ID NO: 35149 - DNA, 659 bp, Homo sapiens
  misc_feature: GYAE6OF02GI838.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagacgtccaccatccacttcgccgaggcgagtacgaggacatcgagactaaacttaatttaaagttgtatacagacaacgaaaccgagggaacaccgacccctaagcctacctcgaactccaacgatgtcttagacgttaagttcgggtaacggttcgggtcccagtacgtaaacgtatttacgaggtcggacgaggtaggtaacgtgtacgggtaatactttagttttaaaccttaacctaaactaaccctaactacgacgacgtaccggaagtagttacgtaggactagtacctaattacttacgtacttacctaataataatgtaacttaacttcctacctaacgtttcctaccgttttccggtaaccgttaccgggtaaacgtaaaggttcgggtaaacttaacgaaccgtaaacgttaaccgtaggttacggtacgttaccgtaacctaaccg

SEQ ID NO: 35150 - DNA, 334 bp, Homo sapiens
  misc_feature: GYAE6OF02FSLHX.30.67.G01.1.454.CMB.1.raw
  modified_base (265)..(267): a, c, t, g, unknown or other
  misc_feature (265)..(267): n is a, c, g, or t
  modified_base (271)..(334): a, c, t, g, unknown or other
  misc_feature (271)..(334): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagccgtgctgagcgggactggcaaggcgcaataggcnnncagnnnnnnnnnnnnnnnnnnnnnnnnnnnnnnnnnnnnnnnnnnnnnnnnnnnnnnnnnnnnnnnn

SEQ ID NO: 35151 - DNA, 809 bp, Homo sapiens
  misc_feature: GYAE6OF02IPNFK.30.67.G01.1.454.CMB.1.raw
  modified_base (138)..(138): a, c, t, g, unknown or other
  misc_feature (138)..(138): n is a, c, g, or t
  modified_base (173)..(173): a, c, t, g, unknown or other
  misc_feature (173)..(173): n is a, c, g, or t
tcagcacgctacgtcacgaccggtgctcgatttagagtatacatattgggtttgggggatcagtcccaaccaggacacagcatggacatgaggtccctgctcagctcctgggctcctgctactcctggctctcaagtncagatgtgacatccgagtatcgacctagtctaccncgtcctcctgtctcgtacctatctagtaggtacacgagagttccacacttacacgttaccgccgtaggcgtacgtacgacgtaaccagttacaacgtactaaacgttaacgttttaaatcggtactagtaacgacaaacggaaccgtacggactaaccgtaccctaacgtctacgtacgactaccgtaacgtactacgtaccttaggtaccgttaagttttaccggggaacgttttcggaccctaacgtaagtaaaccgttggttacgtaacgggtcgaaccggttaacgtacgttacgggtaccgttaacgggtaacgtttaactttttaacccgtttttaaaacccgtaaaaccttaaaccccgaaccgtttaaacccgtgggtaacccgtaaacgggtaacccgggttaaataacgttaggttccgaaacggtaaccttaacggttaacctttaaaccttcggttaaaccgtacttaaaacgttaacgttagttaaacccgtatttaaacccgtttacctacccgttaaactttccccgttacggttaccggtaacccggtaagtaaacccgtaaagtacggtactaacgtaaccggttaacgtacgcgttaccgtacgtcggtaccctaacg

SEQ ID NO: 35152 - DNA, 646 bp, Homo sapiens
  misc_feature: GYAE6OF02IZOSI.30.67.G01.1.454.CMB.1.raw
  modified_base (300)..(300): a, c, t, g, unknown or other
  misc_feature (300)..(300): n is a, c, g, or t
tcagcacgctacgtcacgaccggtgctcgatttagagtatacatattgggtttgggggagtcagtcccaaccaggacacagcatggacagtgagggtccctgctcagctcctggggctcctgctactcgtggctctcaagtgccagatgtgacatccagattgaaccccatcctccagtccgtccctgtcctgacctatcctaagtaggacgacagtacgtcaccaatctacttgccaggccgtagtcaggacagtcagacaaacttagtttaacttggtactacgagacaagaaaccgngggtacaacgtcccctaagtccgtcctagaactcccaggtactcggacttaggacctaatttacgggacggtttcgggtacccagttaacgaggtactacgaggttgactaggtcgatcgtggtaacgttattacttttaaccttaacataaacccgacttcggactacggaccggtaatacttacgttcgacgaacgctaacttactaactaccgtactaaaccgtataacgtcaacgtttaccttacgtacccttactacctacgtttcccgacgttaaccgggaacccttaaaagcggtaacgaacttaaccgaaaccacgttacgcggtactaccgcctaac

SEQ ID NO: 35153 - DNA, 750 bp, Homo sapiens
  misc_feature: GYAE6OF02FKMPL.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatcgacccagtcctcagccgtccctgtctgcatctagtaggagacaggacgtcaccatccacttcgcgaggcgagtcaggacatcacgactaaacttaatttaaagtttaggtacttacgagaccgaaacgaaaccggacgggtaacgaccgtacccctaaggcctacctacgtacctactacgtagtcgtactcgtaagttaacgtttagggtacgggttacgggtaccctagtaccgaaagtactttacgaggttcgacggtagtcggtatccggtagggtaactttaaggtttaaccttttaaaccttaaaccctaacttaaacccgtaaccgtacgtaccgggaaacgggtaaccgtaaacggttaagtttaacgttacggactaacgggttactaaacgttttatttaccgttacgttaacccgttaaattaaacgttaggtaactttaacttaaccgttacctacccgtttaacgtttcgtttaaccccgttttaccggtaccggtaacggggtaaaccctaaaggttcggaaacgttaactaaccgtaaacgtaggtagttacggtacgttaccgaccttaacgg

SEQ ID NO: 35154 - DNA, 701 bp, Homo sapiens
  misc_feature: GYAE6OF02H6E5K.30.67.G01.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagtccgtccctgtctgcatctagtagganacagatccaccntcacttgaccgaggcgagtcgaggactatcgaagacctaaacttattttaaagttggtaactacagacaacggaaaccgagggaccaccgaccccgtaagcctccgttagactaccgagtactcggtcttacggacttaaggtttacgggttaacggggtttccgggtaacccttagtaacttaaagtacgttttacggacgggtcggagttagggtaggtacgttcggtagggttacttaagttttactttttaaaccgttaaacctaacttaaacccgtacgtcgaacgtacggaacgtaagtaagttacgtacgacgtaacgtacttaagttacttacgttaccgtaattaacgtattatagttaacttacgttcctaaccttacttccgttaccggttccgacccggttaaggtaaacctaaggtacggtaacaacccgttaacgacggttaccgtaggttaccgtctaccgtactacccgg

SEQ ID NO: 35155 - DNA, 675 bp, Homo sapiens
  misc_feature: GYAE6OF02G1UDY.30.67.G01.1.454.CMB.1.raw
  modified_base (128)..(128): a, c, t, g, unknown or other
  misc_feature (128)..(128): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (627)..(627): a, c, t, g, unknown or other
  misc_feature (627)..(627): n is a, c, g, or t
  modified_base (643)..(643): a, c, t, g, unknown or other
  misc_feature (643)..(643): n is a, c, g, or t
  modified_base (663)..(663): a, c, t, g, unknown or other
  misc_feature (663)..(663): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactcnggctctcaagtgccagatgtgacactccagatcgacccagtcctccgagtccgtcccgtgtctgctactctagtaggagaaccagtacgtacctaccaattccgtaacgttccggaccgacggaccgtaagtacgacggaccagtacgacgactaaactttaatttaaacgttggtactacgtagacgaaacgaaccgtaggaccaccgacctacgcctactagacnccacntcgctgctaaggttcggtacggttccggacctagtacgtaacgtgttacgagttcggacgtacggtgtacgttacggacggtactttaagttttaaccgttttaaaccttaaacgtacccttaaacccgtaacctcggaacgttacgaacggtaatactaggtccagtaacgtactagttaaccgtattaacgtactaactaacgtagtacgtaactacttcctaacctgttaaccgttcgtacccggtacttacggaactaaggtnaagtcctaaccgtaancggttaggtaccacggtacnccgttaacgtcg

SEQ ID NO: 35156 - DNA, 779 bp, Homo sapiens
  misc_feature: GYAE6OF02FOQ5N.30.67.G01.1.454.CMB.1.raw
  modified_base (580)..(580): a, c, t, g, unknown or other
  misc_feature (580)..(580): n is a, c, g, or t
  modified_base (746)..(746): a, c, t, g, unknown or other
  misc_feature (746)..(746): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagtatgtgacatccagatgaccagtctccagccgtcctgtcctgctatctagtaggagacagagtcaaccatccacttcgaccgagggtcgtaggtcgaaggtactacgtacacgacctaaacttaacgttttaaacgttaggtaactacgtaggaccgaacggtaaaccgaacgggaaccaaccggtaccccgtaagtacccttacctacggtacctaccgtacgtacgttacgtaccgttagtaccgttaaaggttttcgggtaacggggtttccgggtacccgttattaaacgaaacggtttaactacggtacggttaccggacgtaacgggttcggtaacgttccggtaacgggtaacttaaggttttacctttttaaacctaaaccgtaaccttaaaccgtaccgtacgaccgtaacgggaaccggttaaactnttaacgtacgaacgtacgaccttaagttaacctttaacggttacttaacgtaaacttagttaagtaacttaaccttaaccgttccacgtttaacctcgtttacccggttacgacccggtaaggtaaacccgtaaggtacggtaaacgttaaccgaacgttaaccgngggttaccgttacggtctaaccggtactacccg

SEQ ID NO: 35157 - DNA, 786 bp, Homo sapiens
  misc_feature: GYAE6OF02GW58E.30.67.G01.1.454.CMB.1.raw
  modified_base (143)..(143): a, c, t, g, unknown or other
  misc_feature (143)..(143): n is a, c, g, or t
  modified_base (152)..(152): a, c, t, g, unknown or other
  misc_feature (152)..(152): n is a, c, g, or t
tcagcacgctacgtcacgaccggtgctcgatttagagtatacatattggggtttgggggagtcagtcccaaccaggacacagcatggacatgagggtccctgctcagctccgtggggctcctgctactctggctctcaagtcnccagatgtnacactccagatcgacccagtcctccagtcctcctgtctgcacttctaagtaggacgagagtacgtaccaacctattccacgttcgccgaggcgtacgtacgaacgacacgtcaacgtaacctaattttaaagtttaaacgttggtaactcgaacaccgaaacgaaaccgtaacgggacaaccggtaacccgacgtccgtaactcgacctcgaacgttactcggtccttagtaccgtttaaggttaggtacggtttccggtaacctacggttaataacggttacgtagtacggtacggacttaggtacggtaactcgggtaaacgtattacgttttaacttttaacttaaccgaacttaacccgtacgtacgtaaccgacgtaacggtaattcgttaacggtaacgtcgtaacgtacgttaactttaccggttacgtttaaccgtacttaaagtaacgtttagttaacgtaaccgttttaccgtaccccttacgttaaacctttcccgggtttaaccggtcccgtttaaccgggttaaccgaaaccggtttaaacggacggtaaacccttaaccggttaacccgaaacggtttcggttacggttaacccgtccggtaacccgtaccttaaccccg

SEQ ID NO: 35158 - DNA, 714 bp, Homo sapiens
  misc_feature: GYAE6OF02GEUIZ.30.67.G01.1.454.CMB.1.raw
  modified_base (260)..(260): a, c, t, g, unknown or other
  misc_feature (260)..(260): n is a, c, g, or t
  modified_base (303)..(303): a, c, t, g, unknown or other
  misc_feature (303)..(303): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttgccaggcgagtcaggacatcagacaacttaatttaaattgtatnagacaacgaaacaggacacgcccctaagcctcctcgactcagntcgcttagactaagtttacgggtaaggttcgggacccatacaagtatttcgaaggtgcgtaggtagggtacttacggtacgggtaacttaacttttaacctttttaaaccgtttaaacctaaaccgttaaaccccgtaaacccgttcggaaccgaaaccggtaccgggtaaaactaacgttaacgttcgaacgtagtaacccttaaagttactttaacgtcgttaaccgtaaacttagttaacttacgaaacgtttaaccttacccttaccgttaaaccgttaccctttacccggttttacccggacccggttaaacgggtaaacccgttaaaaggttcgggtaaaacgtaaccttaaaccggtaaaacgtacggtttaccggaacgttaccggtaacgacccgttaaccg

SEQ ID NO: 35159 - DNA, 901 bp, Homo sapiens
  misc_feature: GYAE6OF02HY4M0.30.67.G01.1.454.CMB.1.raw
  modified_base (174)..(174): a, c, t, g, unknown or other
  misc_feature (174)..(174): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctcgtcaagtggccagatgtgacatccagactgaccctagttcnccacgccgtcccttgtctgtacacttactataaggagactaggacgtccaacctatctacgttacgaccggaggacggtacgtacgaacggacctaacgtacacggtaacctaaacgtttagtttttaaaacgttagggttatacgtaaacggacaaacggaaaaacccggtagggaaccgtaaccgtaaccccgtaagggtacctcccgtataaccgacctaacggtatcggacgtttacgaacgttaaggtttaggtaacgggttacgtacccgtatacgtaagtactttacgaacggttcggacgtagggtacgacgttacggtaacgggtactttaacgtttaacgtttttaaaaccctttaaactaaaccgtaaaacccgtttaaccctacgggtaacctaaccggggaaaacgggttaaaccgttaacgtttaacggtttaccgaaactaacgggtaacctttaaacgggttaactttaaaccgttcgggtaaaaccctttaaaagaacgtttaaacggtttataaaacccgtttaaaccgtttccctaaaaccgttaccgttttaaccgttaccggttttaccccgggtaacccgttaaaccgggggtaaaacttaaaaccggtacgggggtaaaactaaaccgggtttaaacccggtaaaacccgttagggttaacccgggtttaaccgggaaccctttacccggaaacccgttaccgg

SEQ ID NO: 35160 - DNA, 808 bp, Homo sapiens
  misc_feature: GYAE6OF02F160N.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctatagganacagagtcaccaatccacttcgccgaggcgtaagtccaggaccatcagactaaacttaattttaaaacgttggtaacttacgacgtacaaacggaaaaccgaggggtaaccaaccggtaccccctaaaggtccttaccgtaggtaacctacccgtaacgacttacggttaccgttacgtaaccgttaaagttttaggggtaaacgggttttccggggtaacctagtaacgtaacggtaactttcggaacggttcggtacgtaagggtacggttaactaccgggtaggggaacttagttttaaaccgttttttaaaaccttaaccttaaaaccttaaacccaacccggttacgaaccgtaacggggtaacccggtaaaagtcttaaacggtttcaaccgttacgtaacctatttaaccgttttaacgtacgttaaccttaactaaacgtttacgttaaacgttacgttaaacctttacctaaccttaactttaccggttacccgtttaccggggtaaccgttaaccgggtaaaacccttaaagggtacgtaaacgtaaacgttaaccggtaaacggtacgtttacggacggtttaccacggtccctaacgg

SEQ ID NO: 35161 - DNA, 746 bp, Homo sapiens
  misc_feature: GYAE6OF02HKN8P.30.67.G01.1.454.CMB.1.raw
  modified_base (184)..(184): a, c, t, g, unknown or other
  misc_feature (184)..(184): n is a, c, g, or t
  modified_base (203)..(203): a, c, t, g, unknown or other
  misc_feature (203)..(203): n is a, c, g, or t
  modified_base (323)..(323): a, c, t, g, unknown or other
  misc_feature (323)..(323): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtcctccagtccgtcccngtctgctatctagtagganacagtagtccaccatccacttcgaccgaggcgagtccgaaggacactcagccaaactttatttaaattggtattacagacaacggaaaccgagggaacacgacccccttaaggcctcctnacgtaccaagtatcgtcttgtacttagttaggtagggttccggtacccaagtacgaagttacttacgtaggtcgggacgaggttaggcttacgggtgggtaactaacgttttaacttttaaccttaaacctaacgttaacccctacgttacgacgtaaggacccggtaaagttacgtacttaggtacctacgtaataaccgtttactttaaccggttacttaacccgttaaagttaacgtttaaacgttggttaaaaccttaaacctttccccttacggttttaaaccttacccgttttaacccgtttaccccggggtaccctttaaccggggtaaaacttaaacgggttaccgggtaaataaccccgttaagtaaacccggttaaacgtgggttaacccggtacgtaccgccccttaaccgg

SEQ ID NO: 35162 - DNA, 622 bp, Homo sapiens
  misc_feature: GYAE6OF02I5FHB.30.67.G01.1.454.CMB.1.raw
  modified_base (109)..(109): a, c, t, g, unknown or other
  misc_feature (109)..(109): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (382)..(383): a, c, t, g, unknown or other
  misc_feature (382)..(383): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
tcagcacgctacgtcacgaccggtgctcgatttagagtatacatattgggtatatacgtgcctaggattgaccgttactacggaatggacgtctagggccaagggaccnggtcaactgtctcctcagcttccaccaggacccatcggtcttcccccgtggcgaccctgctaccgaggagcctacctaccggagagccacacgcccgtcccgtgggccttacggcccttagggttacaacggaccttaaccttccggaccttaggccgttagccgtgagccggggttctacgggcaaagggtccacacgttaggcngttnaacncgtcanccttaaaggcgttaanacgtgancctncgntcgnaacnagcttgtanccngcnncngngcntcnacgtacgngacgagtcgngngcgtcgngcgtacgtacngngtacgtgacgtacgtcgtcgtagacgagacgacgtacgacgtacgtacgctcgtacgtacgaccgtacgtacgtacgtacgtaccggtacggtccgtccgtaccgttaccgttaccgtaccgtacggtaccgttacctacgtaacgttacgacgttacgtacgtaccggtacgtacgtcgttccgtacc

SEQ ID NO: 35163 - DNA, 506 bp, Homo sapiens
  misc_feature: GYAE6OF02IXA5I.30.67.G01.1.454.CMB.1.raw
  modified_base (162)..(162): a, c, t, g, unknown or other
  misc_feature (162)..(162): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (476)..(476): a, c, t, g, unknown or other
  misc_feature (476)..(476): n is a, c, g, or t
tcagcacgctacgtcacgaccggtgctcgatttagagtatacatattgggtatatagtgcctaggattgaccgttactacggaatggacgtctggggccaaggggaccgcggtcactgtctcctcagcttccaccaaggacccatcggtccttcccctggcncctgctccaggacgcacctcgagagcacagcccgcctgggctcgcctggtacaaggactacttccagtgccgtgcgtgacggcgggctggacgaacggcgacagtagnactncgagcacngntgccatnancgtcatncgacattcncgcttaagnttaccagttgcttaacncgcgacatgtacgcgcgagcgtagactcgactagtanactcgcgtacgtagtacgngcgtcacgacgcgcngatanacgngncgcncagcacncgtcncgtactcgntactacncgacagacgtcgtacactacgacgtanacgtacctacgtactacgtcgtcgtatacg

SEQ ID NO: 35164 - DNA, 511 bp, Homo sapiens
  misc_feature: GYAE6OF02HPQGS.30.67.G01.1.454.CMB.1.raw
  modified_base (124)..(124): a, c, t, g, unknown or other
  misc_feature (124)..(124): n is a, c, g, or t
  modified_base (174)..(174): a, c, t, g, unknown or other
  misc_feature (174)..(174): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagcacgctacgtcacgaccggtgctcgatttagagtatacatattgggtatatagtgcctaggattgaccgttactacggaatggacgtctggggccaagggaccgcggtcattgtctcctnagcttccaccaaggacccatcggtcttcccccgtggccgcctgctcaggngcacctccgagagcacagccgccctagggctgcctggtcaaggactactcacgtagcgtgctgagcggntggcaaggcgcatagncangntcatcganctagacngcgntagacntaagccatnacgangtaccgngtgacncngacgtnacgtgntaccgancgtangangacngactacgatacncgaactgagtagccatacggtataccggnacgttgacgtctgaatccgactcganagttnagacgtagacgtagacgtcactacgacgtacgtacgtacgtacgacgtacgacgtagtcgagtcgtatacgtacgacgtacgtacgtacg

SEQ ID NO: 35165 - DNA, 653 bp, Homo sapiens
  misc_feature: GYAE6OF02GQ46C.30.67.G01.1.454.CMB.1.raw
  modified_base (577)..(577): a, c, t, g, unknown or other
  misc_feature (577)..(577): n is a, c, g, or t
  modified_base (646)..(646): a, c, t, g, unknown or other
  misc_feature (646)..(646): n is a, c, g, or t
tcagcacgctacgtcacgaccggtgctcgatttagagtatacatattggggtttgggggagtcagtcccaaccaggacacagcatggacatgagggtccctgctcagctccgtggggctcctgctactctggctctacaagtcgccagatgtgacatccagatcgacccagtcctccagccgttccctgtctgctattcgtagaggagacagactcaccatctacttcgcgaggcgtagtcagactatcaagactaacttaattaaaagtgtaactcgacgtacaagtaaacccgaggaacctaccgtaccccgtaagccttaccggtagacttaccgaagtacgtcgtctaagtacgttaagttagggttaacggttcggaccctataaccgtaatagtttcgaggtacgtacgaggttagtcgtaggtacggtaatttacttttaaacgttttaacccttaaaccgaaactttaaacccgaacgttcggaactaccgggtaccgtaaaagtcgtttacgtagcgtaaagtctaactttagtaactgttaactaactatagtataacttcgttacnctattccgtcgtcccgagtaaccgtaaacaagtgtaaccgacgtaaccgacttaggcgtcgtaccgtanacctacg

SEQ ID NO: 35166 - DNA, 700 bp, Homo sapiens
  misc_feature: GYAE6OF02FQ62X.30.67.G01.1.454.CMB.1.raw
  modified_base (282)..(282): a, c, t, g, unknown or other
  misc_feature (282)..(282): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatcgacccagtctccagccgtccctgtctgcatctataggagacagagtcaccatcacttgccagggtcgagtcaggactatacagacaacttaatttaaattggtatcagaccacggaaaccngggaacacgtaccctaacggccttcctagaccgtccaacgtagtcgtcgttagtaccgttaagtttagggtaacggtttccggggtaccctaactaccgtaaaggtactttaggtacggtggacgtacggtgtagtcggtagggacttaagtttaacttttaaacgttaacccgtaactaaaccctaccgtacggaccaacggtaaccggtaagttaactacgttcgacgtaacgtcctaattaacgtttacgtacgttaccgttaaactaattacgtaattaacttaacgtccttaccctaagtttccgttaccgtttacccgaccggtaaccggtaaacccgtaacggtacggtaacgtaaccgtaaccgttaaaccggtacggttaccggtacgcccgttacgtacccgtaaccc

SEQ ID NO: 35167 - DNA, 747 bp, Homo sapiens
  misc_feature: GYAE6OF02FYHZ9.30.67.G01.1.454.CMB.1.raw
  modified_base (140)..(140): a, c, t, g, unknown or other
  misc_feature (140)..(140): n is a, c, g, or t
  modified_base (187)..(187): a, c, t, g, unknown or other
  misc_feature (187)..(187): n is a, c, g, or t
  modified_base (277)..(277): a, c, t, g, unknown or other
  misc_feature (277)..(277): n is a, c, g, or t
  modified_base (373)..(373): a, c, t, g, unknown or other
  misc_feature (373)..(373): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtnccagatgtgacatccagatgacccagtctccagcgtccctgtctgcntctataggagacagagtcacatcgacttcgcaggcgagtcacggacatcaacgctaactaatttaaagttgttactcagcaggaaaccgnggaacacgacccctaaggcctaccgtgacttccgaacgtactcgacttgtaccgtaagtttcgggtaaggtttccgggtacccagtacgaaacgtnttaccgtaggtcggacgtagtggtaccgtcggtacggtacttacgtttaactttttaaaccctttaaaccgtaaccttaaaccccgaccgttcgtaccgaacggtaccggtaaacgtatttaaacgttcgaccttaaggtccaatttaactttaccgggtaactttacccgaaaatttatttaaaactttacgttaacccttaccttacccggttaacttcccgttaacccgttttacccgggtccctttaaccggggaaaaccgttaaaacggttggggtaaaaccttaggtaaaaccccggttaaaaacgttcccggtttaaccgggttaccggggtaccctttacccgggtaaccctaccggtttaacccg

SEQ ID NO: 35168 - DNA, 682 bp, Homo sapiens
  misc_feature: GYAE6OF02GUIFV.30.67.G01.1.454.CMB.1.raw
  modified_base (149)..(149): a, c, t, g, unknown or other
  misc_feature (149)..(149): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtnacatccagatcgacccagtctccagccgtccctgtctgctatctatagganacagngtacacctatcacttcgccgaggcgtaggtccaacggacactcagacctaaacgttaattttaagttaggtactacgacgacaagaaaccgacgggaaccacgaccccgtaaggcctcctacgtactaccacgtatacgcttagacgtaattttacgggaacggttccgggtaccctatacgtaaagtacgtttacgagtcggtacgtagtagggataccggtagggtaacttaacttttacgttttaaaccctttaaacctaacgtaaaccctaaccgtgaaccgtaacgaccgggtaatacgtagtcgacgtatattacttagtcttactaagtaattagtattactaactttcctaacccgttacttaccgttacccggttcggtacccgaagggttaaccctaaagggtacgtaaacggtactaaccgtaaacgtccggttagggtaccgaccgtacgtacctaccgttaacg

SEQ ID NO: 35169 - DNA, 855 bp, Homo sapiens
  misc_feature: GYAE6OF02IH7WA.30.67.G01.1.454.CMB.1.raw
  modified_base (209)..(209): a, c, t, g, unknown or other
  misc_feature (209)..(209): n is a, c, g, or t
tcagcacgctacgtcacgaccggtgctcgatttagagtatacatattggggtttgggggagtcagtcccaaccaggacacagcatggacatgagggtccctgctcagctccgtggggctcctgctactctggctctcaagtgccagatgtgacatccagatcgaccccagtcctccagtccgttccctgtctgctatctataggagacngtacgtcaccatctattcgacgaggcgagtcaggtacatcagaccttaacttaagttttaaacttggtactacgacgacgaacgaaaacccgagggaccctaaccgtaccccgttaacgtcccttacccgataacctcgaaccgtagttcgttccttacggtactttaaggtttaacgggtaagggtttacccgggaccttaacgttaacgtaaacggttaccgtttaggaacgggttcgggtaataggggttacgggtaacttccgggtaagggtaacccttttaagttttaactttttaaacccctttaaaacccgtaaactttaaacccccgttaaccgttaccggtaaccgtaacccggggtaaaccgggtaaacgttaacgttaacgtttacggtaactaaccggtaacctttaaacgttaacgttttaaccggtacctttaaacgttaaaccgttaaacttaacttaaacggttaactttaaacctttccccttaacccgttaaccgttttaacccgttacccgggtttacccggtaccggttaacccggggtaaacttaaaaccgggtgggtaaactaacccggttaaaccgtaacggtaacggttcgggtaaccggaccgttacggtacccttaaccg

SEQ ID NO: 35170 - DNA, 732 bp, Homo sapiens
  misc_feature: GYAE6OF02FRWL2.30.67.G01.1.454.CMB.1.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
  modified_base (539)..(539): a, c, t, g, unknown or other
  misc_feature (539)..(539): n is a, c, g, or t
  modified_base (566)..(566): a, c, t, g, unknown or other
  misc_feature (566)..(566): n is a, c, g, or t
tcagcacgctacgtcacgaccggtgctcgatttagagtatacatattgggtttgggggagtcaggtcccaaccaggacacagcatggacatgagggtccctgctcagctcctggggctcctgctactctggctctcaagtgccagatgtgacatccagactgacccagtctccagcctccctgtctgcatctagtaggagacagatccaccattccncgttagccaggcgagtcacgcganctagctaacttaattaaagttaggtatnacgactagaaaccgacggtagaccgacccgtaacgtacctaccgtacgactaccgaacgtacgtacgcgttacggtaccttaagttaggtaacggttacggggttcccgtaacgttacgtaacggtattacgttaacggtaggtaccgtaaggtacggtaagttccgtagggacttacgttttaacttttaaaccgtttaacctaaccgtaaaaccctaaaccgttccgaacgtaccggtaaccggtaaagacgtttaacgttaacggtntaaggacctttaaagtccttttaacgngttttaaaccacggttaataccgttagtaaccgttaaactacccttttaccctaagttttccaacccggtttttccggaacccgttacgggggaaaccctaaaccgggtacggtaaggttaacctaacgtaaacgtacgtacggttacggcgttaccacgtaaccg

SEQ ID NO: 35171 - DNA, 667 bp, Homo sapiens
  misc_feature: GYAE6OF02F0ECE.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacactccagatcgaccctagtcctccagccgttccctgtctgcatctataggagacagagtcacatcacttcgccgaggcgagtcgaggacatcagacaacttaatttaaagttaggtatacagactaacggaaaccagggaacacgaccccgtaagaccgttcctacgaactacccgacgtacttcggtcttacggacttaagtttggtaaggttcgggtaccctacgtacgtaaagtacgttcgaagtgggacgtaggtaggacgtcggtacgtacgttacttttaagtttttaacctaaccgtaaaccttaaacccgtaaccgtgtacctaccgggaacgtaagtattacgtagcagtacaaagttcttaaccgttctaacttaacttaagttaccgaattaatttcctaaccttaccgttaacttcttaccgtttcgacccgtaggtaaacccggtaagttggtaaactacggtaacctaaacggtacttagggaccgttcgactcctaaccgg

SEQ ID NO: 35172 - DNA, 787 bp, Homo sapiens
  misc_feature: GYAE6OF02HGZ76.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgaccagtctccagccgtccctgtctgacatctataggagacagagtcaaccgactcacgttcgccaggcgagtcgacgacataccagtacctaaacgtttatttaaacgttaggtactacgaacggactaacggaaaccgacgggtaacctaccggtaaccccgtaacgtcctacctacggactacccgacggtatccggttacgttacgtacgttaaggtttacgggaacggggtttaccggaccctaaggtaccgtaacgtagtttacggacgggttacggtacgtaagggtacgtacggtacggtaggttaacttaacgtttttaattttaaccccgtaacgtaaccgttaaccctacggtacgaccggtaacgggtaccgtaagttacttacggttacacggtactttacaacgtttagttacccggttacgttaaacgttaactaggttaacctaacgttaacgtttacccgtaccctttacccgttagttaccccgggtttaccggttaccccgggtaccggtaagtaaacccgggtaattaccggggtaaaacgttaacccctaaacggggtaacgttaccggtacccgggttaacgttaccttaccggtacgttaacccgg

SEQ ID NO: 35173 - DNA, 682 bp, Homo sapiens
  misc_feature: GYAE6OF02HQC6O.30.67.G01.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (509)..(509): a, c, t, g, unknown or other
  misc_feature (509)..(509): n is a, c, g, or t
  modified_base (522)..(522): a, c, t, g, unknown or other
  misc_feature (522)..(522): n is a, c, g, or t
  modified_base (659)..(659): a, c, t, g, unknown or other
  misc_feature (659)..(659): n is a, c, g, or t
tcagcacgctacgtcacgaccggtgctcgatttagagtatacatattgggtttgggggagtcagtcccaaccaggacacagcatggacatgagggtccctgctcagctcctggggcctcctgctactctggctctcaagtgccagatgtgacatccagatgacccagtctccagccgtccctgtctgctatctagtagganacagagtcacatcacttcgccaggcagtcaaggcatcagacaagtactttaaattggtaatcagacaacgaaacacgggacacgacccttaagcttaccgngactaccgaacggactacgcttagtacgtaagtttacggtaaggtttaccgggtacctaagtacaaaggttaactttacgaaggtcggtacgagttacggacttacggtacgggtaaacttacgttttaaacttttttaacccgttaaaacctaaacgtttaaaaccccgtaactacggaaacgaaccggtaacgggtaaaacggtnttaaagttccganaacgttactaaagttactttacttagtaccctaaatactaagtagtaactttaccgtagtaccccttaagttaccgtaccgtttacggacccgtaacggtaaaccaaggttacggaagtactaaacgaacccgttanaggttacgacgtacgactaaccg

SEQ ID NO: 35174 - DNA, 993 bp, Homo sapiens
  misc_feature: GYAE6OF02ISV6B.30.67.G01.1.454.CMB.1.raw
tcagcacgctacgtcacgaccggtgctcgatttagagtatacatattggggtttgggggagtcagtcccaaaccagggacacagcagtggacatgagggtcccgtggctcagctcctggggctcctgctactctggctctcaagtgccagatgtcgacatccagatcgacccagtcctccagcgtccctgtctgcatctagtaggagcagatcgacagtctacttcgccgagcgatcgacgacatcagactaacttatttaaacttgtatcacgacaacgaaaccgtacgggacacgtaccccgtaacgtcctaccgtacgaacgtacccgaacgagttcgtacttaggtaaccgtaaaggttttaaccggggtaagggttttccgggggtacccctaagtttaaccgttaaaacgttacgttttaccggtaaggggttacgggtacggggttaagggggtacgggttaacgggtcccgggtttaaggggttaaacccgtttaacggttttttaaacccgttttttaaaacccgttttttaaaacccgtaaaaccccggttttaaaaccccgtaacccgggtttcccggtaaaacgggtaaccccggggtaaacccggttaaaaccggggtaacgttttaaccggttaaccggtacccggttaacccgtaacgtttaaaccgtttaaacccgttttaaccgggtttaaccctttaaccgtttaaaaacccgttaccgtttaaacgttttaacccggtaaacgttttaacccgttttaccccccgtttaaacccggtttaccccgtttaaacccgtttaccccgggtttttacccgggaccccggggttttaaacccgggaaaacggtttaaaaccccggggttacgggtaaaacgttaaccccgggtttaaaaccggtaaaaacccccgggttacgggtttaaccgggtttaaccggggaacccggttacccgtaacccggtttaaccccggg

SEQ ID NO: 35175 - DNA, 759 bp, Homo sapiens
  misc_feature: GYAE6OF02H1FCX.30.67.G01.1.454.CMB.1.raw
tcagcacgctacgtcacgaccggtgctcgatttagagtatacatagttggggttggggagtcagtccaaccaggacacagcatggacatgaggtccctgctcagctcctgggctcctgctactctggctctcaagtcgccagatgtagacacttccgaagtactcgacccgtagttcctaccgagccgtcccttaggtccgtagccactactaggtaggacgtacgaaggtacgtaccacctatcctacgttcgaccgaaggtcgtaacgtcgacggtacagttaccaggtaaccttaaacgttatttaaaacgttcggtaattacgacgtaccgtaaggaaaccgtaggacccacgtacccgtaacgcgtaccgtagtactaccgtacggtatacgttcgttacgacgttaggttttaggaacggtttccgggaccttacgagttaacgtctaacgtggtcgtactggacggtatacggtacgacgtttaactttacggtttaaccttacgaaacgtaaaccccgtacgtaacgtaccggtaaaggtaccgggttaaataccgtttaacgtcgggtaactacggtacctttaaggttaccttacggtagttaacacgttaaacctaggttaacctaagttaccctttaacgtacccttagtttaccgtaaccggtttccgaccggtaacggtaactaaggtcgtaacgtaacctacgggtaacgttaccgacggttccgtaccgtctacccgtaaccg

SEQ ID NO: 35176 - DNA, 706 bp, Homo sapiens
  misc_feature: GYAE6OF02IWNUS.30.67.G01.1.454.CMB.1.raw
  modified_base (597)..(597): a, c, t, g, unknown or other
  misc_feature (597)..(597): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtcgccagatgtgacatccgagatcgaccctagtcctccgagccgtccctgttcctgctatctagtaggagacagagtaccacctatctacttcggccgaggcgagtccgaggacctatcgaagactaacttaagttttaaagttggtaatacgaagacgaaacgaaaccggagggtaaccaccgtaccccgtaaggtccctacgtacgtaaccgtccacgtacttcgtctacgtacgttaagtttagggtaacggtttccgggtacctaacgtaccgtaaagttacttacgtaaggtcgtacgtaggttaggtacgttacggtacgggtaactttaagtttttaacttttaaaccctttaaaccgtaaaccgttaaaccctaacgttcgaaccgtacgggtaaacccgtaagttattacgttcgacgtaacgacttaagttatacgttacgaccttaanaacttattaacgtaattaaccgtccttacgttacttccttaccgttccgtacgtaccgaaactaacggactacgaactaacgaacgtacgtagtaccgatcgacctacg

SEQ ID NO: 35177 - DNA, 760 bp, Homo sapiens
  misc_feature: GYAE6OF02GUH9X.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctagtaggagaacagagtcaccatccacttcgccgaggcgaacgtacgaacggacatcaacgactaaacttaattttaaaagtttggttaatacgagacgaaacggaaaacccgacggggaaccaccgtaccccttaacggtaccgtccgtacgtacctaccgaccgtatcggtccttagtactaaaggttttagggtaacggtttaccggggtacctagtaacgtaacgtagtttaccgaaggtcgggtacgtaggttacggtacgttacggtaaccgggtttaactttaacgttttaacttttttaaaaccctttaaaccctaaaccttaaaaccgttaaccggtacgtaccgaacgggtaccgggtaaatacgtttacgtacgtacggtaactagttaacttactttaacggttaacttactaaaccttaattaagttaactaagtttaacctaccttaccttaaccgttccgttaccgtttacccggtacccggtaacggtaaacctaaaggttaacggacttaacgtaaccaacggtacgttggtaccgtactacgtacctaacg

SEQ ID NO: 35178 - DNA, 748 bp, Homo sapiens
  misc_feature: GYAE6OF02IPH5P.30.67.G01.1.454.CMB.1.raw
  modified_base (337)..(337): a, c, t, g, unknown or other
  misc_feature (337)..(337): n is a, c, g, or t
  modified_base (384)..(384): a, c, t, g, unknown or other
  misc_feature (384)..(384): n is a, c, g, or t
  modified_base (404)..(404): a, c, t, g, unknown or other
  misc_feature (404)..(404): n is a, c, g, or t
tcagcacgctacgtcacgaccggtgctcgatttagagtatacatattggggtttgggggagtcagtcccaacaggacacagcatggacatgagggtcccctgctcagctccgtggggcctcgtgcttactctggctctcgaagtgccagtatggtacacatccagaactcgaccccgagttcctccgacggtcccgtcccgtgtccttcgactaagttacctaaggtaaggacgaacaggtacgtaccaacctactctaaccgttcgacccggaagggtcctaacgggtaccaggtaccactacgacgtactaaacttaatttaacgtaggtactanagtacaacgtaaaccgaaggacaccgtaccgtaacgtacctaccgtntacctacctacggtatcgtnttactaactaacggtttaggtaaccgggttcggttaaccctacgtaacgtaacgttacttacgtaggtcggtacgtaagggtccgttaagttaccggcgggtttaacttaacttttacgtttaaattaaacccctaataaaccctaaccgtaggtaccgacggtaacctaggtagttctacgtcgacgtattatacctatacgtaactaacgtaatacgtaagttacaacccttcaccttagttacccgttacgtaccggtaaccgtaggtaaactaacggttaggaacgaaccttaaggaaccctaacgggttaccgtagggtcctaacggtcccgttaaacg

SEQ ID NO: 35179 - DNA, 664 bp, Homo sapiens
  misc_feature: GYAE6OF02J3E2Z.30.67.G01.1.454.CMB.1.raw
  modified_base (198)..(198): a, c, t, g, unknown or other
  misc_feature (198)..(198): n is a, c, g, or t
  modified_base (303)..(303): a, c, t, g, unknown or other
  misc_feature (303)..(303): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactcctggctctacaagtcgccagatgtacgacactaccagtactcgaaccctgtcctccacgtccgtcctgtctnacctagtactagtacggacaccagtactccactactctaccgtcgacgtacggccggacgacgaacgacactacacgtaactaacttatttaagtcgtaacgtanacgtaacgaacgaccgacgacctacccgtatacctcgtactacaccggtactacgcgtccgttcgtaacgttaacggttacgggtacgtccggacctacggtatacgtacgtcgtacggtcgacggtgtacgacgttacgtaagtacttacgttttaacttacctacaaccttactaacgtcgacggtaactccggtaatcgtattaccgacttaagacctttacgtactacgttcaagttactaatagttaacttacgtacccttacccgttacctcgttaccttacccggaccgtaggttaaacccgaatacgaaccgtaacttacgaaccgttatggacctacgcttacggcttaccg

SEQ ID NO: 35180 - DNA, 609 bp, Homo sapiens
  misc_feature: GYAE6OF02FQWTU.30.67.G01.1.454.CMB.1.raw
  modified_base (166)..(166): a, c, t, g, unknown or other
  misc_feature (166)..(166): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccngtctccagccgtcctgtctgcatctataggagacacgagtccacatcacttgaccaggcagtcgaggacatcgagctaacttatttaaatggtaatcgagcaacgaaaccgagggacacgacccctaagcctacctgaactccgacgtatcgtctgtactaagtttcggaaggttccgggtaccagtacgaagtacttcgaggtcggacgtagtggatcggaggactatttaacttttactaactactaaaccacgttgaccacggaccgtaatnttacgttnacgtanactagttattacgacgttactaacgtatacgtagtaacttaacgtaccttacctaattcccgttaacgtttcccgaccggtacggtaaacctaaagttacggaacgtaacgtaaccgtaacggttacgtaggttcggactaccgtacgtaaccg

SEQ ID NO: 35181 - DNA, 782 bp, Homo sapiens
  misc_feature: GYAE6OF02F4AMN.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctaataggagacagagtcacatcacttgccaggcgagtcagacatcagactaacttaatttaaattggtatacagacaacgaaaccgagggaaccacggtacccctaagcctccgtacgtactaccgtacgacttcggtacgttacgaccgttaagttttacggggtaaacgggttttcggggtaacccctaagtaccgtaaagtagtttccgtaaggtagggtactaggttacgggtattaccgggttagggtaacttaagttttaacgttttttaaaccctttaaacccgtaaaccttaaacccgtaaacccgtttcggaaccgtaacgggtacccgtaaagtacttaacgttcgacgtaacgtaccttaattaacgttttacgttacgttacttaaacttaacttaaagttaagttaaccttaaacgtttccctaaacccgttacgttttaacccgttacccgttttacccggggtaacccgtttaaacgggtaaaacccgttaaaaggttacgggtaaacgttaaacgttaaaccggtaaaaccggttacgttaaggggttaccgtaccggtaccgtaacccgttaaccg

SEQ ID NO: 35182 - DNA, 767 bp, Homo sapiens
  misc_feature: GYAE6OF02IW4Y3.30.67.G01.1.454.CMB.1.raw
  modified_base (147)..(147): a, c, t, g, unknown or other
  misc_feature (147)..(147): n is a, c, g, or t
  modified_base (453)..(453): a, c, t, g, unknown or other
  misc_feature (453)..(453): n is a, c, g, or t
  modified_base (471)..(471): a, c, t, g, unknown or other
  misc_feature (471)..(471): n is a, c, g, or t
tcagcacgctacgtcacgaccggtgctcgatttagagtatacatattgggtttgggggagtcagtcccaaccaggacacagcatggacatgagggtccctgctcagctcctggggcctcctgcctactctggctctcagtcgccagntgtgacatccagatcgacccagtctccacgccgtcctgtctgcatctagtaggacgacagacgtcaaccatactacttcgccaggcgacgtcgacggactactcgaagtactaaacgttaacttttaaacgttacggtaactacgaacgtacaaacggaaaacccggaggggtaacccaccggtaccccgtaaacgtcccgtaccgttacggtactaccgaacgtacttacggtcttacgtacgtttaacggtttagggtacgggtttaccgggtaccctaagttaacgaacggttacgtttacgngggttcgaaccggttagnggtacgttccggttacgggtaacttttaacgtttaacgttttaaaccctttaaacctaaccttaacccgttaaccgtagtaccggtaacggtaaccggtaaacgtacgttagttaccgagtaacgtaactaacgtttaaccttaccggttattaaccgtaacttaacgttagtagttaactaacccgttacttacccgttattacccggtttaccgttacccgtacgttaccgggtaaactaacgggacgtaacgactaacgtaacgtacggtagtacggtaccgtacacgtaacc

SEQ ID NO: 35183 - DNA, 668 bp, Homo sapiens
  misc_feature: GYAE6OF02JYDUK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtacaccatcacttcgaccaggacgagtcaggacatcagcaaacttaatttaagttggtatcagacaagaaaccgaggaacacgaccctaagacctcctaggactaccgacgtattacgtacgttcgtaccttaaaggtttacgggttaaaggggtttcccgggggtacctaacgtttaaccgaaaagttagtttaacggacggtttcgggacgtaggttacggtagtcggtagggtaacgttaactttaactttttaacctttaaacctaaacgtaaaccctaaccgtacgacgaacggttaaccggaaaggtactaagttcggtaaccagtacctaaattaattactacgttactaacttaatactagtaacttactaactccttaatcgttacgttccgtacgtacggtaactaaggtagactaacgttacgaaacgttgtacgtagtacgacgtactaacg

SEQ ID NO: 35184 - DNA, 800 bp, Homo sapiens
  misc_feature: GYAE6OF02I9TUR.30.67.G01.1.454.CMB.1.raw
  modified_base (346)..(346): a, c, t, g, unknown or other
  misc_feature (346)..(346): n is a, c, g, or t
  modified_base (642)..(642): a, c, t, g, unknown or other
  misc_feature (642)..(642): n is a, c, g, or t
tcagcacgctacgtcacgaccggtgctcgatttagagtatacatattggggtttgggggagtcagtcccaaccaggacacagcatggacatgagggtccctgctcagctcctggggctcctgctacctcgtgctctacgagtccgacgagtatggtacgactactaccgaagtacgtaccgaaccgtaacgttcctaccgacggtccccgttaccgttgtccgtagacttacttacgttaagggaaggacgacaaggtcaccactatccgtctacggacgaggtacgtacgacggaacgtactacgtacgaactaacgtaaacttttaagtttaaggttcggtacngtaacggaacgtaaacggaaccgggaacgtaaccgaccgtaaccgtaccgtacctcgtacgtaccaccgtaacgtactacggttctaacgtaacggtttagtacgggtaccgggttacgaaccgtagtaacgtagtaacttggaggtcgagtacggtgtacgtcgtaacgggtacttaacgttttaacgtttaacctaacgtaaacccttacgtaaccggcgtaacgggaacccggtacgtaaattacggtagttacgataacccgttagtaacttttaacggatttaaacccgtnttaaacgttagtttaagacttaacgtttccctacgttaacttaacctttcgggttacccgtacccggttacgggtaaaaccgtaccgtaaacgggttacgaaacttaacgaacgggttaccgaacgttttccggacgttaacccgtcgtacttaaccg

SEQ ID NO: 35185 - DNA, 513 bp, Homo sapiens
  misc_feature: GYAE6OF02FUNLZ.30.67.G01.1.454.CMB.1.raw
  modified_base (197)..(197): a, c, t, g, unknown or other
  misc_feature (197)..(197): n is a, c, g, or t
  modified_base (329)..(329): a, c, t, g, unknown or other
  misc_feature (329)..(329): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcagaaaccagggacagcccctaagctcctgatccacatgcttgcaatttggaagttgggtcccatcaagnttcagtgcagtgatgtgggatatattttacttaacataaccaactgacacgacgagatattgacagcaatnttactgtactanaatatnaattaactcctaccattactaccgtttcgacccgtcgggtaacctaaagtcggtaacacgtaacctaaacgacttggacgtacgtgactaacccg

SEQ ID NO: 35186 - DNA, 856 bp, Homo sapiens
  misc_feature: GYAE6OF02F44V3.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctcgtcaagtgccagatgtcgactatccagatcgacccagtctccagccgtccctgtctgctatctagtacggacgacagacgtcaccgaatctaacttcgaccaggccgagtcaacggtaccattcgaagacctaaagttaacttttaaacgttaggttaacttcgagtaccaaggaaaaccctaacgggggaccaaccggtacccctaaacggtaccgttacccgtacggaaccgttccccgaaccggtacgttacggtccgtttaacggtaacgttaacggtttttaacggggtaacggttttaccgggggttaaccccctaaggttaaccgggaaaccgttaaacgtttacggaacgggtttacgggaaccgtttaaggtacggggtaaacgtttccggtaacggggtttactttaaacgttttttaaccgtttttttaaacccgtttaaaacccgtaaacctttaaaacccccgttaaaccggttaccgaaaccgtaaaccggggtaaccggaaaacgttaccgtttaacgttacggtacaacggttaacctattaacgtacttacgttactaaacgtataacgttacgtaacttaaccgtccttaacccttactacccgtttacccgttaccgtaaccggttaaccggaaccgttaaagtaccggtaaagtaccgtaaaccgtacggtaacggtgttaaccgtacgtacgtacggtaaccc

SEQ ID NO: 35187 - DNA, 313 bp, Homo sapiens
  misc_feature: GYAE6OF02GP2VD.30.67.G01.1.454.CMB.1.raw
  modified_base (273)..(273): a, c, t, g, unknown or other
  misc_feature (273)..(273): n is a, c, g, or t
  modified_base (278)..(279): a, c, t, g, unknown or other
  misc_feature (278)..(279): n is a, c, g, or t
  modified_base (282)..(313): a, c, t, g, unknown or other
  misc_feature (282)..(313): n is a, c, g, or t
tcagcacgctacgtcacgaccggtgctcgatttagagtatacatattgggtatatagtgcctaggattgaccgttactacggaatggacgtctggggccaaggggaccgcggtcactgtctcctcagcttccaccaaggacccatcggtccttccccctggcgccctgcctccaggagccacctccgagagccacgacgcccgcccgtgggctgccgtggtcaaggactacgttaccacgtacgcgtgctgaggccgggctggcgaaggcganatagnncgnnnnnnnnnnnnnnnnnnnnnnnnnnnnnnnn

SEQ ID NO: 35188 - DNA, 762 bp, Homo sapiens
  misc_feature: GYAE6OF02GV9JP.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgacatctatagganacagagtcacatcaccttgccaggcgagtcgaggacatcagcaactaattaaatgtatcagacaagaaaaccagggaacacgaccccgtaagcctaccgtagactaccacggtactcgaccttaggacttaagtttacgggaaaggtttcgggtaccctaagtacgaaaagtacgtttacgaacggttaggacgtaaggtacggtagttccggtaagggtaacttaacgttttaactttttaaacccttttaaaaccgttaaacccgttaaaaccctaaacccgttacggaaccgtaacgggaaccgggtaaacgtaacgttaagtttaacgaaccgtaagtaaccttaacgtttaaacgtttaaccttacggttaaccttaaccttaaagtttaacttaacggtaactttaaaccgtaccttaaccgttaacctttaaccttaccggttttacccggtacccggtttaaccgggaaaaccctttaaaaaggtacggtaaacgtaacgtaacccgtaaaaccggttaaacggttcggaaccggttcggttaaccgaccttaaccg

SEQ ID NO: 35189 - DNA, 724 bp, Homo sapiens
  misc_feature: GYAE6OF02GI2XZ.30.67.G01.1.454.CMB.1.raw
tcagcacgctacgtcacgaccggtgctcgatttagagtatacatattgggtttgggggagtcagtccaaccaggacacagcatggacatgagggtccctgctcagctccgtgggctcctgctactctggctctcaagtgccagatgtgacatccagatgacccagtctccagcgtccctgtctgcatctaataggagacagagtccaaccatactacttcggcctagggcgtagtacgaaggacactcgaagactaaacttaactttaaagtttaggtaattcgaagacctaaacggaaaaccgaacgggtaaccaccggtaccccctaagtcctacccgtacgacctacccacggtactcggtcttagtacgtaagtttaggggtaacggtttccgggtaccctaagtaacgtaagttaacgtttacgacggtacggtacgtaaggtacggtacgtacggtacggtaacttacttttaacgttttaaaccgttaactaaaccgtaaccctaacgttgaaccgtacggtaaccggaatacgttattacggaccgtagtaccgttaaatttaccgttaacgttacgttactaaattacgtattaactaacgttaacttaccgtaccttaactaccgttaccgttcccggacggtaccggtaaacgtaacgtgggtaacctaacgaacgttaacgccggttacgtaccggacgttaccgctaaccg

SEQ ID NO: 35190 - DNA, 590 bp, Homo sapiens
  misc_feature: GYAE6OF02IZBFO.30.67.G01.1.454.CMB.1.raw
  modified_base (429)..(429): a, c, t, g, unknown or other
  misc_feature (429)..(429): n is a, c, g, or t
tcagcacgctacgtcacgaccggtgctcgatttagagtatacatattgggtttgggggagtcagtcccaaccaggacacaggcatggacatgagggtccctgctcagctcctggggctcctgctactctggctctcaagtgccagatgtgacatccagatgacccagtctccagcgtccctgtctgcatctataggagacagagtccaaccgtatcctacgttcgaccaggacgagtcaggacatcagacaacttatttaaattggtactcagacgaagaaacgagggacacgacccctaagcctccgtgactaccacgactgtcttgacgtaagtttagggaacggttcgggtacccatacaagtattacgagtggacagtggatcggtgggtactatttactttaacttaactaactaaccgactancgagacggaatatattgacagactattactctagtactaactaatatagtactactacctaccgttattaccgtaccgtttaccggccgttaaccggaacttaaacgtcggtaagtactaaccgtaaacgtacggttacggtacggacgtacgaccctacg

SEQ ID NO: 35191 - DNA, 616 bp, Homo sapiens
  misc_feature: GYAE6OF02FQBAD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccaccatccacttgccaggcgagtcaggacatcagacaacttaatttaaatttggtatcaagcaacgaaaccgaggggacacggacccctaagcctccgtagactccacgattcgtcttagtacgtaagttttgggaacggttcgggtacccatacgaagtactttacgaggtcggcgtagtggtatcgtagggaattagtttaacttttaccttaaacaactaaacccgtactcgacgtacggaccggaatattatacgactatactattacttacgtagttaacctaataattagtattaacttaactcccttaactacttaccgttaccggtttcgacccgtaggaaacctaagtacggtaagtaacctaagtaaaccggtagtacggtcggacgtaccgacctaaccg

SEQ ID NO: 35192 - DNA, 934 bp, Homo sapiens
  misc_feature: GYAE6OF02FYJAL.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccgagtcctccagccgtccctgtctcgcatctagtaggagacgagtacgtccacctatccgtacttcggcccgtaggggtacggacgtccgaacgggactaactaaccgacgtaacctaaaaccgttttaagttttaaaacggttttggttaaactccgtaacggaaccaaaccgggaaaacccggtaacggggaaccctacccgggtaacccccgttaacggtccccttacccgttaggaacccctacccggtaaccgtaacgttcggttaaccgttaggtaacgtttaaacggttttaacgggggtaaaccgggttttacccggggtaccctaactttacgggaaagtttacgtttaacccggtagggttacggtaaccgtaggggttacggttacgttaccgggttacgggtaactttaacgtttttaaccttttttaaacccttaaaccttaaacccgttaaaaccccgtacccgttacggtaccccgtaaacggggtaaccccggttaaaaggttacgtttaaccggttaccgaacggtaccttacgttaaacctttaacgtttaacccgttttacggttaaaccttaacttaaacgtttagttaaaccgtttaactttaaccttacccgtttaccctttaacgttaacccgtttacccggttttaccccgggaacccgttaaccggtaaacgttaaaccgggtagtaaaccgttaaaccggtaacgtaaaccgtacggtacggtaacgtcctacgtaccgtaccg

SEQ ID NO: 35193 - DNA, 303 bp, Homo sapiens
  misc_feature: GYAE6OF02JR4M7.30.67.G01.1.454.CMB.1.raw
  modified_base (254)..(254): a, c, t, g, unknown or other
  misc_feature (254)..(254): n is a, c, g, or t
  modified_base (272)..(273): a, c, t, g, unknown or other
  misc_feature (272)..(273): n is a, c, g, or t
  modified_base (275)..(275): a, c, t, g, unknown or other
  misc_feature (275)..(275): n is a, c, g, or t
  modified_base (278)..(303): a, c, t, g, unknown or other
  misc_feature (278)..(303): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtccttcccctggcgccctgctccaggagcacctccgagagccacagcccgccctgggctcgcctggtacaagggactaccttcacgtagccgtgctgacgtcgggcnggccaaggcgcagtgctnngntannnnnnnnnnnnnnnnnnnnnnnnnn

SEQ ID NO: 35194 - DNA, 1014 bp, Homo sapiens
  misc_feature: GYAE6OF02HDTE2.30.67.G01.1.454.CMB.1.raw
tcagcacgctacgtcacgaccggtgctcgatttagagtatacatattggggtttgggggagtcagtcccaaccaggacacagcatggacatgacgggtccctgctcagctccgtggggctcctgctactctggctctcaagtgccagatgtgacactccagactcgacccgtagtcctaccgacgtccgtccctgtctgactattctagtaggacacgacggacgtaccacctatctaaccgttcgacccggacgggtcgtacggtacgaaacgggtacctacttaccgaacggtaacctttaaaaccgttttaaagtttttaaaacggttttacgggttaacttaaccggtacggtaaaccgaaaaccgggtaaaaaccccggacgggggtaaacccgtaacccccggtaaccccccgttaaacggttccccgtacccgtttaggaaccccgtttaacccgaaacggttacgttccggttaaccggtttaccgtaaccgttttaaaacggggttttacggggttaaccggggtttaccggggttaaccccttaaacggttaccgtaaaacgggtttacgtaaccggttacgggttaaccgggtaacgtaacggggttacgggtaacgttaccggggttacgggttaaaccttttaagttttaacccgttttttaaaacccttaaaccccttaaaccgttaaacccggttaaccccttacgggaaaccgggtaaccgggtaaaccggttaaagggttaacctagggtttaaccggtaaacgtaccggtaaacgttaaaccgttttaacgttttaccgttaccggtaaacctttaaaacgttaaacgttactttaaacggttaacgtttaaaccctttcctaacccttaaccgttttaccgtacccggtttacccgggaccgggtttaaaccggaaaccgttaaaggtaccggtaaacgtaacgttaacggtaaccggttacgtaggttaccgggacccttacgtaccggtaacc

SEQ ID NO: 35195 - DNA, 682 bp, Homo sapiens
  misc_feature: GYAE6OF02ICRMC.30.67.G01.1.454.CMB.1.raw
  modified_base (139)..(139): a, c, t, g, unknown or other
  misc_feature (139)..(139): n is a, c, g, or t
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (432)..(432): a, c, t, g, unknown or other
  misc_feature (432)..(432): n is a, c, g, or t
  modified_base (528)..(528): a, c, t, g, unknown or other
  misc_feature (528)..(528): n is a, c, g, or t
  modified_base (637)..(637): a, c, t, g, unknown or other
  misc_feature (637)..(637): n is a, c, g, or t
  modified_base (647)..(647): a, c, t, g, unknown or other
  misc_feature (647)..(647): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcagtnccagatgtgacatccagatgaccctagtctccagcgtcctgtcctagcctagtcagtaaggnacagactccacctntcgtacttccgcgtaggcagtcacggtacagtactagaactaaccttaagttttaaactggttaataccgtaagacgtaaacggaaaaccgagggaacctacggaccccgtaacgtaccgtaccctggaaccttccgaacgagtccgtaacttcgaactaacggttttacgggaacggtttaccgggtccaattaccgaaagtactttacgtaacgnggtacgtaggtacgaccgttagtcggggtaactacgtttttaaactttacctaaaacctacgaaaccctacgtaggtacacggtaacgtaaagttntaattacgccgagttacctaagtatttaccgacttaagaccgaattatagaactaacctcgtacctaagttccaccgtttaccgacgtcgtaaagtaaagtgaacttanaaacccggtntaacgggcttaacggcccgttaagccctaaaccgg

SEQ ID NO: 35196 - DNA, 716 bp, Homo sapiens
  misc_feature: GYAE6OF02FUCP0.30.67.G01.1.454.CMB.1.raw
tcagcacgctacgtcacgaccggtgctcgatttagagtatacatattggggtttgggggagtcagtcccaaccacggacaccaggctatgggactatgtagggtccctgctcagctcctggggctcctagctactctggcttcgtcaagtgccagtattgtgacatcctaagctcgaccctagtctcgagcctcctgtctgcagtctataggacacgagtcggtccacgatcacttcgcagggccagtccaggactatcacgtacaaacttatttaaattggtactacagtacacggtaaaccgacgggacacggacccctaacgaccgtccgtagtacgtaccgacggtactgtctttacgacgttaagttagggtaggtttcgggtccagtacaagtactcgtagtcggtacgtacggttaggacgttccgtacggtacttacgtttacttttaaaccgttaaaccgtacttaaaaccctacgtaacgaccgtaaacgggtaaccggtaaatactttacgttacgacgtaaacgtctaaattacctttaacctagtaacctaactaacgtaagttacgtaacttaaccgttacctcccttattacgttaacccgttacccggacccgttacggtaaacctaaagggttcgggaaacgttacgtaacccgtaaacggttacgtaccggttcggtacccgttcggaccctaaccgg

SEQ ID NO: 35197 - DNA, 271 bp, Homo sapiens
  misc_feature: GYAE6OF02HJSMA.30.67.G01.1.454.CMB.1.raw
  modified_base (176)..(176): a, c, t, g, unknown or other
  misc_feature (176)..(176): n is a, c, g, or t
  modified_base (243)..(243): a, c, t, g, unknown or other
  misc_feature (243)..(243): n is a, c, g, or t
  modified_base (249)..(271): a, c, t, g, unknown or other
  misc_feature (249)..(271): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtccttccccctggcgccctgcctccaggncacctcgagagcacagccgccctggctgctgcagctactcagtgcgtgctgagcggctggacaggcncatagnnnnnnnnnnnnnnnnnnnnnnn

SEQ ID NO: 35198 - DNA, 810 bp, Homo sapiens
  misc_feature: GYAE6OF02ICLPN.30.67.G01.1.454.CMB.1.raw
  modified_base (791)..(791): a, c, t, g, unknown or other
  misc_feature (791)..(791): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctacaagtgccagatgtagacatccagatcgacccagtcctaccagtccgtccctgtcctgactacttactagtaggacgacgagtacgtaccaaccacttaccgaacgtttcgacccggacgggaccgtaacggtaccgaacgggtacctaagtccgaacgacctaaaactttaacgtttttaaaaacgttaggtttaacgttaccgtaaggtacccgaaacggtaaaacccgaacggggaacccgaaccggttaaccccccgtaaaggtcccccgttaccgttacggtaccgtaccccgtaacgtaacgttcggtccttaacgggtacttaaggttttaccgggtaaggtttaccggggtaccctacgtaactaacggtatttacggtacggtcgggaacttcggggtagtacggtcgtagggggtacttaacgttttaacgttttttacccttaaaacgttaaccttaaaacccgtaacccgttacggaaccgtaccggggtaaccggtaaagaacgttttaagtacgaccgtaacgtaaccttaaattcgttaaccgtttagtaccgttaaactattaatagttaacaacgttccctacgtactacttaccgttccgtaccgtacggaagtaacgtagaacgtagaacctagacnggtcgagtcgtactaaccg

SEQ ID NO: 35199 - DNA, 669 bp, Homo sapiens
  misc_feature: GYAE6OF02IX3B5.30.67.G01.1.454.CMB.1.raw
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcactgccaggccagtcaggacatcagcaactattaattggtatcagcagaaccaggacagacccctaagctccgtgactccacgatgcttgactaagtttggtaaggttcgggggtacctagtactaagattacgagtggacgaggtgagtcgtagggactaagttaatttttaactttaaacctaacgtaaacctaaccgtacgtacgacggtaccggaaacgtaagtacgttgtacgtaacgacttaacttacgtttaacctggttaacccttaaacgtaaacttagttaacgggttaaactttaccgttaccccttaacgttttaccttaaccgttttacccgggtacccggttaccggggtaaacccgtaaaacgttacgggaaacgttaactaccgtaaaaaccgtaacgttacggttacggtaccgttaccggtacctacccttacttaccgg

SEQ ID NO: 35200 - DNA, 681 bp, Homo sapiens
  misc_feature: GYAE6OF02IQ7CV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagtcgtccctgtctgcatctagtaggacgacagatcaccatcattcgaccaggcagtcaggacatacagacctaattaatttaaatggtatctagacgaagtaaccgagggacaacccgacctaacgccgtaccgtagacctaccgaacggtatcgtcgtttacgacgttaaaggtttacgggtaacgggttaccgggtaccctaagtacgtaaaggttagttaccgaaggtcggtacgtaggttacggacgttaccgtaagggtacttaagttttaacgttttaaccctttaaaactaacgttaaaccctaaacgtcggtaacgtacgggtaaccgaagttacttagttacgactaagtacctaatttaacgtcttacgttaactaagtattaactaggtaactttaaccgtcctacctactttacccgtaacggttcccgtacgtaacgttaaacggaagtacggaagttaaccaacgttaaccaggttcgtacgacgtcacctacg

SEQ ID NO: 35201 - DNA, 752 bp, Homo sapiens
  misc_feature: GYAE6OF02FS41P.30.67.G01.1.454.CMB.1.raw
  modified_base (205)..(205): a, c, t, g, unknown or other
  misc_feature (205)..(205): n is a, c, g, or t
  modified_base (644)..(644): a, c, t, g, unknown or other
  misc_feature (644)..(644): n is a, c, g, or t
  modified_base (708)..(708): a, c, t, g, unknown or other
  misc_feature (708)..(708): n is a, c, g, or t
tcagcacgctacgtcacgaccggtgctcgatttagagtatacataattggggtttgggggagtcagtcccaaccaggacacagcaactggacatgaggtccctgctcagctcctgggctcctgctacgtctggctctcaagtcgccagatggtgacatccagactgacctgtctccagccgtccctgtcctgcatctagtagganaccgagtacgttccaacgtatcacgttgaccaggtcctaaggtcaaggactaacgtcaacgaacctaaacttaagtttaaacttcggtaactcgaagtaccaaagtaaacccgtagggacctacggtacccctaaggtccgtaccgtaggtacctacccgaagtacgttcgtaccgtggtaaccgttaaggtttcggggaacgtttcgggtaaccctagttaccgaaggtactttaccgaggtacggtaacgtggttacggacgttccggtagggtaaactttacttttaaccgttttaaacgttaaccgaaacgtaaccccgtaaggttcggaaccgtaacgggtaaccggtaagttacttacggttaacacgttacggtaactacgttttaggtactacgttaactaacgttaagtcgtaagttaactcgttacccncgttaaagtcccgtttcggtaaccggtacgtaaccggtaaaccgtaaaggtcttaaaacccggnttaaaccgtaacggtctttaggccgttcaccggtaccttaccgg

SEQ ID NO: 35202 - DNA, 747 bp, Homo sapiens
  misc_feature: GYAE6OF02HZHD0.30.67.G01.1.454.CMB.1.raw
  modified_base (704)..(704): a, c, t, g, unknown or other
  misc_feature (704)..(704): n is a, c, g, or t
tcagcacgctacgtcacgaccggtgctcgatttagagtatacatattggggtttggggggagtcagtcccaaccaggacacagcaatggacatgagggtccctgctcagctctgggctcctgctactctggctctcaagtgccagatgtgacatcagatcgaccacgtctccgacgccgtccctgtctacgctatctagtaggagacaggtacgtaccaactaactcctacgttacgcccgtagggacgtacgacgaacggtacacttaccgacgtaactaaaacctttaatttttaaacggtcggttaactaacggtacgtaaccgaacgtaaaacccgggtacggaaaccgtacccgtaaccccgtaacgtcctaccgtacgtacctaaccgaacgttcgtacgtcgttacgtacttaaggttacggtacgggttaccgggtacctacgtaaccgtaagtctttacgaggttacggacgtacggtaaggtcgtacgggttagtacctttaacgttttaactttttaaacccgtttaacctaaaccgtaaaccgtccggttaacgaacggaaccgtacgggaaacgttagttacttacggacgaacggttaacttacgttaacacgttacttaaccaacgtaatagacttaacgtactacccgtataccttagtaccgttccgtaaccggtataacggaagtntaaccgtactaacgttacggaacttggaccgaagtccaggtcc

SEQ ID NO: 35203 - DNA, 777 bp, Homo sapiens
  misc_feature: GYAE6OF02FZ9B0.30.67.G01.1.454.CMB.1.raw
  modified_base (206)..(206): a, c, t, g, unknown or other
  misc_feature (206)..(206): n is a, c, g, or t
  modified_base (417)..(417): a, c, t, g, unknown or other
  misc_feature (417)..(417): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccgagccgttccctgtctgcgtatctagtagganacagagtacaccatcacttgaccgaggcgtacgtcgaacggacactcgacgactaacttaacgttttaagttggtaactacgagacgtaacgaaaccgaggaccaccgtacccgtagccttaccgtgaccgtaaccgacgtactcgtacgttagtacttaaggtttcgggtaacggtttacggccctaagtaactaacgttacgttacggnggttacggagtagggtcgtaacgttcggtacggtaacttacggttttaacttttaaccgttaaaccgaccttaaaacccgtcgtaacgtacggtaaaccggtacgtaaacgtacttacggttacgacgttaagtaccttaaagtttaaccgtttccgtaagtttaacctaacgtttaaagtttaccgttaagttaaccgttaccgtttacccgttaaacctttaccgtttacccggtttaacgtttaccccgggaaccggttaacccggttaaaacgtaacgggtacccgttaaaaccggttactaaaccggttaaacttcgggggttaactacggtaccgttacccgtaattaccccgg

SEQ ID NO: 35204 - DNA, 351 bp, Homo sapiens
  misc_feature: GYAE6OF02HHANI.30.67.G01.1.454.CMB.1.raw
  modified_base (257)..(257): a, c, t, g, unknown or other
  misc_feature (257)..(257): n is a, c, g, or t
  modified_base (263)..(264): a, c, t, g, unknown or other
  misc_feature (263)..(264): n is a, c, g, or t
  modified_base (266)..(267): a, c, t, g, unknown or other
  misc_feature (266)..(267): n is a, c, g, or t
  modified_base (276)..(278): a, c, t, g, unknown or other
  misc_feature (276)..(278): n is a, c, g, or t
  modified_base (281)..(282): a, c, t, g, unknown or other
  misc_feature (281)..(282): n is a, c, g, or t
  modified_base (284)..(285): a, c, t, g, unknown or other
  misc_feature (284)..(285): n is a, c, g, or t
  modified_base (287)..(288): a, c, t, g, unknown or other
  misc_feature (287)..(288): n is a, c, g, or t
  modified_base (290)..(351): a, c, t, g, unknown or other
  misc_feature (290)..(351): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggccgccctgctccaggagcacctccgagagcacagcccgcctgggctgcctggtcaaggctacttccacgtagcgtgctgagcgggctgggcaagggcncatagnngnnagctcgtcnnntgnnannanngnnnnnnnnnnnnnnnnnnnnnnnnnnnnnnnnnnnnnnnnnnnnnnnnnnnnnnnnnnnnnn

SEQ ID NO: 35205 - DNA, 297 bp, Homo sapiens
  misc_feature: GYAE6OF02G9OOB.30.67.G01.1.454.CMB.1.raw
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (262)..(263): a, c, t, g, unknown or other
  misc_feature (262)..(263): n is a, c, g, or t
  modified_base (265)..(297): a, c, t, g, unknown or other
  misc_feature (265)..(297): n is a, c, g, or t
tcagcacgctacgtcacgaccggtgctcgatttagagtatacatattgggtatatagtgcctaggattgaccgttactacggaatggagtctggggccaaagggaccgcggtcactgtctcctcagcttccaccaaggacccatcggtcttccccctggcgccctgctccaggagcacctccgagagcacagccgccctgggctgcctggtcaaggctacttccngtagcgtgctgagcgggctggcaaggcncagtagntnncnnnnnnnnnnnnnnnnnnnnnnnnnnnnnnnnn

SEQ ID NO: 35206 - DNA, 757 bp, Homo sapiens
  misc_feature: GYAE6OF02HJN04.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgaccagtctccagtccgtccctgtcgtgactactactaagtacggagacagacgttaccaccaatacctacgttagacccgagggtaccgaacgttacgaacggactactaacgagaacctaaagttaacttttaaagttacggttaatacacgacgaaacgaaaaccgacgggtaaccaccgacccctaaacggtcctaccgtacgactaccgagtactacggtcttacggaccttaaggtttaggtacggttacgggtacctagtacgtaacgttacgttacgtacggtaggcgtaagttacgggtacttcggtagggtaacttaacgtttttaaaccgtttttaaccgtttaaaccgaaaccgttaactaacgttcggaaccgtaacggtaaccggaaacgttacgttattacgtacgaacgtattaacgttagttaccgtgttaaacgtaactaattacgttagtaacttaccggttactacccgttaaattaccctaccgtttccggacggtttaaccggaaaactaaggttcgtaacgtaacgttaaccgaaacggtaccgtaagggtacccttagtacctaaccgttaacg

SEQ ID NO: 35207 - DNA, 743 bp, Homo sapiens
  misc_feature: GYAE6OF02IMZDH.30.67.G01.1.454.CMB.1.raw
  modified_base (125)..(125): a, c, t, g, unknown or other
  misc_feature (125)..(125): n is a, c, g, or t
  modified_base (156)..(156): a, c, t, g, unknown or other
  misc_feature (156)..(156): n is a, c, g, or t
  modified_base (738)..(738): a, c, t, g, unknown or other
  misc_feature (738)..(738): n is a, c, g, or t
tcagcacgctacgtcacgaccggtgctcgatttagagtatacatattgggtttggggagtcagtcccaaccaggacacagcatggacatgaggtccctgctcagctcgtgggctcctgctactcnggctctcaagtcgaccagatggtagactacnccgaagtactacgaccctaggtcctaccacggtcccgtaccctgtccgtcgtctaagtacttaggaacggagaccgagtacgtaccacgtaacgtcctacgttcgaccggtagacggtacgttaccggaacggtactacgtacgaacgtaaccgttaaagttaagttttaacgttcggaattaccgtaacggtaacgaaaccggtaaaccgggtacggaacccgtaacccgtaaccccggtaacgttcctaaccggtctaacctaccgaacgttacgtcgtaccgttacgtaacgttagggtttaccggtacggtccgtaacgatacgtaagttcggtactggtacggtacaggtttaccgattcggacggtattaacgttactttaacctaactaccgtaccgtacacgtacgacgtacgagtacgtagttcgagtacttaccgtaacttacgagttactaactacgtaacgtattaaccgtaagttcctaacctacgttaccgtacgtaccgttccgaacggtaccgtaaactcggaacgtacgtaaccgtacgtacgttcgtacgtacggtctacggtntaacg

SEQ ID NO: 35208 - DNA, 894 bp, Homo sapiens
  misc_feature: GYAE6OF02HDQHD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggctctcagtcgccagatgtgacacgtcagatcgacccagtcctaccacgtccgtccctgtaccgtgactacttactaagtaggacacgagtacgtaccacctatacctacgttacgaccgaggaccgtaagtcgaacggtactacgtaccgagaacttaaagttaacttttaaacggttggaacttacgaacgaaccgtaaacggaaaacccggtacggaacccgtacccgtaaccccgttaggccctaccgtaggtaccgtaccgtaaggtacgtacggttaccgtttataacccggtttaaaggttttggggtaaccggggtttccggtaacctaacgttaaccgtaacggtttaccggttaaggcgggttacgggtactacgggggtttacgtaccggttacggtaaaccgggttttaaatttaacggttttaaacctttttaaaccctaaaccgtttaaacccgtaaaccccgtaacggtacgtaaaccggtaaccggtaacggtaacgttacggtacgtttaacggacttaacgtacgtttaaccttaacttaaccgttaacgttaaccttaaagttaagttacttaaagttaacgttaacctttaaccggttacctttaaccggttaccctttaacccgggtacccggttaaccgtaaccgggtttaaacggttaaccggtaccgtaaaggttaacccgttaaaccggttaacgtttaccggtacggtaaccgggtttaccgtaccgtacccgttaccg

SEQ ID NO: 35209 - DNA, 710 bp, Homo sapiens
  misc_feature: GYAE6OF02I0D8P.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtcctccagccgtccctgtcctgcatctataggagacagatcaccatcacttcgccaggcgagtcacggacatcagcgaactaattttaaattaggtactacagtacaacgaaaccgacgggaacaccgaccccaagtcctcctacgactccacgactcgtctgtacgtaagtttgggtaaggttacgggtaccctaacgttacgtaacgtacttacgtacggtacggtacgtacggtggtaacggtttccgtaggggtaacttacgttttaaaccgtttttaacctttaaaccctaaaccgtttaaacccgaacccgtttcggaaccgtaccggtaaccgggtaaacttacgttaatacggtaacccgtagtaccgttaaagttacttacgttaacgtctaaacgttaattacgtaacgtattaacttaccctccttaacgtttaccgttacccgtttccgtaaccgtaacggtaaaccgttaaacgtacggtaaagtaactaaccgtaaacgtaacggttacgttaggccttacgacctaccg

SEQ ID NO: 35210 - DNA, 778 bp, Homo sapiens
  misc_feature: GYAE6OF02JEQE9.30.67.G01.1.454.CMB.1.raw
  modified_base (169)..(169): a, c, t, g, unknown or other
  misc_feature (169)..(169): n is a, c, g, or t
  modified_base (771)..(771): a, c, t, g, unknown or other
  misc_feature (771)..(771): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagttcnccagccgtcctgtacctgctactctatacggatacgagtacgtcaacctatcgtaacgttcgaccgtaggaccgtagtaccgaaggtacctacgttaccgaaggacctaaacgttttaagttttaaaacggttacggtactacgtaacgtacgaaaccggaaaaccgtcgggtaacccaaccggttaccccctaagtcccgttaccgtacggtacctaccgtaccggttaacgttccgtacgttaccggtaacctttaaaggttttaccgggtaacggtttacccgggttacccctaagtttaacgggaacttaaccggtttacgtaaacggttccggtaacgttaacgttacgggtaaccgtttacggtaacggttaaccttaccgtttttaaacctttttaacccggttaaccaaccggttttaaaccacccggttagtaaaccgacgggtaaccgtaacgtattacgttacgactacgtactacgttacttacgttaccagtaacttagtacgtagtaccttacgttctccgtaattctccgtcgacgtaacgtaaagtactagaacgtaccgtataaccgggtctaacgtgtacgtanacgtaac

SEQ ID NO: 35211 - DNA, 697 bp, Homo sapiens
  misc_feature: GYAE6OF02HY9PJ.30.67.G01.1.454.CMB.1.raw
  modified_base (204)..(204): a, c, t, g, unknown or other
  misc_feature (204)..(204): n is a, c, g, or t
tcagcacgctacgtcacgaccggtgctcgatttagagtatacatattgggtttgggggagtcagtcccaaccaggacacagcatggacatgagggtcctgctcagctcctgggctcctgctactctggctctacaagtgccagatgtagacatccagatcgacccagtcctccagccgtcctgtctgctatcgtagaggacganagtacgtacaccatacgtacgttcgaccgtaggcgtaagtccaaggacctacgtaccgagacctaaacttaatttaaagttaggtacttacgacgtacgaaacggaaactaacggggaacaaccgtaccccgttaaacggcttccggactaccgtaccgtaaccgtaagttcgtaccgttaagtaccggttaagttagggttaaccggttacgggtaccctaaggtacctaaggtatttccgaaggtccgaggtacgttagacgtcgtaggtaacctagtttaatttaaccgttaaacaaacgttaaccgtaaccgtcgtaacgacggaaaccggtaatacgttacgttagtaccgagtacctattattactagttactaaagtataagagttactaacttaccgttctaacttacgtcgtaccggtaccgacggtaaacaacgtacgacgttaaccacgtaaacgtcgtagcggttacacggtacctaaccg

SEQ ID NO: 35212 - DNA, 273 bp, Homo sapiens
  misc_feature: GYAE6OF02HDAHS.30.67.G01.1.454.CMB.1.raw
  modified_base (260)..(273): a, c, t, g, unknown or other
  misc_feature (260)..(273): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgaggcgggctggcaggcgcatagnnnnnnnnnnnnnn

SEQ ID NO: 35213 - DNA, 917 bp, Homo sapiens
  misc_feature: GYAE6OF02JCNL4.30.67.G01.1.454.CMB.1.raw
tcagcacgctacgtcacgaccggtgctcgatttagagtatacatattgggtttgggggagtcagtcccaaccaggacacagcatggacatgacgggtccctgctcgagctccgtgggctcctgctactctggctctcaatgccagatgtgacactccagatcgaccctagtcctcctagtccgttccctgtctgctattctactaggacgaccgtagacgttaccacccgtaattcccaaccgtttcggaccccgtaagggtccgtaacggttccaagggtaaccctagttccgaaacgtacccgttaaaaacctttaatttttaaaaaccggtttgggttaaacttacgtaacggttaacccgaaaccggtaaaacccggtaacgggggaaaccccgtaaccccggtaaccccccgtttaaaacggggtccccttacccggtttaacccggaaaccccgtaaccgggtaacttcccgggttaacctttacggtaacccgtttaaaggttttaaccgggggttaacgggtttacccgggggtacccctaaaggttacccggtaaaaacgttccggttacggtacggtacggtaacgtacggggttaagtacgtaccggtacgggtacttaacgtttacctttttaaacgtaaccctaaacgttaccctaaaccgtcgaccgtacggtaaccggtaagtacttacgttaccggcgtaaccgtactaaccgtttacgtttaccgtacgttaacttaaaccggttaattaaccggttaagttaacctaaccgtttaacccctttacaaccttttaacccgtacggtttacccgtaccggtaacggtaaaccgtaaggtaacgggtacctaaacgtacccgtaacttacggtacgtcggtaacttcccgaccgtattaccg

SEQ ID NO: 35214 - DNA, 842 bp, Homo sapiens
  misc_feature: GYAE6OF02FV0Q5.30.67.G01.1.454.CMB.1.raw
  modified_base (225)..(225): a, c, t, g, unknown or other
  misc_feature (225)..(225): n is a, c, g, or t
  modified_base (393)..(393): a, c, t, g, unknown or other
  misc_feature (393)..(393): n is a, c, g, or t
tcagcacgctacgtcacgaccggtgctcgatttagagtatacatattggggtttgggggagtcagtcccaaccaggacacagcatggacatgagggtccctgctcagctcctgggctcctgctactctggctctcagtcgccagatgtgtacattccgagactacgacccagtctaccagtccgtaccctgtctcgaccatcgtaatacggactaccacggtacnctaaccactaccaacttcgaccgtaaggtcgtaacgttcgaacggacacgtacgactacctaacttaactttaaagtttcggaacttaccacgtaccgaaaccgtaaacccgacgggtaacaaccggtaccctaagtcccgtccgttaaggaccgttacccgaacgtnttacggtccgttacgtaacgttaacggttaggttaaccggtcggggttaacccatacgtaaagtacgtttaggaccggttggaccgtagggttcgtaacggttcggtaacggtaactatttttaaccgttttaacctaaaccgttaacaaacccttaacgtaccgtacgggaacccggtaacggaattaacgttaacgttcgtaccgtacggtaaccttaaagtttacttttaccgtacggttaaccttaaaccgtaagtttaccgttaaataaccctttttaaacggtcccgtttaacccctttaacgttacccgtttaaaccccggtttacccgggaccgtttaacccggggaaaaaccttacggggttaaacgaacggtaacctttaaaacgggtaaccggttaacggtaccggttacgggtacttaccgggaaccctttaaccgg

SEQ ID NO: 35215 - DNA, 540 bp, Homo sapiens
  misc_feature: GYAE6OF02IRIJG.30.67.G01.1.454.CMB.1.raw
  modified_base (401)..(401): a, c, t, g, unknown or other
  misc_feature (401)..(401): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactaatttaaattggtatcagcagaaaccagggacagcccctaagctcctgatccagatgcttgcaatttggaagttggggtacccatcaagattacagtggcagtggatcgtgggactagttattttactttaaaccataaaccaacctgcagaccggaanatagttgcagactatacttactgtactacaatatagtaataattcctaccctaagttcctaccgtttcggcccttacgggaaccctaaaagtggaagtacgtaaccaaaacggtacgtagtacggactcggactaaccc

SEQ ID NO: 35216 - DNA, 300 bp, Homo sapiens
  misc_feature: GYAE6OF02IFASV.30.67.G01.1.454.CMB.1.raw
  modified_base (199)..(199): a, c, t, g, unknown or other
  misc_feature (199)..(199): n is a, c, g, or t
  modified_base (260)..(260): a, c, t, g, unknown or other
  misc_feature (260)..(260): n is a, c, g, or t
  modified_base (277)..(300): a, c, t, g, unknown or other
  misc_feature (277)..(300): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtccttccccctgggccgccctgcctccgaggacgccaccctccgagagcacncgcccgccgtgggctgccgtggtacaaggcctacttccacgtagcgtgctgacggcgggcnggacaggcgctagtagnnnnnnnnnnnnnnnnnnnnnnnn

SEQ ID NO: 35217 - DNA, 552 bp, Homo sapiens
  misc_feature: GYAE6OF02I8YCW.30.67.G01.1.454.CMB.1.raw
  modified_base (136)..(136): a, c, t, g, unknown or other
  misc_feature (136)..(136): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (493)..(494): a, c, t, g, unknown or other
  misc_feature (493)..(494): n is a, c, g, or t
  modified_base (496)..(552): a, c, t, g, unknown or other
  misc_feature (496)..(552): n is a, c, g, or t
tcagcacgctacgtcacgaccggtgctcgatttagagtatacatattggggtttgggaagagttacagccttggctaaacctgggagcctggccccttgtgaagagggggtatcccaagtccctcccccggggggntgggctttggcgtgccctgtggcagcagtcttcttgtctccttccccagctcgaggtactgtgcagtagagatgccgagtcgtccccttccaacccgaggcgacgggtcctccgcccccttaccggcgggaccctacgtcccgccccctacccggacgtccggtaggggacggaccaaggaccacctaacccggtaccggaccccccgacctacccgtacctaccccctcgtttcccccgttaccccacccccttcccgtaactaccggtacggtcccggtcgcgttacggggaccggtccggggtaccgtacggggaccctaaacgggggccgaccgttaagnggcctancnccgnntnnnnnnnnnnnnnnnnnnnnnnnnnnnnnnnnnnnnnnnnnnnnnnnnnnnnnnnnn

SEQ ID NO: 35218 - DNA, 752 bp, Homo sapiens
  misc_feature: GYAE6OF02HYNSE.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagtatgtgacacgtccagtatcgacccctgtcctccgagtccgtcccttgtctcgctatcgtaagtaaggacgactagtgtaccaccgtatcacgttcgccgaggtccgagtcgaggactactacgagaacctaaactttaagtttaaacgtggtaactccgtaagaccgaaacggaaaccgacgggaaccaaccggtacccctaacgttcctaccgtacggtaaccctaccgacggttagtccgttacgttacggtaacgttttaacggttagggtaaaccgggttccggtacccctaaggttaaccgtaaagttaccgtacggtacggtacggaaccgtttggttaaggtacgttacggtacgttaacgtttaacttttaaccttttaacccgtaaacctaaaccttaaccgtacggtacgtaccgtaacgggtaaccgtaaggttactaggtttacgacgtaactacttaagtttacctaaccggttcgtaacttaactaagtcgtaaacgtattacctactcctacgttacgtcccgttacgtacccgtaagtaaccgagtcgtaaacgtacgaactaacggcgttagactacgacgtacctaacg

SEQ ID NO: 35219 - DNA, 801 bp, Homo sapiens
  misc_feature: GYAE6OF02FWV3E.30.67.G01.1.454.CMB.1.raw
  modified_base (612)..(612): a, c, t, g, unknown or other
  misc_feature (612)..(612): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccgagtccgtccctgtctgacatctataggacgacaggtacgtccaaccgtatcctacttacggaccgaagggtccggtaacgtaccgaacggaaccttaacgtccgaacgtacgtaaaccttttaagttttaaaacggtttggtaacttaccgaacggaccgtaaaccggaaaaccgtaacggggaaccctaacggtacccccgtaaaagggttcctacccggtacggaaccgttcccaaacgggttaatccggttacgttacggtacttaaacggttaggggtaaccgggttacgggtaccctaagttacggtaaatcgtttacgaacggtcgaacgtaggtcgagttcgtaacgggtaactacgttttaactttaacccgtttaacaaaccgttaaaaccgtaaccgtaggtacctaacgggtaaccgttaaaacggtnttaacggttagaccggtacgttaactaagttaaccttacacggtttaaccaaaggttaccttagtaaacggtacttaaactcccgtaaaccttactttcgtaacccgttagaaccccggttagggtaaaacctaggttaccgaacgaccttaaacgaacgtacggtgttaggacctacgtaccctaagg

SEQ ID NO: 35220 - DNA, 313 bp, Homo sapiens
  misc_feature: GYAE6OF02JHZTV.30.67.G01.1.454.CMB.1.raw
  modified_base (185)..(185): a, c, t, g, unknown or other
  misc_feature (185)..(185): n is a, c, g, or t
  modified_base (265)..(265): a, c, t, g, unknown or other
  misc_feature (265)..(265): n is a, c, g, or t
  modified_base (267)..(313): a, c, t, g, unknown or other
  misc_feature (267)..(313): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctgcgccctgctccaggagcacctccgagngcacagccgccctgggctgcctggtcaaggacctacttccacgtagcgtgctgaggcgggctggcaagggcgacagtagncnnnnnnnnnnnnnnnnnnnnnnnnnnnnnnnnnnnnnnnnnnnnnnn

SEQ ID NO: 35221 - DNA, 671 bp, Homo sapiens
  misc_feature: GYAE6OF02HXTXC.30.67.G01.1.454.CMB.1.raw
  modified_base (194)..(194): a, c, t, g, unknown or other
  misc_feature (194)..(194): n is a, c, g, or t
  modified_base (376)..(376): a, c, t, g, unknown or other
  misc_feature (376)..(376): n is a, c, g, or t
  modified_base (399)..(399): a, c, t, g, unknown or other
  misc_feature (399)..(399): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcagtgccagatgtgacatccagatcgacccagtctccgagccgtccctgtctgacatctanaggacgacagacgtcacctatctactcgccaggcgagtcgaggacatcgacgactaaacttatttaaatggtatcagacgaacgaaccgagggaaccaccgtacccgtagccgttaccagactaccgatagtcgtcgttgtacttaaggtttacgggtaacggttcggacctatacgaagtnttacgaggtacggcgtaggtagntaccggtaggtaaccttagttttaacctttaaaccctttaacgaaaccttaaacccgtacgttacggaaccgaacgggtaaaccggtaagttaattaacgttccgaacgtactataaaccgtttacgtttaccgttagttaaaccttaacgtaatttataaacgtacttaaccttcctaccgtttaaattcccttaccggttaccgaccggtaaggaacctaaaggtacgtaacgtaagtaaccaagtccggttagcggtacctcgaactcc

SEQ ID NO: 35222 - DNA, 653 bp, Homo sapiens
  misc_feature: GYAE6OF02JXLX3.30.67.G01.1.454.CMB.1.raw
  modified_base (174)..(174): a, c, t, g, unknown or other
  misc_feature (174)..(174): n is a, c, g, or t
  modified_base (318)..(318): a, c, t, g, unknown or other
  misc_feature (318)..(318): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (504)..(504): a, c, t, g, unknown or other
  misc_feature (504)..(504): n is a, c, g, or t
  modified_base (557)..(557): a, c, t, g, unknown or other
  misc_feature (557)..(557): n is a, c, g, or t
tcagcacgctacgtcacgaccggtgctcgatttagagtatacatattgggtttcggggagtcagtcccaaccaggacacagcagtggacatgaggtccctgctcagcgtcctgggctcctgcctactcctggctcgtcaagtcgccaggactgtcgacatccagtatcgacccngtcctaccgagtccgttccctagtctcgcatcctataaggacgacagactcacctaatccaacgttcgccgtaaggccgtaagcgaacgtatactcgaagcgtaaacttagtttaacgtagtactagacgtacacgtaaaccgnggactacgaccctagccactgacncgaacngtcgtactgcttaagttcggtaacgtcggtaccataacgagttactgaagtcggtatggtaagtctacgtggtaactttaactttacttttaaccttaaacggaactaaccccgtaacgttcgaacgacgtaaccggtaagtacttagtaccgtanaacgtaccttaataccttaggtactaactaacttaataagtataacctttacnccttttacaacggttcttaaccgtcgtaaccgttaaccgaagtttaacgtgtaacctagtaaccgacgttacgacgttacgtgtaccgactttccc

SEQ ID NO: 35223 - DNA, 536 bp, Homo sapiens
  misc_feature: GYAE6OF02GR8R6.30.67.G01.1.454.CMB.1.raw
  modified_base (415)..(415): a, c, t, g, unknown or other
  misc_feature (415)..(415): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
  modified_base (465)..(465): a, c, t, g, unknown or other
  misc_feature (465)..(465): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagcctcctgactccacgatgcttggactaattttgggaagtttcggggaccctatacaagtacttcaggtggctaggtggatcgtgggactattacttttacttaacattaaaccactgccaggaccgaagtntagttcgacngacaattnttactgtactactatatagatactctaccctnttctctttccggccctacggaacctaaagtggaacgtactacgaaacgtacttagtcggctcgaccgtacc

SEQ ID NO: 35224 - DNA, 274 bp, Homo sapiens
  misc_feature: GYAE6OF02GCS6Q.30.67.G01.1.454.CMB.1.raw
  modified_base (255)..(255): a, c, t, g, unknown or other
  misc_feature (255)..(255): n is a, c, g, or t
  modified_base (261)..(274): a, c, t, g, unknown or other
  misc_feature (261)..(274): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggcctgcctggtcaaggactacttccacgtagcgtgctgagcgggctggcaaggcncatagnnnnnnnnnnnnnn

SEQ ID NO: 35225 - DNA, 758 bp, Homo sapiens
  misc_feature: GYAE6OF02G3DCR.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgctatctataagggagacagacgtccacctatccacttcgccgaggcgagtcgagacatcacgactaattaatttaaagttgtactacacgtacaacggtaaaccgagggaaccaccggacccctaaagcccgttacccgtcgtaactaccgaacgtacttacgtcttacggtacttaaggttttacgggtaacggtttaccggggttaccctaagttacgaaagtactttaccgaaggttcggacgtagtacggtacttcggtagggtaactttaacgttttaactttttaaaccctttaaaccgtaaaccttaacccgtaaccgtacgtaccggaacggtaccgtaaacgtaattaacttcggacttaacgaacgtttattaacttaaccgttacgtaacgttaacttaaacgttaagttaagttaacttacctttaacccgttacccttaccgttttaccgttacccgttacccggtaccccggttaaacgggtaacgtaaacggttagggtaaacccgtaagtaacccgtaaacggttacggtaccgtacggtctaccgacccgtaccg

SEQ ID NO: 35226 - DNA, 800 bp, Homo sapiens
  misc_feature: GYAE6OF02JUQ9Q.30.67.G01.1.454.CMB.1.raw
  modified_base (201)..(201): a, c, t, g, unknown or other
  misc_feature (201)..(201): n is a, c, g, or t
  modified_base (419)..(419): a, c, t, g, unknown or other
  misc_feature (419)..(419): n is a, c, g, or t
tcagcacgctacgtcacgaccggtgctcgatttagagtatacatattgggtttgggggagtcagtcccaaccaggacacagcatggacatgagggtccctgctcagctcctgggctcctgctctctggctctacaagtcgccagacttgtagacctactccgagtatcgaacccctagtcctccgacgtccgtccctgtcngactagtcctagtacgggactacacgtacgtccaacctagtccctaacggttccgaaccgacgggtccgtaacggtaccgtaacggtactaacctcgaaccgtacttaaactttaaacttttaagtaggtaactccgaagtacgtaaaccggaaaccggaccgggtaacccgtacctacccgtaaccgtcgtaccctacggtaccgtaaccgacggtntaccggtccgttacgtacgttaacggttcgggtaaccgtccggtaccctaagtaacgatacgttacggacggtacggtatacgggtactaacggtacggtacgttaacttaacttttaaccgttttaacccgtaaacctaacccgttaacctaaccggttacgaaccgtaacggtaacgttaaactacggttagttaccgaacgtagttaacgtaactttaggtacctaagttaaaccgtaacttaaagttacctaagtaacttaccttacccgtacttaacttccgtaaccgttccgaccggtaacgtaacggtaacgtacggtaactaaccgtacggtaaaccgtacggtcgttaaccggacccgttacacgttacccg

SEQ ID NO: 35227 - DNA, 740 bp, Homo sapiens
  misc_feature: GYAE6OF02JICP8.30.67.G01.1.454.CMB.1.raw
  modified_base (237)..(237): a, c, t, g, unknown or other
  misc_feature (237)..(237): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctcagcgtcctgtctgcatctagtaggagacaggactcacatcacttgccgaggcgagtcgagacatcganctaacttattaaatggtatcagacaagaacgagggaccacggacccctaaagtcctaccgtacgtacgtaccccgtaagtaacgttcgacgtttcgtaaacttaaacggttttcgggtaaacgggtttaccggggtaccctaaacgtaccgtaaagttaacgtttccgtaaggtacgggtacctaagggttacggtaacgttcgtaaccggggtaacttaacggttttaaactttttaacccgtttaaacctaaacctttaaaccgaacccgttagaccgtaacgggaccggtaaatacgtttaacttgggaactacttacgtaactttaacttacgttacgttaacttaacgtaaatcgttaaataccgttaacttccttaccttacgttacccgtacgtttaccgggaccgtaacggggtaaaaccttaacgtgggtaaccttaacgaaaccgggtaaacgttagttacgggtaccgtaaccggttacaacccgttaaccg

SEQ ID NO: 35228 - DNA, 799 bp, Homo sapiens
  misc_feature: GYAE6OF02HRRD4.30.67.G01.1.454.CMB.1.raw
  modified_base (147)..(147): a, c, t, g, unknown or other
  misc_feature (147)..(147): n is a, c, g, or t
tcagcacgctacgtcacgaccggtgctcgatttagagtatacatattgggtttgggggagtcagtcccaaccaggacacagcatggacatgagggtcccctgctcagctccgtggggctcctgctactctggctctcaagtgccagntaggtcgacatccagatcgacccagtcctccagcgtccctgtctgcactctaagtacggagacagacgtcactatacacttcgccaggcagtcgaggacatacgagactaacttaatttaaagttggtactctacgactaacggaaaccgtacgggaaccaccgaccccgtaacgccgtaccacgacctacgaccgtatcgtcttacgaagttaaggtttaggtaacggttcgggtaaccctagtaacctaaggtactttacggacgttcggtaccgtaagggtacgtaagttcggaaggtaaccgttaattttaacggttttttaaaccccttaaaaccgtaaaccgttaaaccccgtaaacccgttacggtaacccggtaaaccgggaacccggggttaaaattaacggtttaacgtaaccgtaacgtaacggttaacctaaacgtttaaacgtttaccgttaaacgtaaccgttaaacctaaacgttagttaaaccgtaactttaaccggttacccttaacccttaaacgtttacgttaaccctttcccgggaacccgttaaaccggggtaaacccgtaaaggttacggaaaccgtaaccttaaccggtaaacgtacgtacggttaccggtactacggacttaacccgg

SEQ ID NO: 35229 - DNA, 723 bp, Homo sapiens
  misc_feature: GYAE6OF02JWSWS.30.67.G01.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtcgccagatgtgacatccagatcgaccctagttcctcacgtccgttccctgtactgacnttactagtagganacgagagtccacctagtctacttcggaccaggacgtaggtacacggactacgtacaacgtacctaaatttaagttttaaacgttggttaactcgaagtacgaaacggaaaccggacggaaccgtaccgaacccgtacgtacctaccgtagaccttaccgacgacgtcgtacgtgttacgtacgttagggtaacggttcggtaccctagtacgaacgttacgtacgttacggttcggacgtaggttcgtaacggttacggtacgtaacgtttaacggtttaacttttaaacttaccggtaaacctaacccgtacgtacgaccgtaacgacggtaattaagttcgttaacgcgaacgttgtactttacgtacttaagttacctaagttaaccgtgtaaagtaccttacttaccttaaccttagttacccttacgttaccggacgttccggtaaaccgtagtaccggtaaatacggtaactaacggtacgttacgtacgtacctacgtacgtaacc

SEQ ID NO: 35230 - DNA, 266 bp, Homo sapiens
  misc_feature: GYAE6OF02G8A2H.30.67.G01.1.454.CMB.1.raw
  modified_base (254)..(254): a, c, t, g, unknown or other
  misc_feature (254)..(254): n is a, c, g, or t
  modified_base (258)..(266): a, c, t, g, unknown or other
  misc_feature (258)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcnatgnnnnnnnnn

SEQ ID NO: 35231 - DNA, 680 bp, Homo sapiens
  misc_feature: GYAE6OF02HOHCN.30.67.G01.1.454.CMB.1.raw
  modified_base (148)..(148): a, c, t, g, unknown or other
  misc_feature (148)..(148): n is a, c, g, or t
  modified_base (638)..(638): a, c, t, g, unknown or other
  misc_feature (638)..(638): n is a, c, g, or t
  modified_base (672)..(672): a, c, t, g, unknown or other
  misc_feature (672)..(672): n is a, c, g, or t
tcagcacgctacgtcacgaccggtgctcgatttagagtatacatattgggtttgggggagtcagtcccaaccaggacacagcatggacatgagggtccctgctcagctctggggctcctgctactctggctctcaagtgccagatgtnacatccagatgacccagtctccagtccgtcctgtctgctatctagtacggagacagtacgtaccaccgtactctacgtcgaccgaggacgacgttacgaaggtacctataccgactaactaaacgtttaacttttaaaggttcggttactacgaacgaacgaaacggaaaacccggagggaaccctaaccgaccccgttaacgtcctaccgtacgtacctaccgacgtacgtcgtacttcggacgttaacgtttacggggaacggtttccgggacctacgtaacacggttacttgtaacgtcggtaactggtagtactcggtagtactttactttactttaaccttaactaacttaacgtaaccgtcgacgaacggtaccgtaagtacgttactacgcgtacgtataacgttattactcgtaactaatatagtagtacttaacgtcctacttacgttacctacgttccgaaccggttagaaactaaggtntaacgacgttaacgtaacgtcgtacgtcgtactntactaccg

SEQ ID NO: 35232 - DNA, 845 bp, Homo sapiens
  misc_feature: GYAE6OF02HNG1A.30.67.G01.1.454.CMB.1.raw
  modified_base (209)..(209): a, c, t, g, unknown or other
  misc_feature (209)..(209): n is a, c, g, or t
  modified_base (313)..(313): a, c, t, g, unknown or other
  misc_feature (313)..(313): n is a, c, g, or t
  modified_base (376)..(376): a, c, t, g, unknown or other
  misc_feature (376)..(376): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtccctcgacgtcctcccgtgtcgtcgactatactagtagganaacagtactaccaaccactacgtacgtcgaccgacggacgtagtacgaacgactactacgacaacttaaactttaaagtttaaagttaggtactacgaacgaanaaaacccggaaacggacggaccacccggtaaccctaacgcctcgtacgtactacccgagtacncgtacttagtaacgttaggttaagggttaacgggtttaccggtaccctaagtaacgaaagttcttaacggtaggttaccggagtagggttagtaacgttaccggtagggtaaacctttaacgttttaaactttttaaacccgtttaaaccaaaaccttttaaaaccccaacgttaccggaaccgaaaccggtaaaccgggtaaagttaacttacgttaaccgtaacgtaccgttaaacttaatttaaccgtttaaccggttactttaaccctaaattaatttaacgtaagttaaacctttaaccctacccttaacccgtttaacgttttaacccgttaccggttaaccccggtacccgggttaaaccggtaaaacgtaaacgggtacggtaaaacgttaaccgtaaaaccggttaaaaaccggtcggtttaacgggacccggttaacggtaccgaacccgtttaacccg

SEQ ID NO: 35233 - DNA, 758 bp, Homo sapiens
  misc_feature: GYAE6OF02GOC62.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccagccgttccctgtctgcatctagtaggganacctagacgtcacctatccaactttgcccaggcgtagtaccgtaggacctagtcacgactaacttaattttaaagttggtaattacgagtacaacggaaaccgacgggtacacgtaccccgtaaagtccgtacctacgacttaccgaagtactcgtacgttacgacgttaagtttacgggtaaacggtttcgggtaccctaagttacgtaaaggtactttaccgaggttcgtacgtaaggttaggacgttaccggtaggggttaacctaacgtttttaacgtttttaacccttaaaaccgtaagttaaaccccgttaaccgtggtaccgtaaacggtacccgggaaagtacgtttaacgtgacgacgtacttactttaactagttacgttactaacgtacttagtaacgtaacgttaacgttacctaacctagtttacccgttacgtttacccggtaacccgtacggggttaaacccctaaagggttccggaaacgttacccgaagtaaaacccggtttcgtaccgggttaccgtacgttacggacccttaaaccgg

SEQ ID NO: 35234 - DNA, 667 bp, Homo sapiens
  misc_feature: GYAE6OF02IF0EY.30.67.G01.1.454.CMB.1.raw
  modified_base (210)..(210): a, c, t, g, unknown or other
  misc_feature (210)..(210): n is a, c, g, or t
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtcgccagatgtgacatccagatgacccagtctccagcgtccctgtctgcatctataggagacagatcaaccntcacttcgccaggcgagtcgaaggacatcagcaacttaatttaaattggtatcagcaagaaacaggaccagcccctaagcctcctgactccacgntcgctgtactagtttggaagttcgggtaccatacaagtatttctaggtcggngtagtggactcggtaggtacttaagttttacttttaaaccttttaaaccaaacttaaacccgtaaaccctgtaaccgtaccgggaacccggtaagtaacttagttaccggacagtaccttaaacgttactttaaccgtcttaccttaaaccgtaattaactagttaactaacgttaccctacccttaagtaccctttaaccgtttcccggtaccccgttaagggtaacccctaaaaggttcggtaaacgtaacgttaaaccggaaaccgtaaccgttggtaacgggtaccgttaccggtcttaaacccgg

SEQ ID NO: 35235 - DNA, 289 bp, Homo sapiens
  misc_feature: GYAE6OF02HGKZW.30.67.G01.1.454.CMB.1.raw
  modified_base (264)..(289): a, c, t, g, unknown or other
  misc_feature (264)..(289): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggccgccctgctccaggagcacctccgagagcacagcccgccctgggctgcctggtcaaggacttacttccacgtagcgtgctgagcgggctaggcaggcgcagtgnnnnnnnnnnnnnnnnnnnnnnnnnn

SEQ ID NO: 35236 - DNA, 677 bp, Homo sapiens
  misc_feature: GYAE6OF02IGL3P.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagaatggacatgagggtccctgctcagctcctggggctcctgctactctggctctcaagtcgccagatgtgacatccagatgacccagtcctcagccgtcctgtctgactatctaatagganacagagtcaccatcctacgttcgaccaggacgtagtacgacggacagtcaagacctaaacttaagtttaagtcggtatcaagtacaaacggtaaaccgagggtaaccaccgtacccctaagtccgtaccgtagactaccgtagacttggacttgtacgttaagttgggtacggttaccggtaccagtactaagtactcgaggtcgaacgtgtaagtcttcggtaggaacttttaacgtttaacttttaaaccctaaccgttaaactaaccccgtaacgtacgtaccggaaaggtaaccgaacgtagttacgtcggaactacggacttaacgtacttacgtagtactaataagtactagttaacctacttccgtaccttagttacccttacggttacccggtacgtaacgtaactaaggtgaaccgtaacgttaaccaacgttcgtacgttaccggactactaccgacgtttaaccg

SEQ ID NO: 35237 - DNA, 877 bp, Homo sapiens
  misc_feature: GYAE6OF02GD09T.30.67.G01.1.454.CMB.1.raw
  modified_base (118)..(118): a, c, t, g, unknown or other
  misc_feature (118)..(118): n is a, c, g, or t
  modified_base (151)..(151): a, c, t, g, unknown or other
  misc_feature (151)..(151): n is a, c, g, or t
  modified_base (181)..(181): a, c, t, g, unknown or other
  misc_feature (181)..(181): n is a, c, g, or t
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcgtgggctcngctactctggctctacaagtcgcagtagtgtanactactccagtatccgacctagtcctaccncggtccgtcctgtctcnctatactaaggtaggacgagacgtacgtcaacctacgtctacgtcgaccggagggtacgacgtacgaacggactactacgaactaaccttaaatttaaagttttaaagttcgtatacgtaacgaacgaaaccggaaaccggaaccgggaacctaaccccggtaaccccgtaacgttccccgttaaccgtaacggtaaccccgttacccggtaacgtaccgttacggttccttaacggttaaaccgggttttaaaagggtttaccgggtaaaccggggtttcccgggtaacccttacgggtaaacgtaacgtttacgtaaccggttagggacgggtaaccggttgggtaacggttaacgtcgggtttaacgttaacttaacttttttaaaccgttttaaaccgttaaacctaaaccgtaaccgtaacccgtcggaaccgaaacgggttaaccgaagttaattcggtacgtaaccgacgttaatttacttaacgttacggttaaacttccgaaaatttaaccgttacggtaaatttacccgtaacctttacccggttaacttaccgtttaaccgtttcccgggtaccgttaaccggtaacggtaaacgtaaggttactaacggttaacccgtaaaacgtacccggttgttaaccggaggttaccctaaccgtacggttaac

SEQ ID NO: 35238 - DNA, 652 bp, Homo sapiens
  misc_feature: GYAE6OF02FX5AM.30.67.G01.1.454.CMB.1.raw
  modified_base (294)..(294): a, c, t, g, unknown or other
  misc_feature (294)..(294): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatccacttgccaggcgagtcaggacatcagcaacttatttaaattggtatcagcaagaaaccgagggacacgcccctaagcctccngactccacgtatcgcttgactaagtttggtaagttgggtaccctatcgaagtattacgaggttggcgtaggtggactacgtgggactaagtttacttttaacgttaaccaacttaaccgaaacctgtaaccaacgggtaccggaagtaacttacggttacgacgtaacgcgtaattacgtttaccgtagttaaccgtaacttaaagtacgttagttaacttaactttaccctaccccgttaatttacccgtacccgttttccgggaaccccgttaggggtaaacccttaaaggtacgggttaaaccaagttaccgaaaaccgttacggttagtacggtcccgttagaccgttaacccg

SEQ ID NO: 35239 - DNA, 359 bp, Homo sapiens
  misc_feature: GYAE6OF02H2VYP.30.67.G01.1.454.CMB.1.raw
  modified_base (302)..(304): a, c, t, g, unknown or other
  misc_feature (302)..(304): n is a, c, g, or t
  modified_base (306)..(359): a, c, t, g, unknown or other
  misc_feature (306)..(359): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagccttccaccaaggacccatcggtccttcccccctggccgcccctgcctccagggagccaccctccgagagcaaccacgcccgcccgtcgggctcgccgtcggtacaacggacctaccttccacggtacgcgttgctaggacggcgggcgtcggacgaacgggacgaccgagtaggnnnannnnnnnnnnnnnnnnnnnnnnnnnnnnnnnnnnnnnnnnnnnnnnnnnnnnnn

SEQ ID NO: 35240 - DNA, 690 bp, Homo sapiens
  misc_feature: GYAE6OF02HY7LW.30.67.G01.1.454.CMB.1.raw
  modified_base (206)..(206): a, c, t, g, unknown or other
  misc_feature (206)..(206): n is a, c, g, or t
tcagcacgctacgtcacgaccggtgctcgatttagagtatacatattggggtttggggggagtcagtccaaccaggaccacagcatggacatgagggtccctgctcagctcctggggctcctgctactctggctctcagtgccagatgtgacatccagatgacccagtctccagccgtccctgtctgcatctagtaggagaccagngtcaccatcacttgccaggccgagtcaggtacactacagtacaaacttattttaaaacttgggttaactcaggacaacgaaaccgagggtaccacgtaccccgtaaggcctaccgtcgtactaccgaacgtactgtccttgacttaagtttagggtaacgggtttcggggtcccctaagtacgtaagtacgttttacgacggttacgggactaagggttggtacgttcggttagggtacttaacgtttttaactttttaacccgtttaaaccaacttttaaaccccgaaccggtttacgaccgtaacgggtaaccggtaaagtaagtttacgtttaccggactacggtacttaacgttatttaccggttagttactaactaattaactagtaacttacgtccttactacttactccggtttacggaacccttgggaaacctaacgtggaacgtactaacgacgtacgtgtacgcttcgactacg

SEQ ID NO: 35241 - DNA, 266 bp, Homo sapiens; identical to SEQ ID NO: 33523
  misc_feature: GYAE6OF02IMR9P.30.67.G01.1.454.CMB.1.raw
  modified_base (260)..(266): a, c, t, g, unknown or other
  misc_feature (260)..(266): n is a, c, g, or t

SEQ ID NO: 35242 - DNA, 686 bp, Homo sapiens
  misc_feature: GYAE6OF02GZPBY.30.67.G01.1.454.CMB.1.raw
  modified_base (313)..(313): a, c, t, g, unknown or other
  misc_feature (313)..(313): n is a, c, g, or t
tcagcacgctacgtcacgaccggtgctcgatttagagtatacatattgggtttgggggagtcagtccaaccaggacacagcatggacatgagggtccctgctcagctcctgggctcctgctactctggctctcaagtgccagatgtgacatccagatgacccagtctcagcgtccctgtctgcatctagtaggagacagagtcacatccacttgccaggcgagtcaggacatccagacaaacttatttaaagttgtatcagtcaggaaaccagggacacgacccctagacctcctggactccacgatgcttgntaagttgggaagtttcgggtcctatacagtacgttcgagtgacgtagtggacgttcgtacgggtaactattttaaccggtttttaacttaaccctaaacgttaaacccctaacgttaccggtacgaccggtaacccggtaaagtagtttacgttcggaaccgttaaggtaccctaagttaacccttttaaacggtcgtttaaactaaccttaaagttagttaaaccgtaacgttaactttcccccgtaactttacgttaacccgttccgtttaccccgggacccgtttacgggtaaaacctaaaggttaccggataacccgtttaacggaaaccgtggttaccggtaacggtccttaccggaccttaacccgg

SEQ ID NO: 35243 - DNA, 792 bp, Homo sapiens
  misc_feature: GYAE6OF02FQLUH.30.67.G01.1.454.CMB.1.raw
tcagcacgctacgtcacgaccggtgctcgatttagagtatacatattgggtttgggggagtcagtcccaaccaggacacagcatggacatgagggtccctgctcagactccgtgggctcctggcctactctgggctctcaagtcgaccagattgtacgactactccgagcttcggaccctagtcctaccgagtcctaccctggtcctggactatcgtagtaggacacagacgtccaaccataccgtacttgaccgtagggcaagtacaggtacctagtcacgacgtaaacttagttaagttaggtactacgacgtaacgaacgtaaaccgacggtaaccgacgtaccctaacggtcccgttacgtcggaaccgttaccgaacgtaacgtgttaccgttacgtacgttaacgtttaggaacgtttcgggaccctagtaactaacggtactcggtacgtagtacgaggttacgtacgttacgtaacgggtacttaacgtttaccgttttaactaaacccgttaaacgtaaaccccgttaacgtacgtaaccgtaaaccgggttacccggtaaagttaacgttaaccggttacgaaccgttaacgggtaacccttaagttttaccgttaaccgtacggttaacctaaaccgttagttaaccgtaacgtaccgttaaactccccttaacggttaacttcccgtttaaccggtccggtaccgttaaacgggtaactaaggtccggtaattaaccgtaacgtaacggtacggttcggttacgccgttacacccgtacg

SEQ ID NO: 35244 - DNA, 1080 bp, Homo sapiens
  misc_feature: GYAE6OF02H6128.30.67.G01.1.454.CMB.1.raw
tcagcacgctacgtcacgaccggtgctcgatttagagtatacatattggggtttgggggagtcagtcccaaccaggacacagcatggacatgagggtccctgctcagctccgtggggcctctgctactcgtggctctcaagtcggccagtaatggtacgacactccgagatcgaccctacgtctaccgcgtaccgtccctgtctcgactacttacgttaagaggggaacaacgaacggtacggtacccaaccctagttaacccttacggttacggacccggttaaccggggtaacggaaccggttaaccggaacgggacctaacgttacccgaaaccgtaaaccttttaaaaacgtttttaaagttttttaaaacggtttaacgggttaaccttaaccgggtaaacggaaaccgtaaaaccggggaaaaacccgggtaaaaccgggaaaccccgtaccccggttaaacccccgtttaaccggggtaaccccttaacccggttaaccgtaaaccccgtaaccggtaaccggggttacgttaaccggtttaccggtttaacgggtttaacttttaaacgggggttttaaacgggggtttaccggggttttacccggggtaacccgttaacgttaaaacccgttaaggtttaccgttaacggtagggttaaccggttacgttacgggttaaggtccggtttaagggtaccgggtttaaactttttaaacgtttttaaaccttttaaaccccggttttaaaacccttaaacccggtttaaaaccccgttaaaccggttaccggttaaccggtaaaccgggtaaccggttaaacggttaacgtttaaccgttacggtaacctagttaaccgttaactttacgtttaaaccgtttacgtttaccgtaaaacttaacgtaaacttaacgttactttaaccgtttccctaacctttacggttacccttttaccggttacccggttaccggttaaaccgggtaaattaaaccgggtaagttaaaccgtaacgttaacccgttaaccggtaaggtttcccgggaacggtttactacccggtaccgttacg

SEQ ID NO: 35245 - DNA, 856 bp, Homo sapiens
  misc_feature: GYAE6OF02JL5F3.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctctgctactctggctctcagtcgccagatgtgacatccagatacggaccctagtcctaccgagtcccgttccctggttcctgacacttcgtaagtaggacgtacagtaacgtccacctatccgacttcggacccgagggtcctaacggttcgaagggacccagttaccgaagtacctaaacgttttaaattttaaaacggttggttaacttaccgaacggtaaccgaaacggtaaaaccgtacggggaaccgtaccgtacccccggttaaagttcccgtaccgtaacgttaccgtaacccaacggtacgttcgtaccgttagtaaccgttaaggttttacggggtacgggtttaccgggtaccctaacttacgtaaacgttacgttacgtaggtcgggtaagacggttcggtagtaccggttagggtaacctttagttttaaccgtttttaaccttaaacccgtaaaccgttaaccccttacgttaacggcgtaacgggtaaccgtaacggttaacgttaacttcggaaactcgttaactaacttttacgttaactcggtttaaactaacgttagtaacgtttagtaacctttaacttaccgttaccttacgttaccgttaccgtttccccgggtaaccgtaaacgggtaaaccttaacggttaacgggaaccgttaaccggtaacgttaaacccggttccggttacggtacccgggttactacccggttactaacccgg

SEQ ID NO: 35246 - DNA, 959 bp, Homo sapiens
  misc_feature: GYAE6OF02HQACP.30.67.G01.1.454.CMB.1.raw
tcagcacgctacgtcacgaccggtgctcgatttagagtatacatattggggtttgggggagtcagtcccaaccaggacacagcatggacatgagggtccctgctcagctccgtggggctcctgctactctggctctcaagtcgccagagttgtgactattccgagactcgacccctagtcctccgacgtcccgttccgttggtctcgacctattacttaaggtacggagaacgaggtacgtacccaacacttcctaacgttcgaccgtacggcgtacgtaccgaacggacattaccaacgaccttaaaagtttaacgttttaaagtttacggtacttacgaacgaccggtaaacggaaaacccggaccggggaaccaacccggtaacccctaacggtacccgttacccgttacgaacctacccggtacgtagttcgttaccgttaccgtaatttaaacgggttttacgggtaacgggggtttacccgggtaaccgtaacgtaaccgtaaagttaaccgtttacggaagggtacggttaccgtaaggggttccggtaaggttacgggtaacgggtttaactttaaccgttttttaaacgttttttaaacccctttaaaaccttaaaacccgttaaaccccttaaccgggttacgtaaccgggtaaaccgggtaaccggtaaacgttaacgtttaacggttaccggtacgtaaacgtttacggtaacttttaaacccggtttttaccgtaacgtttaaacccgttaaacttaaggttaacgtttaacgtaaaaccttttaccggtaaaccccgtttaccttaacggttttaacccttacccggggttttacccgtaacccgggtttaacggtaaaccgtaaagtacgggtaaaccggttaaacctaaaccggtaaacgtttacggtaccgggttaactacccggtacgttaccctaaccgg

SEQ ID NO: 35247 - DNA, 776 bp, Homo sapiens
  misc_feature: GYAE6OF02G30ZJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagttctccagccgtccctgtctgcatctagtacggagacagatacaccatcacttcgccaggcgagtcaggactagtcacgactaacttaattttaaaagttggtactcaagacgaacgaaaccgagggaaccaaccgtaccccctaagtccgtacctacgacctaccaccgatcgtcttacgacttaagtttacgggtacggttacggggtaccctaagtacgtaaacgtactttcgaaggtcggtacgtacggtttaggaacttccggtacgggtaactttaactttttaacgtttttaaaccctttaaaccgttaacttaaaccccttaaccgtaccggtaaccgacgggtaaccggtaataagttacgtttacgccgtaagttacctaacttttaacgtttaccggttacttaacccttaaagttaacgttacgttaaggtaaaccttttacctacccgtttaccttaaacgtttaccctttaacccgggttacccgtaaccggttaacccgggtaaaccttaaaacggtaccggtaagttaacccgtaaacggttaaaccggttacgttaacgggttacccggtacgttacggacccgtttaaacc

SEQ ID NO: 35248 - DNA, 888 bp, Homo sapiens
  misc_feature: GYAE6OF02F2ACV.30.67.G01.1.454.CMB.1.raw
  modified_base (154)..(154): a, c, t, g, unknown or other
  misc_feature (154)..(154): n is a, c, g, or t
  modified_base (292)..(292): a, c, t, g, unknown or other
  misc_feature (292)..(292): n is a, c, g, or t
tcagcacgctacgtcacgaccggtgctcgatttagagtatacatattgggtttggggatcagtcccaaccaggacacagcatggacatgagggtccctgcgtcagctccgtgggctcctgctactcgtggactctacaagtcgccagattggtnacactccgaagtactcgaccctagtcctaccgagtccgttcccgtgtactcgcctaattcgtaagtacggaacgtacaggtacgtcctacctattcctaacgttcgacgtacgggacgtaacgtacgacggacttacnccgaacggtaacctaaagttttaacgttttaaacgttaggttacacgacggaaccgtaaacggaaaccggtacgggacctaacccggtaccctaacggcccttccgaagtccgtaccgaggtacgtcgttcgtactaacgttaggttagggaccggtttcggaccttacgaacgttacttagttcggtaacggtggtaccgttaggtacgtaccggttcgtaacgggttaacttacgtttttaacctttaaccgttaaactaaccgtaacccgtacgttacggaacgtaccggaaccgttaagtaacgttagtacgtaccgtaaacggttacttaacgttaccgtttaccgttaggttaaaccttaacgttaaacgttaccgttaaagttaacccgttacgtttaaccccgtaacctttacccgttttaaccggtacccgtttacccggggttaaaccgtaacccggggtttaaaaccgtaaacgggtttaaccgtaaaaccccggtaacggtttaaaaccccgttaacgggttaaaccggttttccggggaaaccgggtttaacccctttaccggtaaaccccggtttaaccccg

SEQ ID NO: 35249 - DNA, 731 bp, Homo sapiens
  misc_feature: GYAE6OF02F9ZS0.30.67.G01.1.454.CMB.1.raw
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (360)..(360): a, c, t, g, unknown or other
  misc_feature (360)..(360): n is a, c, g, or t
  modified_base (414)..(414): a, c, t, g, unknown or other
  misc_feature (414)..(414): n is a, c, g, or t
tcagcacgctacgtcacgaccggtgctcgatttagagtatacatattgggtttgggggagtcagtcccaaccaggacacagcatggacatgagggtccctgctcagctcctggggctcctggctactctggctctcaagtcgccagatgtgacattcccagatgacccctagttcctaccagtccgtccctgttctgcatctagtaggananagntccaccntcactgctaggcgagtcgaggactcgtacacgtacaacttaagtttaacgtttaggtactaccaaggacctaaggaaacccggtagggaaccctacggtacccctaaggtcccttaccggaggtacctaccaacggtnttacggtccttagacgttaacggtttagggaaacggttccggtaccgtaacttntaaacggtcttacggtaggttgaaccgtaggtaggaccggttagtacggtaacttagttaacgttttaccttaaacccgtacttaacccgtaaacgtgtaacctacgggttacccgtaagtactttacggttacacgttaagtcttaacggttacttacccgttaaggtcctaaacttaagtaccttaaaggtactttaaaccgtaccgttcccttaacgttacctttaacgttcccgtaacggtacgtaaaccgtaagtaccggtaaactcgttaaacggaccgttacgttcggttacgacgttaccaccgttaac

SEQ ID NO: 35250 - DNA, 723 bp, Homo sapiens
  misc_feature: GYAE6OF02H2LK8.30.67.G01.1.454.CMB.1.raw
  modified_base (128)..(128): a, c, t, g, unknown or other
  misc_feature (128)..(128): n is a, c, g, or t
  modified_base (637)..(637): a, c, t, g, unknown or other
  misc_feature (637)..(637): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactcnggctctcaagtgccagatgtgacatccagatcgaccagtctcacgtccgtcctgtctcgctatctagtaggacacgagacgtccaaccagtcattcgcctaggcgacgtcaggactagtacaggtactaaacgtttaagtttaacgttggttactcgaacgtaccgtaaacggaaaacccggtagggaaacccgtaccgtaccccgtaaacgtccgttacccgtacgtaccgtacccgaacggtacgtacggttaccttaggtaacgtttaaacggttttacggggtaacggttccggggttaaccctaacgttacgtaacgtttacgttaacgacggtacgtaggaacgggttacgtacggttaccggtaacggttaactttaacgttttaaacgttttaaccgttaaacctaaacgtaccgtaaaccctggaacctcgggaaagtacgttaacgtgttacgactacgtatacgttactctatacctatacgtatacgtatactaccncgttactacgtccttacgccttaagggactaacggtcaacggtactaacggtaacgtacttagggtacgcttaccgtaacgtaccg

SEQ ID NO: 35251 - DNA, 655 bp, Homo sapiens
  misc_feature: GYAE6OF02G27O5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctagtaggagacagacgtcaccactctacgttcgccagggcgacgtcgaggacatcagactaacttaatttaaattggttatcgagacaacgaaaccgacgggaccaccgtacccgtaacgtcctccgtaggactaccgacgatcgtctgtacttaagtttagggtaggtttccgggtcctaatactaatagttacgagtggactagggtcggactcggtacgggtaactttattttaactttttaaccttaaacctaacttaaaccctacgtcgaccgaacggaacggtaagtacttagttacgactacgtattacttattacttctaactaataagttatacttaataactttcctacttactttaccgttaccggtttaccgaccggtaacggtaaactaaaggtacggtaaactacgtaaacgaaacggtaacgttcggtccgacgtaccgcctaacccg

SEQ ID NO: 35252 - DNA, 803 bp, Homo sapiens
  misc_feature: GYAE6OF02IXGHY.30.67.G01.1.454.CMB.1.raw
tcagcacgctacgtcacgaccggtgctcgatttagagtatacatattggggtttggggggagtcagtcccaaccaggacacagcatggacatgagggtccctgctcagctcctggggctcctgctactctggctctcaagtgccagatgtgacatccagatcgaccctagtcctaccgagtccgtccctgtctacgcattctagtaggacgacaggactcaccatcacttcgaccaggcgagtcaggactactcaaggtactaaacctttaatttaaagttaggtaactacgaacgtcgaacggaaaacccggagggaacccgtaccggtaacccccgtaagtccgtacccgtgtacctacccgtaacgacgttcgtacgtttacgtaacgttaagttttcggggtaacgggttccgggtacccaagttacgtaacggtatttaccggtaggtcgggtacgtaggtagtacgtagtacgggtaacttaacgttttaacgtttttaaacttaaacccgtaacttaaacccctaaccgtacggtaaccgtaaacgggtacccggtaaagtacgttaacgttcggaccttaacggtcttaaagtttatttacccgtacgtttaacctaaagttacgttaaagttactaaccttaaccgtttcccgttaaaccttctttaacccgtttaacccgggttacccggttacccggtaaaccgggtaaaccgtaaaggttaaccggggtaacctaacggtaaaccgttaacgtacggttaaggtaccggttacgtacggtccctaacccgg

SEQ ID NO: 35253 - DNA, 824 bp, Homo sapiens
  misc_feature: GYAE6OF02FPOSA.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctatagganacagacgtccaccatcctacttgccaggcgagtacaggacatcagctaaacttaatttaaacgtttggtaacttacgaagaccgtaacggaaaacccgtacgggggaacctaaccgtacccccgtaaaggtcccttacccttacggaacgtttaccccaacggtactcggtacctttaggacctttaaaggttttggggtaaacgggttttccgggggtaccccttaacgttaactaacggtaatttaccggaaggttcgggtacgtaagggttacgggtaacgttacggttacggggtaacttaacgttttaacgttttttaaacccgtttaaaacctaaaccttaaacccctaaacccgttaggtaccgaaacggtaccgggaaataaggttattacgggacctaagtacttaacggttaactttaacgtacgttaaactaattaagttattaggtaaactttaccgttaccctaacccttacgtttaccgtttacccttttacccggggaaccccgttaacggggtaaaaccctaaacgggttacggtaaacccgttaacgttaaacccgttaaacggtaccgtttaacgggttactaacccggtacgtacccttaaacccgg

SEQ ID NO: 35254 - DNA, 663 bp, Homo sapiens
  misc_feature: GYAE6OF02HZS5I.30.67.G01.1.454.CMB.1.raw
  modified_base (160)..(160): a, c, t, g, unknown or other
  misc_feature (160)..(160): n is a, c, g, or t
  modified_base (211)..(211): a, c, t, g, unknown or other
  misc_feature (211)..(211): n is a, c, g, or t
  modified_base (484)..(484): a, c, t, g, unknown or other
  misc_feature (484)..(484): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagtancgaccctagttccaccgacggcctccctggtcctgctattctagtaggganaccgagtataccacctatctacttcgcgagcgagtcgaggacatcagactaacttaagtttaattaggtaactcgaagacgaacgaaaaccgaggaaccaccggtacccctaacgtacctcctacggactaccgtaacgtactcgtcttagtaccgtttaggttaacgggttacgggttaccggttaccgtacgtacgtaacgtacgttgtaggtgacgtgtaggacgtgtacggacttaagttttacttaacgttaactaacttaacgaacngtacgacgtacgatcttaagcgtagtacacgttactacttagtcgtactaacgtattataagtttactcgtacctacgttacttaccgttcgtaccgtcccgtaacggtaaacgtaaaccggtcgtaaacgtaacctaacggtaacgtacggttcgtaacggtcctacgacccttaccg

SEQ ID NO: 35255 - DNA, 302 bp, Homo sapiens
  misc_feature: GYAE6OF02H6AY6.30.67.G01.1.454.CMB.1.raw
  modified_base (253)..(253): a, c, t, g, unknown or other
  misc_feature (253)..(253): n is a, c, g, or t
  modified_base (277)..(302): a, c, t, g, unknown or other
  misc_feature (277)..(302): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaacggacccatcggtccttcccccctgggccgccctgcctccgaggacgccacctccgagagcacacgccgccctgggctgccgtggtacgaaggactacttccgacgtagcgtgctgnggcggctggacgaggcgcaatcgnnnnnnnnnnnnnnnnnnnnnnnnnn

SEQ ID NO: 35256 - DNA, 726 bp, Homo sapiens
  misc_feature: GYAE6OF02H6A0E.30.67.G01.1.454.CMB.1.raw
tcagcacgctacgtcacgaccggtgctcgatttagagtatacatattgggtttgggggagtcagtcccaaccaggacacagcatggacatgaggtcctgctcagctcctggggctcctgctactctggctactcaagtgccagatgtgacatccagatcgacccctagtcctccgagccgtccctgtctcgcatctaagtaggacacagagtacacctactctacgttcgaccgaggtcgagtcaaggacctatcgaagaactaaactttaatttaagttgtaattcgaacgacgaacgaaaccgacggtactacccgtacccgtagacctccgagtacctaccgaccgtatacgtccgttcgtaacttaaggttaggtaacggtccgggaccttagtactaagtacgttagtacggtacgtccgtaaggttcgacgtcggtaagggtactttaaacgtttaaccttttaaccgtaaaccaaacccgttaaacctaccgtagtacggaaaccgggtccggtaaatacgttgtaccgactagtaacttatacgtaacttcgttaacgtaatagttactaagttaccttaacttccccgtaaacttccgttacccgttacgttaccccgggtacttaacgggtaaaccaggttaaaccggaacttaaccggtaaaccgttacggtaaccggtcggtttacggtaccccgttagaaccccgtttaaccg

SEQ ID NO: 35257 - DNA, 905 bp, Homo sapiens
  misc_feature: GYAE6OF02FMU05.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagctccctgtctagctagtactacgtaggagacagtagtccacctagtcaacgttgccgtaaggcgagtaccaaggaaccatacgacgactaaacttaatttaaaagtttcggtaacttacaacggtactaacggaaaacccgaagggggaacccgaaccggaaccccccttaaaggccttacccgtacggtaacctaccggtaacgaacgttcggtacctttagggtaaccttaaggttttaacggggtaaacggtttaccgggggttaccctaaacgggttactaaacggttaaacggtttccgtaacggtttacgggaccttaaggggtacggttaacgttacccggggtaaacgggtaaccttaagggttttaaacccttttttaacggtttaaaaccctaaaccgttaaaaccccggtaaaccttacggggttaaccgtaacgggtaaacccgggttaaaggtaaaccgtttaacggtttaacgaacccgttaaagggtcccttaaaacgttaagtttttaacccggacgggttttaaacctaaccgttaaagtacgtttaaacgttaacctttaaaacgttaccccgttacgttaacccggttttaacttacccggtttttacccggaaacccgggttacggtaaaaacccgtaaaggtacggttaaaacgacttaaaacccgggttaaacgaacttccggggctttaaccggtaccacgttaacccg

SEQ ID NO: 35258 - DNA, 724 bp, Homo sapiens
  misc_feature: GYAE6OF02GINGY.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctagtaggagacagatcgaccatcacttcgccaggcagtcaggacatcagcaataatttaattggtatcagcaagaaaccgagggacacgacccctaagcctcctagactccgacgactgcttagacttaagtttgggaacggtttcgggtaccctatacgaaagtagtttaccgaggttcgggaacgtaggtacgggacttacggttacggggaacttaacgtttttaacgttttttaacctttaaacccaaacgtttaaacccctaaacgttcgtaccgtaacggggtacccggtaaagttacgtttaacggttcgacgtaacgtaaccttaacgtttacttttaccgtagttaaccttaaacgttaatttacgttaagtaacttttaaactaccttaccccgttaattttccccgtaagttttccccgggaccgttaacggggtaaaccctaaaggtcgggtaaacgtaaccgttaaccggtaaaccggttaccgttacgggttacggtaccgtacggtacccttaaacccg

SEQ ID NO: 35259 - DNA, 830 bp, Homo sapiens
  misc_feature: GYAE6OF02I9F39.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctgggctcctgctactctggctctacaagtcgccagtatgtgacagtaccagatcgaccctagtcctccgacgtccgtccctgtcctgctatcgtaataggaacgactagacgtcctaactactacctacgttacgaccgtacggtacgaacgtaccgaacggacaacgtacgtaagtacctaaacgttaacgttttaaaagttcggaaattccgaaaggtaccgaaggaaaacccctaaggggaacccctaaagggacccccttaaaaggacctaaccgttaccgaacgttcccaacgggtacttacggaccttaaggtaccgtaaacgttttacgggaaacgtttacgggggtacccctaaggtaccgtaaacggtaactttacggtacgtaggtacgtaaggttacggtaaggtaccgtacggggtaacttaacgtttaacgttttaaaccgtttaaaccgtaaaccgtttaaaaccgtaaacccgttaacggtaaaccgtaaacggaacccggtaaacggttaacgttaaacgttacgtaacgtaacgtaaccgtaacgttaacttaaccgttagtaaccttaacgtaagtaaacttaacgtaacttaacgtaccttaccgtaacttaccgtaaccgtttacgtaccgttaacgggtaactaacggtaacgtaacgtaacgtacgtaaacgtacgtagtacgtactacgataaccg

SEQ ID NO: 35260 - DNA, 676 bp, Homo sapiens
  misc_feature: GYAE6OF02ICG9I.30.67.G01.1.454.CMB.1.raw
  modified_base (133)..(133): a, c, t, g, unknown or other
  misc_feature (133)..(133): n is a, c, g, or t
  modified_base (652)..(652): a, c, t, g, unknown or other
  misc_feature (652)..(652): n is a, c, g, or t
  modified_base (669)..(669): a, c, t, g, unknown or other
  misc_feature (669)..(669): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctntcaagtgccagatgtgacatccagatgacccagtctccagtccgtcctgtctgcatactagtaggagacagtacgtcaaccatcgaacttgacccaggcgagtcaggtacagtacagacctaacttaatttaaagttgtactcaacgtacaaggaaaacccgagggaccctaaccggacccctaacgtacctaccgtagtacctccgacgtacttgacttgacgttaagttaggtaggttaccgggtcccaagtacgaagtacttacgaagtcggacgtagtgtacgtacggtggtaaacttgttttaaacttttaaccgtttaaacccaaacttaaccgtaacccttgaaccggtaccggacggtaaacggtcttaaacggttcggaactacgtattaaaccgtttcgtaaacgtttacgtacctaaagttaatacgttaacgtattaaccgtcctaccgtattacccttaggttccgacgtaacggaactaacggcgaacgttaaccgagtaacgtntacggtctacttacggntaacccg

SEQ ID NO: 35261 - DNA, 258 bp, Homo sapiens
  misc_feature: GYAE6OF01A92MB.8.85.H08.1.454.CMB.1.raw
  modified_base (255)..(258): a, c, t, g, unknown or other
  misc_feature (255)..(258): n is a, c, g, or t
tcagctcgcgtgtccacgaccggtgctcgatttagtatcactcagtcgcgggaagatgaagacagatttcactctcaccatccgcagtctgcaacctgaagattttgcaatttattactgtcaagagactcacaatggaggcacttttggccaggggaccaagctggagaggaaacgaactgtggctgcaccatctgtcttcatcttcccgccatctgagacacgcgagctgagcgggctggcaaggcgcatagnnnn

SEQ ID NO: 35262 - DNA, 220 bp, Homo sapiens
  misc_feature: GYAE6OF01AYMF3.8.85.H08.1.454.CMB.1.raw
  modified_base (213)..(220): a, c, t, g, unknown or other
  misc_feature (213)..(220): n is a, c, g, or t
tcagctcgcgtgtccacgaccggtgctcgatttagtatcactcagtctgcaacctgaagattttgcaatttattactgtcaagagactcacaatggaggcacttttggccaggggaccaagctggagaggaaacgaactgtggctgcaccatctgtcttcatcttcccgccatctgagacacgagagctgagcgggctggcaaggcgcatagnnnnnnnn

SEQ ID NO: 35263 - DNA, 259 bp, Homo sapiens
  misc_feature: GYAE6OF01DPDKJ.8.85.H08.1.454.CMB.1.raw
  modified_base (224)..(259): a, c, t, g, unknown or other
  misc_feature (224)..(259): n is a, c, g, or t
tcagctcgcgtgtccacgaccggtgctcgatttagtatcactcagtcgtaggcaacctgaagattttgcaatttattactgttcaagagtactcacaatggaggcacttttggccaggggaccaagctggagaggaaacgaactgtggctgcacctatctgtcttctaatctttcccgcatctgagacagcgagctgagcggggctggcaaggcgcgaggtagnnnnnnnnnnnnnnnnnnnnnnnnnnnnnnnnnnnn

SEQ ID NO: 35264 - DNA, 550 bp, Homo sapiens
  misc_feature: GYAE6OF01BDWRG.8.85.H08.1.454.CMB.1.raw
  modified_base (269)..(269): a, c, t, g, unknown or other
  misc_feature (269)..(269): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcggcaagtcagactataaataattatttaaattggtatcagcagaaacagggaacncccctaagctcctcatatattctgctattctactttgactaaaagtcgggtcccatactaaggttcaggtggcaggtggatcgtggacagtactttcactctcaccactccgctacgtctcgacaaccgtgaacgtatttgactaatttatttactgttacaagtagtactacaactaagtggaagtctacgttttcggaccgtaacggggaccaaggcgtacgggaaggaacggaaacgaacgtaggtacggtcgtacgacctacctacgttcgttacgg

SEQ ID NO: 35265 - DNA, 488 bp, Homo sapiens
  misc_feature: GYAE6OF01BG7DX.8.85.H08.1.454.CMB.1.raw
  modified_base (460)..(460): a, c, t, g, unknown or other
  misc_feature (460)..(460): n is a, c, g, or t
  modified_base (483)..(483): a, c, t, g, unknown or other
  misc_feature (483)..(483): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaagtggggtcccatcaagttcagtggcagtggatctgggacagatttcactctcaccatccgcagtctgcaacctgaagtattttgactaacttactactgtcaacagacttacaatataccgagacgttcgcaaggaccaaggtggagatanaaacgactgtggctgacaccatntgttc

SEQ ID NO: 35266 - DNA, 541 bp, Homo sapiens
  misc_feature: GYAE6OF01EHIPD.8.85.H08.1.454.CMB.1.raw
  modified_base (268)..(268): a, c, t, g, unknown or other
  misc_feature (268)..(268): n is a, c, g, or t
tcagctcgcgtgtccacgaccggtgctcgatttagtatcactcagtcgcgggggagtcagtctcagtcaggacacagcatggacatgagggtcccgctcagctcctggggctcctgctactctggctccgaggtgccagatgtgacatccagatgacccagtctccatcctcctgtctgcatctgtcggagacagagtcaccatcacttgtcgggcaagtcagactataaataattatttaattggtatcagcagaaaccagggaacncccctaagctcctcatatattctgctattcacttttgactaaaggtcgggtcccatacaaggtttcagtggcaggtggatcgtgggacagtatttcactctacaccatccgcagtctgacaaccgtagaagtattttgacttaattttacttacttagtactaagagtaactacaactaagttaggacgtactacgtttcggaccgacggggaccaaggcgtaggaaggaacggaaacgaacgtggtacggtcgtagaccacgtatcgttacg

SEQ ID NO: 35267 - DNA, 217 bp, Homo sapiens
  misc_feature: GYAE6OF01B3QY0.8.85.H08.1.454.CMB.1.raw
  modified_base (213)..(217): a, c, t, g, unknown or other
  misc_feature (213)..(217): n is a, c, g, or t
tcagctcgcgtgtccacgaccggtgctcgatttagtatcactcagtctgcaacctgaagattttgcaatttattactgtcaagagactcacaatggaggcacttttggccaggggaccaagctggagaggaaacgaactgtggctgcaccatctgtcttcatcttcccgccatctgagacacgcgagctgagcgggctggcaaggcgcatagnnnnn

SEQ ID NO: 35268 - DNA, 569 bp, Homo sapiens
  misc_feature: GYAE6OF01AI648.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatccctccctgtctgcatctgtcggagacagagtcaccatcacttgtcgggcaagtcagactataaataattatttaaattggtatcagcaagaaaccaggaacgcccctaagcctcctcatatattctgctattcactttgactaaaggtcgggtacccatcaaggttcagtggcaggtggatcgtgggactagtactttcacttctcacctatccgactacgtctagacctaacctagaagttattttagactttaaattttacttacttagtacaagtactactacaactaagtaggacgtacttacgtttcggaccgtacggggtaaccaggtacgtagggaagaacgggaaaccgaacgttcggtacggtctacggacctaccgtagttcgttaacg

SEQ ID NO: 35269 - DNA, 260 bp, Homo sapiens
  misc_feature: GYAE6OF01CDCGM.8.85.H08.1.454.CMB.1.raw
  modified_base (254)..(260): a, c, t, g, unknown or other
  misc_feature (254)..(260): n is a, c, g, or t
tcagctcgcgtgtccacgaccggtgctcgatttagtatcactcagtcgcgggaagatgaagacagatttcactctcaccatccgcagtctgcaacctgaagattttgcaatttattactgtcaagagactcacaatggaggcacttttggccaggggaccaagctggagaggaaacgaactgtggctgcaccatctgtcttcatcttcccgccatctgagacacgcgagctgagcggctggcaaggcgcatagnnnnnnn

SEQ ID NO: 35270 - DNA, 539 bp, Homo sapiens
  misc_feature: GYAE6OF01BPBZX.8.85.H08.1.454.CMB.1.raw
  modified_base (192)..(192): a, c, t, g, unknown or other
  misc_feature (192)..(192): n is a, c, g, or t
  modified_base (245)..(245): a, c, t, g, unknown or other
  misc_feature (245)..(245): n is a, c, g, or t
  modified_base (247)..(248): a, c, t, g, unknown or other
  misc_feature (247)..(248): n is a, c, g, or t
  modified_base (260)..(260): a, c, t, g, unknown or other
  misc_feature (260)..(260): n is a, c, g, or t
tcagctcgcgtgtccacgaccggtgctcgatttagtatcactcagtcgcgggggagtcagtctcagtcaggacacagcatggacatgagggtcccgctcagctcctggggctcctgctactctggctccgaggtgccagatgtgacatccagatgacccagtctccatcctccctgtctgcatctgtcgganacagagtcaccatcacttgcggcaagtcagactataataattattaatgtatnannagaacaggaacnccctaagctcctcatatattctgctattctactttgacaaagttgggtcccatactaaggttcgagtgcaggtggatcgtggacagtatttcacttctcaacctatccgactacgttctgacctaacctagtaagtattttagactttaatttactttacttagtaccaaagtacgaataccaataagtggtacggacttacgtttacggaccgtagggtaccaagtcgtagggagaaggaaacggtacgtaggtcggactacgactacgatcgttacg

SEQ ID NO: 35271 - DNA, 663 bp, Homo sapiens
  misc_feature: GYAE6OF01D6L8G.8.85.H08.1.454.CMB.1.raw
  modified_base (193)..(193): a, c, t, g, unknown or other
  misc_feature (193)..(193): n is a, c, g, or t
  modified_base (254)..(254): a, c, t, g, unknown or other
  misc_feature (254)..(254): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcgganacagagtccaccatcacttgcgggacaagtcagactaataaataattatttaaattgtatnagacaagaaaccgagggaaccgacccctaagcctacctactatatattctgtctattcactttagactaaaggtcgggtaccatcgaaggttcagtggcgaggtggtactcgtagggactagtatttacacttctactaccactccgctacgttctacgacctaaaccgttagtaagttagttttacgactttaaattttaacttaacttacgtaacgaacgtaagtaaccttacgaaccgtaagtacgggtaggtaccgttacggttttacgggacccggtaacggggtaaccctaaagggtaccggttaaggggaaacgggtaaacggggtaaaaccggtaaccggtttagggtacggggtaccgttacgtaacccgtaaacccgttaacgttccggtttaacccgg

SEQ ID NO: 35272 - DNA, 550 bp, Homo sapiens
  misc_feature: GYAE6OF01CRM73.8.85.H08.1.454.CMB.1.raw
  modified_base (379)..(379): a, c, t, g, unknown or other
  misc_feature (379)..(379): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaaccagggaaacgcccccaaaactcctgatacaattatgcatccagtttgcaaagtggggtcccatcaaagattcagtggcggtggatcgtgggacagatttcactctcaccatcaacngtctgacagtagttgaggtattagtgactaacttaattactgtacagctaagacgttaccgacggaccccctcgtacctaccgtttccgggaccgggggtaaccctaaaggtcgggaaccgtacgaaaaccggtaacgtaggtacggcttacggacaccctgtccgttacg

SEQ ID NO: 35273 - DNA, 223 bp, Homo sapiens
  misc_feature: GYAE6OF01BFMQ5.8.85.H08.1.454.CMB.1.raw
  modified_base (214)..(223): a, c, t, g, unknown or other
  misc_feature (214)..(223): n is a, c, g, or t
tcagctcgcgtgtccacgaccggtgctcgatttagtatcactcagtctgcaacctgaagattttgcaatttattactgtcaagagactcacaatggaggcacttttggccaggggaccaagctggagaggaaacgaactgtggctgcaccatctgtcttcatccttcccgccatctgagacacgcgagctgagcgggctggcaaggcgcatagnnnnnnnnnn

SEQ ID NO: 35274 - DNA, 647 bp, Homo sapiens
  misc_feature: GYAE6OF01A7BJY.8.85.H08.1.454.CMB.1.raw
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcggcaagtcagactaataataattattaattgtatnancagaacaggaccnccctaagctacctcatatattctgctattctactttgactaaaggtcgggtaccctagtacgtaaggttcaggttcggctaggtaggagtcgtagggactagtactttcactcgtcacctactccgacagttcctagacctaaacccgtgtaacgttacgttttacgacgtttaacttttaattacgttagtacgtaaacgacgtaaccttacgaacgtaaagttacgggtaacggtaccgttaacgttttcgggacccggtaaaggggtaaccccgtaaaggtaccggtaaggggtaaacggaacgggtaaaaccggtaaccggttacgggacgggttacccgttacgggaaccctacccgttaaacgttcccggttaccgg

SEQ ID NO: 35275 - DNA, 554 bp, Homo sapiens
  misc_feature: GYAE6OF01CEEAY.8.85.H08.1.454.CMB.1.raw
  modified_base (272)..(272): a, c, t, g, unknown or other
  misc_feature (272)..(272): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttggtcggcagtcagactataaataattatttaaattggtatcagcaagaaaccagggaaccncccctaagcctcctcatatattctgctattctactttgactaaaggtcgggtcccatcaaggttcaggtgcaggtggatcgtggacagtactttcactctccaccactccgcagtctacgactaaccgtgtaagttattttagacttaattttacttacttagtacaagtacgtaactacgaataagtaggacggtactacggtttacggcccgtaaggggaccaaggcgtagggaagaacgggaaacgtacgtggtacggtcacgacacctgtcgttaccg

SEQ ID NO: 35276 - DNA, 261 bp, Homo sapiens
  misc_feature: GYAE6OF01BH3CB.8.85.H08.1.454.CMB.1.raw
  modified_base (255)..(261): a, c, t, g, unknown or other
  misc_feature (255)..(261): n is a, c, g, or t
tcagctcgcgtgtccacgaccggtgctcgatttagtatcactcagtcgcgggaagatgaagacagatttcactctcaccatccgcagtctgcaacctgaagattttgcaatttattactgtcaagagactcacaatggaggcacttttggccaggggaccaagctggagaggaaacgaactgtggctgcaccatctgtcttcatcttcccgctatctgacgacacgcgagctgagcggctggcaaggcgcatagnnnnnnn

SEQ ID NO: 35277 - DNA, 739 bp, Homo sapiens
  misc_feature: GYAE6OF01CU8K6.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatcgacccagtccccatccctccctgtctgcatcgtggtcggagacagtacgtcaccatctacgttggtcggacaagtcagactaataaattaatttaatttaaattggtatacaagacaaacgaaaccgacgggaacctcccctaagccttacctacaattattacttcgacgtactaatttcctactttacgaacgtaacgggtcgggtacccaagtacgtaacggttcgaggtacggacgtaggtgtaacgtcggtacggggtactaaggttacctttaccgactcctacaacccgtactcccggacttacgtactaccggtaacctaaacgttaggtaacgtttacgttttaacgtaacgtttaaattttaacttaaccgttacgttaacgaaacgtacgttaaccctaacgtaaacggttaacggttggggtaacgttaccgtttaaccggtttacggggaaccgggtaaaccgggggtaacctaacgggtacggttaaggggaaacgggtaaaccggtaaaacggttacgttcgggtacgccgttaacggacctacccgttagttccgttcggttaaccc

SEQ ID NO: 35278 - DNA, 790 bp, Homo sapiens
  misc_feature: GYAE6OF01CYYRG.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctccgtggggcctcctgctactctggctccggaggtgccagatgtgacatccagatgacccagtcctccatccctcctgtctagctatcgtggtcggagacagacgtccaacctatcacgttggcgggtacaggtacagtaactaattaaattaatttaatttaaagtggtaatcgaagacaacggaaaccgacgggtaaccacccgtaacgcctacctactaatttactactttctacgtactactttcctaacgtttacggaacgttaacgggttccggggtaccctaacgttacggtaacggttacgacggtcggtacgtagggttggtaacgttacgggtacggtaacgtagtttacgtttacctaccttaccgtacctaccgtacgtcccgtacgtaccgtcgtaaccgtacgtaaccttaaggtaacgttttacgttttaaccggtaactttaaacggttttaacttaaccgttacggtaacgtaaacggtaccgtaaccgttaacccgtaagtaaccgggtacgggttaacgttaccggttaaccggttttccgggaaaccgggtaacggggtaaacccgtaacgggtacggttaaacggggaacgggtaaaccggtaaacggttccggttacgggtacgaccggttaacgtaaccgtaaccgttcggtacgtttacccgg

SEQ ID NO: 35279 - DNA, 591 bp, Homo sapiens
  misc_feature: GYAE6OF01DKCB2.8.85.H08.1.454.CMB.1.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
  modified_base (253)..(254): a, c, t, g, unknown or other
  misc_feature (253)..(254): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (286)..(286): a, c, t, g, unknown or other
  misc_feature (286)..(286): n is a, c, g, or t
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccggaggtgccagatgtgacatccagatgacccagtctccatccctccctgtctgcatctggcggagacagacgtcaccatcacgttgcggnaagtcagactataaatattaattaatgtatnannagaaccaggaccncctaanctcantatattcngctattctacttgaccaaaggtcgggtaccagtcgtaaggttcagtggacaggtcggactcggnggacagtactttcactcacaccncgtccgancgtactccgaactaactaggaagttatttacgtacttaaattttagttaacttagtacgaagtacgtaacctaacaacgtaagtacggtaacgtaccgttacggtttacggacccggtaaggggaaccctaaggtccgtaagggaacggaaacgggtaaaccgaacgttcgggtaacggtacgtaacgtccgaaccttgttccgttaccg

SEQ ID NO: 35280 - DNA, 805 bp, Homo sapiens
  misc_feature: GYAE6OF01C5TNZ.8.85.H08.1.454.CMB.1.raw
  modified_base (454)..(454): a, c, t, g, unknown or other
  misc_feature (454)..(454): n is a, c, g, or t
tcagctcgcgtgtccacgaccggtgctcgatttagtatcactcagtcgcggggggagtcagtctcagtcaggacacagcatggacatgagggtccccgctcagctccgtggggctcctgctactctggctccggaggtgccagatgtgacatccgagatcgaccctagtcctaccactccctccctgtctgcactcgtggtcggacgacagtacgtccaacctatctacgttggtcgggactaagtcaacgtacttaaaattaaaagtttaattttaaagttttaaagttggtaacttcgaaacgacgaaacggaaaccccggtacggggaacccctaccccctaaagtccctacctataacttatactttcgacgtactaacttccgttaacgtttacgaaccggtaaaacggggtttcccgggtacctaaacggttcgttaaacgggggttntaccggggttaggccggtaacggtttcgggaacgttttaccgggggagttaaccgtagtttcctttaaccacccgttccacctaccggacttccccgagttaccggtctacgaaccgttaaccgttaaggtaactttacgttttacgtaactttaaacttttagtttacccgtaagaaccgtaacggtaaccgttaacctaaccgtaaggttaacggtacggggttacttacccggttacggtttacccgggacgggtaaaccgggacctacgggtaagacggggtaaacgaaacggttaacgtacggttacggtcggtacgaccgtacgtaacccgtgttaacctttccg

SEQ ID NO: 35281 - DNA, 823 bp, Homo sapiens
  misc_feature: GYAE6OF01EHUKS.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctccgtgggctcctgctactctggctccgaggtcgccagatgtgacatccagactcgacccagttctccactccgtcctgtctcgctacgttcgtggtaccggagaccaggaccttccaaccgtattcctaaccgtttcgggtaccgggacctaaggttccaaagtaaccttaaaattaaaatttaagttttaaattttaaagtttaggtaacttacgaacgtaaccgaaaccgtaaaaccggaaccgggtaaacccgtacccccgttaacggtacccttacccgtaactaacgtttactttacgtttccgtacgtaccttaactttaccgttacgttttacggaacgttaaacggggttccggttaacccctaagttaaccgttaacggttacggaacggtcggacgtaaggtacggtacgtcggtacggaacgttacgtaacgtttcctaacgttcctaccgtaaccgtaccgtaccgtagttaccgttcccgtaacggtacctaacggttaagttaacgtttacttttacgtaacgtttaatttacgttacgtactaacgtaagtacctaacgtacaaacgttacgtacggtacgtaccgttacgttccggaaccgggtacgggtaaacccaaggttaccggtaagggaacggtaaacggtaaacgttacggtaggttacggtaccgtacgtacccgtaacttcggttacgttacccg

SEQ ID NO: 35282 - DNA, 783 bp, Homo sapiens
  misc_feature: GYAE6OF01EGCXL.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatcgacccagtctccatccctcctgtctgcatcgtgtacggagacagactaccaacctagtccacgttcggtacggactaagtcaagtactaaattaaaattaatttaagttttaaaagttggtaactacgaagaccgtaaaggaaaacccgaacgggaaccccgtacccccgtaaacgccgttaccctacgtaattaacttacgtttactagtacccttaattttccgttaacgtttacgaaacggtaaaacgggttccgggtaaccctaagtaaccggtaaggtacctagggtcggacgtaggtacgggtatacgggtaaggacgtaacgtacgttttacccgaaccgttcctacccaaccgtaccgtacccgtacgtacgttaccgtacgaacctaaccgttaaggtaacgtttagtttacgtaaacgtttaattttaacgtttactacgttaagtaacgtaacgttacctaaccgtaagtaacgttacggtaacgttaccgtttacggttttaaccggaccgggaaccggtaaccgaacggtacgggtaacgggtaaacggaaacggtaaaccgaacggttaggtcggtaccgtacgaacccgttaacgtaccgttcgttaaccgg

SEQ ID NO: 35283 - DNA, 779 bp, Homo sapiens
  misc_feature: GYAE6OF01D2NS6.8.85.H08.1.454.CMB.1.raw
tcagctcgcgtgtccacgaccggtgctcgatttagtatcactcagtcggcggggggagtcagtctcagtcaggacacagcatggacatgacgggtccccgctcagctccgtggggcctcctgctactcgtggctccggaggtgccagatggtgacatccagatcgacccagtcctccacttccctccttgtctgctatcgtggacggaagacaggtactaccactatactacgttcggcggacaagtcaagtaactaataaattaatttaatttaagtggtactagacgacgaacgaaaccgacggaacccacccgtaagtcctcgtactaattacgttactcgtagtacctattacctagttacgaacgtaacgggtcggtaaccacgttacggtaacgttgaggtcggacgtaggtacggtagtcgggtagggtactaggttacttacgtaccttaccgtactacccgtacgtccgtacgtcgttacccgtaccggaaccttaacgtttaagggtaaacgttttcgtttttaaaccggtaacctttttaaagttttaaccgttaacggttactaaccggaaacgttaacggtacctaaccggtaaagttaccgggtaagggttacccttaacggtttacgggttaaccgggaaccgggaaccggggtaaacccggtagggtaaccgggtaaacggggaaaacgggttaaccgggtaaacggtaccggttacgggtacggtcctaacggtaaccctaacgtttcgtaccggttacccg

SEQ ID NO: 35284 - DNA, 772 bp, Homo sapiens
  misc_feature: GYAE6OF01E1CFR.8.85.H08.1.454.CMB.1.raw
tcagctcgcgtgtccacgaccggtgctcgatttagtatcactcagtcgcgggggagtcagtctcagtcaggacacagcatggacatgaggtccccgctcagctcctggggctcctgctactcgtggcctccgaggtgccagatgtagacatccagatcgacccagtcctccactccctccctgtctgctatctggtcgagacagactccacatccacgttcggtacgggactaaggtacaagtaactaaattaaattaaatttaattttaaagtgttaatcaagacaacgaaaccgaacggtaacccgacccctaacgtcctacctactaatacttattccgtagtcctatttacctagttacggtacgtaaacgggttccgggtaacccaagttacgtaacggttacagggttcggagtaggtaggtacgtacggtagggaacttagtactttaccaccgttactacacctacggtaccagtcggtactcggaaccctaacgttacgtaacggttttacttttacggaactttaaacgttttaacttagttaacggtacgtaaagtaaccgttaactaaccgaaagttaacccggttagggtaccgtttaaccgtttacgggtttaaccgggaaccggggttaacccggggaaaccgtaacgggttaaccgggtaacggggtaaaccggggaaaacggtttaaaccggggaaacgtttcgggtacccggggtaacacccggtaacggtacccttacggtccgtttaacccg

SEQ ID NO: 35285 - DNA, 831 bp, Homo sapiens
  misc_feature: GYAE6OF01DTVVY.8.85.H08.1.454.CMB.1.raw
  modified_base (205)..(205): a, c, t, g, unknown or other
  misc_feature (205)..(205): n is a, c, g, or t
tcagctcgcgtgtccacgaccggtgctcgatttagtatcactcagtcggcgggggagtcagtctcagtcaggacacagcatggacatgagggtccccgctcagctccgtgggctcctgctactctggctccggaggtcgccagatgtgacatccagatcgaccctgtcctccacttccctccctgtcctgctatctggtacgganacaggacgtccaacctatccgtacgttcgggtcgggactaagtacaacgtaacttaaaattaaaactttaaattttaaagttttaaagttaggttaacttaccgaagaaccgtaaaacggaaaacccggtaacggggaaacccctacccccgttaaaggtcccctttaccgtaacttaattaacttacttccgtacgtctttaacttttacccgtaacgttttccggaaacggttaaccggggttccgggttaacccctaaagttaccggttaaacgggttcgtagggtacgggtactagggtaccggtaattccgggtaggggtaaacttacgtttacgtttacccaaccttcccttaacccgtaacgtaccccgttccgaaccgttcggttaccgtaccgtaccgtaaccgttaagttaacgttttaattttacgtaacgttttaaatttacggtttaaccgttagtaagaacggtactaactacgtaagtagttacgggttagtaaccgttacgggttacggaccggaacgggtaaccgtaggtaccggtaaggggaaacggttaaacggaaacccgttacggtcgggacgtagtacccgtaacgtaccttgttacgttcccg

SEQ ID NO: 35286 - DNA, 709 bp, Homo sapiens
  misc_feature: GYAE6OF01CBVIO.8.85.H08.1.454.CMB.1.raw
  modified_base (180)..(180): a, c, t, g, unknown or other
  misc_feature (180)..(180): n is a, c, g, or t
  modified_base (188)..(188): a, c, t, g, unknown or other
  misc_feature (188)..(188): n is a, c, g, or t
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
  modified_base (703)..(703): a, c, t, g, unknown or other
  misc_feature (703)..(703): n is a, c, g, or t
tcagctcgcgtgtccacgaccggtgctcgatttagtatcactcagtcggcgggggagtcagtctcagtcaggacacagcatggacatggacgggtccccgctcagccgtccgtggggctcctgctactcgtggctccggaggtgaccagatgtgacactcgagactacgaccctagtccncacttccnccctgtctgctatcgtgacggancgatcgtacacctagtcagttcggacggatacggtanactaataataaaattaacgtttaatttaaagtcgtaatacagaacaaacgtaaaccgacggggaaacccctcctaaggcctacctataataatcttgacgtactagttaacncgtttacgagaacggggtttcaccgaattaggaacgttanaacgggtggtaacagggtactacggtttcggaaacgtagttacggttaactttacgactttacccgacctaaccgtaccgtaccgaacgtacggtacctagtaacccgaagttaaggttaacgttaaacgtttacgttaacttttaaatttaaccgtttaacgtaacgttaaacgtaacggtaacgtaaccgtaacccgtaaggtaaacgtacgggtaaacgtaccgttacggttaacgagggaaccgtacgacgtacgggtacgaagaacggacgagtcggtagacgtacaggtactcggtnttaccg

SEQ ID NO: 35287 - DNA, 213 bp, Homo sapiens
  misc_feature: GYAE6OF02GR5IL.8.85.H08.1.454.CMB.1.raw
  modified_base (212)..(213): a, c, t, g, unknown or other
  misc_feature (212)..(213): n is a, c, g, or t
tcagctcgcgtgtccacgaccggtgctcgatttagtatcactcagtctgcaacctgaagatttgcaatttattactgtcaagagactcacaatggaggcacttttggccaggggaccaagctggagaggaaacgaactgtggctgcaccatctgtcttcatcttcccgccatctgagacacgcgagctgagcgggctggcaaggcgcatagnn

SEQ ID NO: 35288 - DNA, 216 bp, Homo sapiens
  misc_feature: GYAE6OF02HUYB4.8.85.H08.1.454.CMB.1.raw
  modified_base (212)..(216): a, c, t, g, unknown or other
  misc_feature (212)..(216): n is a, c, g, or t
tcagctcgcgtgtccacgaccggtgctcgatttagtatcactcagtctgcaacctgaagatttgcaatttattactgtcaagagactcacaatggaggcacttttggccaggggaccaagctggagaggaaacgaactgtggctgcaccatctgtcttcatcttcccgccatctgagacacgcgagctgagcgggctggcaaggcgcatagnnnnn

SEQ ID NO: 35289 - DNA, 513 bp, Homo sapiens
  misc_feature: GYAE6OF02G77HG.8.85.H08.1.454.CMB.1.raw
  modified_base (270)..(270): a, c, t, g, unknown or other
  misc_feature (270)..(270): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgcgggcaagtcagactataaataattatttaaattggtatcagcagaaaccagggaacnccctaagctctcatatattctgcattcactttgcaaagtgggtccatcaaggttcagtggcagtggatcgtgggacagatttcactctcaccatccgcagtctgctaaccgtgaagtattttcgactaatttattactagtacaagacgactcgaactaagtgagtctacgttttggaccgtagggaccaagtcgtgggaacgaagggaaacgacgttggtacggctagacacctagtcttcg

SEQ ID NO: 35290 - DNA, 488 bp, Homo sapiens
  misc_feature: GYAE6OF02I8PGG.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtgggtcccatcaaggttcagtggcagtggatctgggacagatttcactctcaccatccgcagtctgcaacctgaagtattttgctaattttattacttgtacaagagactacacaatggaggcacttttgccgagggaccaagcgtgggagaggaacgactgtggctgcacatctcg

SEQ ID NO: 35291 - DNA, 241 bp, Homo sapiens
  misc_feature: GYAE6OF02H3FOR.8.85.H08.1.454.CMB.1.raw
  modified_base (216)..(216): a, c, t, g, unknown or other
  misc_feature (216)..(216): n is a, c, g, or t
  modified_base (218)..(241): a, c, t, g, unknown or other
  misc_feature (218)..(241): n is a, c, g, or t
tcagctcgcgtgtccacgaccggtgctcgatttagtatcactcagtcgtgcaacctgaagatttgcaatttattactgtcaagagactcacaatgggaggcacttttggccaggggaccaagcctggagaggaaacgaactgtggctgcgaccatctgtcttcatcttcccgccatctgagacacgcgagctgagcgggctggcaaggcgcatagnannnnnnnnnnnnnnnnnnnnnnnn

SEQ ID NO: 35292 - DNA, 753 bp, Homo sapiens
  misc_feature: GYAE6OF02GEFP0.8.85.H08.1.454.CMB.1.raw
  modified_base (285)..(285): a, c, t, g, unknown or other
  misc_feature (285)..(285): n is a, c, g, or t
tcagctcgcgtgtccacgaccggtgctcgatttagtatcactcagtcgcggggagtcaggtctcagtcaggacacagccatggactatggagggttccccgctcgagctcctggggctccgtgctactctggctccgaggtgcctaggatgtgacagtccagtattgacccagttactccatcctcctgtctgcatctgtcggagacaggagtcaccatcacttggtcggcaagtcagactataaataattattaattggtatcagtcagaaacctagggaaccnccctaagcctccgtcagtactacttcgtagcctagttctacgttttcgaccgtaaaaggttcggggtaccccaagttaccgaaacgggtttcaagggttggaccgtaaggttagggtaacttaccgtagggggtaacctaaggtacgttttaccgaccgttccgtaccgaacccgtacgttccccgacctaacggttccgtacgaccgtaaacccgttacgtaaaacggttaacttttaacggaaccttaaagttttaactttaaccttacggttaaccaaacggtaagtaaccgttactaacgtaaaggtacggtaacgggtacccttaacggttttcgggacccgtaacggggtaaccgtaacggtaccggttaacgggtaacggtaaacgggtaaaaccggtaacggttacggttaacgggtaccgttaccgggttaccaaccgttacgtttaccgtttaaccgg

SEQ ID NO: 35293 - DNA, 510 bp, Homo sapiens
  misc_feature: GYAE6OF02H2I4V.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactaataaataattatttaaattggtatcagcagaaaccaggaacgcccctaagcctcctcatatattctgcattcactttgctaaagtggggtcccatcaaggttcagtggcagtggatcgtggacagtatttcactctcaccatccgcacgtctgcaacctgaaagtattttgactaatttattactgtacaagagactcaacaatggagtctagtttcggaccgtagggaccaagcgtaggagaaggaaacgtaactggtacggcgtgccactagtcttacg

SEQ ID NO: 35294 - DNA, 215 bp, Homo sapiens
  misc_feature: GYAE6OF02I7ZIT.8.85.H08.1.454.CMB.1.raw
  modified_base (212)..(215): a, c, t, g, unknown or other
  misc_feature (212)..(215): n is a, c, g, or t
tcagctcgcgtgtccacgaccggtgctcgatttagtatcactcagtctgcaacctgaagattttgcaatttattactgtcaagagactcacaatggaggcacttttggccaggggaccaagctggagaggaaacgaactgtggctgcaccatctgtcttcatcttcccgccatctgagaccgcgagctgagcgggctggcaaggcgcatagnnnn

SEQ ID NO: 35295 - DNA, 531 bp, Homo sapiens
  misc_feature: GYAE6OF02II41R.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatccctccctgtctgcatctgtcggagacagagtcaccatcacttgcgggcaagtcagactaataaataattatttaaattggtatcagcagaaaccaggaacgccctaagctcctcatatattctgctattcactttgactaaagtgggtccatcgaaggttcagtgcagtggatcgtagggacagtatttcacttctaccacactccgcagtctgactaacctgaagtatttagacttaatttattactgtactaagagtactacaactaagtggagtactacgtttcggaccgtagggaccaaggtcgtagggaacgaagggaaacgtaacgtaggtcggacgtcgaccactacgtctacg

SEQ ID NO: 35296 - DNA, 217 bp, Homo sapiens; identical to SEQ ID NO: 35267
  misc_feature: GYAE6OF02FR39T.8.85.H08.1.454.CMB.1.raw
  modified_base (213)..(217): a, c, t, g, unknown or other
  misc_feature (213)..(217): n is a, c, g, or t

SEQ ID NO: 35297 - DNA, 508 bp, Homo sapiens
  misc_feature: GYAE6OF02F4KQR.8.85.H08.1.454.CMB.1.raw
  modified_base (290)..(290): a, c, t, g, unknown or other
  misc_feature (290)..(290): n is a, c, g, or t
tcagctcgcgtgtccacgaccggtgctcgatttagtatcactcagtcgcgggggagtcagtctcagtcaggacacagcatggacatgagggtcccgctcagctcctgggctcctgctactctggctccgaggtgccagatgtgacatccagatgacccagtctccatcctccctgtctgcatctgtcggagacagagtcaccatcacttgtcgggcaagtcagactataaataattatttaaatggtatcagcagaaaccaggaacgcccctaagctcctcatatattcngcattcactttgcaaagtgggtccatcaaggttcagtggcagtggatcgtgggacagtatttcactctcaccatccgactagtctgcaacctgaacgtatttgacttaatttatacttgtacaagtacgtactcaactaagtggacgtctacgtttcggaccgtagggaccagcgtaggagaaggtaaacgacgtgtacgctcggacacgtatctacg

SEQ ID NO: 35298 - DNA, 534 bp, Homo sapiens
  misc_feature: GYAE6OF02HG2VD.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactaataaataattatttaaattggtatcagcagaaaccagggaacgcccctaagcctcctcatatattctgcattcactttgcaaagtgggtccatcaaggttcagtggcagtggatcgtgggacagtatttcactctaccaccactccgctacgttctcgactaacctgaagtattttagactaattttattactgtacaagtagtactacactaagtcggagtacgtactttggaccgacggggaccaaggtcgtaggacggaaggtaaacgaacgtcggtacggcgtacgccaccgtatcgtacg

SEQ ID NO: 35299 - DNA, 220 bp, Homo sapiens
  misc_feature: GYAE6OF02HMT3I.8.85.H08.1.454.CMB.1.raw
  modified_base (207)..(207): a, c, t, g, unknown or other
  misc_feature (207)..(207): n is a, c, g, or t
  modified_base (213)..(220): a, c, t, g, unknown or other
  misc_feature (213)..(220): n is a, c, g, or t
tcagctcgcgtgtccacgaccggtgctcgatttagtatcactcagtctgcaacctgaagattttgcaatttattactgtcaagagactcacaatggaggcacttttggccaggggaccaagctggagaggaaacgaactgtggctgcaccatctgtcttcatcttcccgccatctgagacacgcgagctgagcgggctggcaaggcncatagnnnnnnnn

SEQ ID NO: 35300 - DNA, 266 bp, Homo sapiens
  misc_feature: GYAE6OF02G1HB8.8.85.H08.1.454.CMB.1.raw
  modified_base (254)..(266): a, c, t, g, unknown or other
  misc_feature (254)..(266): n is a, c, g, or t
tcagctcgcgtgtccacgaccggtgctcgatttagtatcactcagtcgcgggaagatgaagacagatttcactctcaccatccgcagtctgcaacctgaagattttgcaatttattactgtcaagagactcacaatggaggcacttttggccaggggaccaagctggagaggaaacgaactgtggctgcaccatctgtcttcatcttccgcatctgacgacacgcgagctgagcgggctggcaaggcgcatagnnnnnnnnnnnnn

SEQ ID NO: 35301 - DNA, 754 bp, Homo sapiens
  misc_feature: GYAE6OF02JO8E7.8.85.H08.1.454.CMB.1.raw
tcagctcgcgtgtccacgaccggtgctcgatttagtatcactcagtcgcgggggagtcagtctcagtcaggacacagcatggacatgagggtcccgctcagctcctgggctcctgctactctggctccgaggtcgccagatggtcgacatccagatcgaacccagtcctccactccctccctgtcctgctatccgtgtaccggagacaggactccaacctattacctaaccgttgggtcccggggtactaaacgggttaccaacggaacctaatttaacggacctttaaaccttttttaaaagtgttaacctacaaacggtaagaacgtacccgaaaaggtaaaaaccccgcccccctaaaaactcccgttaagtaacttttaagtacgggtcacttaataccgtaactttaccgaacgtaaaggtccgggtacccctaagtacgtaacggttctaagtacggtacaggtacggtaacttcgggtgggaacctaggtactttaccaacccttacgaacctgtaccaggtacctagttaccgacgtaaccaaccgtagtaaagtaccttttagacttaaattacgttttacagttactaaacgacgttacctacaacgttaagacggtatacccgttaagttttcggacccggaaggaacctagggacgttaaggacgggaaaaccgtaaagggtacttcggggtaaggcctaacgggaacctaccgttaagttccggttacttacccggttacg

SEQ ID NO: 35302 - DNA, 618 bp, Homo sapiens
  misc_feature: GYAE6OF02FWPA1.8.85.H08.1.454.CMB.1.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
tcagctcgcgtgtccacgaccggtgctcgatttagtatcactcagtcggacgggggagtcagtctcagtcaggacacagcatggaccatgaggtcccgctcagctcctgggctcctgctactctggctccgaggtgaccagatgtgacatccagatcgacccagtctcccatcccgtccctgtctcgcctatcctgtccggagaccagagtcaccatcacttgtcggcagtcagactataaatattattaaatgtatcngcagaacaggacnccctaagcctcctcatatacttcngtctattcactttgacaaggttcgggtacccagtaccgtaaggttccaggtcggacgaggtggattcgtagggactaaggtactttccacttctccacctacgtccgacgtacgttacgtacgtacctaaccgtacgtaaacgtttacgttttacgtacttaagttttaaccttaacttcgttacaagtacacgttaccaacgtaagtcggtacgttcgtacgtttacggaccgtaagggtacctaacggtcgtaacggaacgtaacgggtaacgtaacgttacggtacggtccgtaccgacctaaccgtacgttcttaccg

SEQ ID NO: 35303 - DNA, 667 bp, Homo sapiens
  misc_feature: GYAE6OF02FGGQ7.8.85.H08.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
  modified_base (646)..(646): a, c, t, g, unknown or other
  misc_feature (646)..(646): n is a, c, g, or t
  modified_base (655)..(655): a, c, t, g, unknown or other
  misc_feature (655)..(655): n is a, c, g, or t
tcagctcgcgtgtccacgaccggtgctcgatttagtatcactcagtcgcgggggagtcagtctcagtcaggacacagcatggacatgagggtccccgctcagctccgtgggctcctgctactctggctccgaggtcgccagatgtgacatccagatcgacccagtcctccactccctcctgtctgcatcgtggtacgganacncggtactccacctatccgtacgttgggtacggactaacggtcaagtaacttaattaaaactatttaatttaaacgttcggtacacgtaacgacctaaacggaaacccgtacgggacccctaccctaagtcctacctanattactacttacngtacttactctagttacgacgtaacgggttccggacctagtaccgtaagttcgaggtgtacgtaggtacggtactacggtacgggtaactacggttacctttaccgacctacctacctacccgtacttccgaacgttaccgttaccacgtacccgtaacgttacgtaacgtttcgttaactactttaactttacgtacgttacgtacaaacgtactacgtaactaagtaggtacggtacgtacttaccggtgaccggtacgacgagcggtaagacgaacgtacgtgtaggcnctaccgacncgttagtctacg

SEQ ID NO: 35304 - DNA, 682 bp, Homo sapiens
  misc_feature: GYAE6OF02GMM79.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatcgacccagtcctccactccctccctgtctgccatctgtcggagacagacgtcaccatcacttggtcggacaagtcgagaactaattaaattaattaatttaaattggtaatcagactaaggaaacctagggaacccacccctaagtcctcctactaatacttattctacgtctaattctactttggaacctaaggttccgggaccctataccgtaaggttccaggttcggacgtaggtacggtaactcgggtaggaactagtacttttacgaaccttcgtacctaacctacgtaccgacctaacggttcctaccgacctaaaccgtagggtaaacgtttcgtttacgtaactttaagttttaacttcgttaacgttaacaagtaactacctacaaactacgtacgggtacgtacttacggtttaccgggacgtaacggggacctaaggtacggtacgggaaagtaaccggtaaacgtacggtacggtacgggtaccgttaacggaccctacgttacgttcttaccgg

SEQ ID NO: 35305 - DNA, 793 bp, Homo sapiens
  misc_feature: GYAE6OF02I1EV1.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatcgacccagtcctccatccctccctgtctgcatctgtacggagacaggactcaccatcacttggtcgggacaagtcagtactaataaataattaatttaaattaggttatacgagacaaacgaaaccgaagggaaccgacccctaaggaccctacctactattattacgttctagactactttactactttagacgtaaggtacggggtacccctaagtacgtaaaggttacgaagggtacggtcgtaagggtaggtaacggttcgtacggggtaaacctaggttaacgttttaccgtaacttccgtacctaacccgtaaccgtacccggtacctaacggtaccgttacgtaacccgaaaccgttacggtaaaaggtttagttttaacgtacgtttaaaatttttaacctttaacgttaccggtaagtaaaacggttactaaaccttaccgtaaaccgtaaaacggttaggggtaaccgttacgtttaaaccgggtttttaaccgggaccgggtaaacggggtaacccgtaacgggtacggtaacggggtaacgggtaaaccgggttaaaaccgggtaaccgttagggttaccgggtacgtaaacggtacccgttaacccgtagttacccggtttaccg

SEQ ID NO: 35306 - DNA, 725 bp, Homo sapiens
  misc_feature: GYAE6OF02HPDBB.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgaccctagtctccatccctcctgtctgctatctggtcggagacaggactccacctatctacgttcggtcgggacaacggtcaagtaacttaaattaaaattaatttaatttaaagttggtatactagacaagaaaccgaaggggaaccctacccctaagtcccttaccctataacttaattactttactcgtacttactttcctacgtttgaaccgtaaacggttccgggtaccctaacgtacgttaacggttacgtagggtcggacgttagggtacggtacgtacggtaggaacgtacgttacttacctaccttctacccgtacctaccgtcccgacgtacgttctacggtaccctaacggtaggttaaacgttacgtttcgtaacttaacgttttacgttaactgtacgtaacgtaactactacgtaacgtagtacggttacgtccgttaacggttccggaaccggtacggacggtaacgtccgggtaaggaacggtaaaccggtaacggttaacggtcgggttacggtaacccgttacggaccgttaaccgttaccgtgttacccgg

SEQ ID NO: 35307 - DNA, 900 bp, Homo sapiens
  misc_feature: GYAE6OF02FQJCE.8.85.H08.1.454.CMB.1.raw
tcagctcgcgtgtccacgaccggtgctcgatttagtatcactcagtcgcgggggagtcagtctcagtcaggacacagcatggacatgacgggtccccgctcagctccgtggggctcctgctactctggctccggaggtcgccagatgtgactatccagatcgaccctagtcctaccacttcccctacccgttcgtctacgtctagttccgtggtacggacacgagtacgtacccaaccgtacttacctacgttcgggtaccgggactaacgtacgtaacgtacctaaatttaaaccgtaaactttaaattttaaacgtttcggtaaactaaaccgaaaaaaccgtaaaaaccggaacggggtaaaacccgtaacccctttaaaacgtcccggtttacggttaacttaacttaccgtacgtaccttacctaccgtttaacgtttaccggtaacgttaaacggggttaccggggttacccctaaggttaaccggttaacgggttacgaggggttacggtacggtaggtttaacggggtttacggtttaccgggtttaacgttttacggtttttacacccgtttactacccgtaaacgtaacctccggtaaagtccgttaacttacccggtaaccgttaacggtaacggttaaacgttacggtttaacctaaccgtttaacctttaccgttaaccgtttacgtaaaccggttaacttaaacggttaaccttaacctaacgtttaaccggaacggtttacggttaacccggtacgggttacggaaaccgggttacggaagggttacgtaacgtaactaacgtaacgttacgttacggtccggtaactacgttacccgacgttactcggttttacaccttgttaccctccgttaccgtactacgg

SEQ ID NO: 35308 - DNA, 657 bp, Homo sapiens
  misc_feature: GYAE6OF02HFPAO.8.85.H08.1.454.CMB.1.raw
  modified_base (200)..(200): a, c, t, g, unknown or other
  misc_feature (200)..(200): n is a, c, g, or t
  modified_base (332)..(332): a, c, t, g, unknown or other
  misc_feature (332)..(332): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
  modified_base (505)..(505): a, c, t, g, unknown or other
  misc_feature (505)..(505): n is a, c, g, or t
  modified_base (631)..(631): a, c, t, g, unknown or other
  misc_feature (631)..(631): n is a, c, g, or t
tcagctcgcgtgtccacgaccggtgctcgatttagtatcactcagtcggcgggggagtcagtctcagtcaggacacagcatggacatgagggtccccgctcagctcctggggctcctgctactctggctccgaggtgccagatgtgacatccagatgacccagtctccatccctcctgtctgcatctggtcggagacagngtcaccatctacgttcgtcgggactaagtccagtaactaataaaattaatttaatttaaattggtaatcacgactaacgaaaccgtacgggaaccctacccctaaagtcctcctactattaattactcgtancttaactttacctactttagactaaacgggttcggtaaccccattaccgtaaggttccgaaggttcggtacgtaggtgtaacgtcggtaggactagtacttcgtactacgtacacgtcncgtacgtctacncgaactaccggtagtaacttagttactattaatttcttacgngtaacgtaaacggtactaacgtacgaaacgtaaggtcgggaattccgttacggttaaccggacgggaaccggttaacaacgggtcgtaacggggaagaacgggttaacgaaccggtggtaccgggntaccggacgtaactcggtcgttaccg

SEQ ID NO: 35309 - DNA, 797 bp, Homo sapiens
  misc_feature: GYAE6OF02GZYL2.8.85.H08.1.454.CMB.1.raw
tcagctcgcgtgtccacgaccggtgctcgatttagtatcactcagtcgcgggggagtcagtctcagtcaggacacagcatggacatgagggtccccgctcagctcctggggctcctgctactctggctccggaggtgccagatgtgacatccagatcgacccagtcctccatccctccctgtctgcatctggtcgagacagactccaacctatcgtaccgtttggtaccgggactaaggtccaagtaacttaaattaaaatttaaagtttaattttaaaagttggttaactacgagaacgtaaccggaaaaccgaacggggaaacccctaccccgttaacgacccttcccttaactaactttaagttaacttttccggtacgtaccttacgttttacctaacttttaggaccgttaaaaggggttcccgggggttacccctaagttaaccggttaaaggttccgtaaggtccggtacgtacggtacggtaacgtcggttaggggaacttaaggttacctttcaacgttcctacacccgtcgttacccgctacgttccttacgaacctaccgtagtaacggttacttttagactttaaactttttaacggtacgttaagtacggtaacgttacgtaaccttaacgtaacgtaaggttaccggaacgttcggtttacgtttaacgggaacccggttaaggaccggtacgtaacgggtacgggaaacggaaaacgggtaaacgttaccggttaggtaccggtaccgttaccgacccggtaaacttccgttacggtttacc

SEQ ID NO: 35310 - DNA, 676 bp, Homo sapiens
  misc_feature: GYAE6OF02HHNLW.8.85.H08.1.454.CMB.1.raw
  modified_base (201)..(201): a, c, t, g, unknown or other
  misc_feature (201)..(201): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtcctccatccctccctgtctgcatcctgtcggagacagngtccaccatcacttgtcggcagtcagactataaataattattaattgtatcagcaagaaaccgagggaaccacccctaagtccctacctcgaattactacgttctcgtctacttactaccgtttgacgtaacggttacggggtaccctagttaccgtaacggttcgtaggtcggtacgtaggttaggtacgttacgtacgggaactacgttacgttttacctaccgttcctaccggaacccttacgtacccgacgtacgtcgtacgtacccgtaacgtaacgtaacgtttactttacgtacttaacggttttaacttacgttacgtacgttaaagacgtacctacgacgtaacgtacggacgttacgttacggtttccggaccgtaacgggaccgtaacgtccggtaacggaaggtaacgggtaaaccgacgtagggttacggacgtaccggaccggtacctagttccttaccgg

SEQ ID NO: 35311 - DNA, 576 bp, Homo sapiens
  misc_feature: GYAE6OF02FUZCV.8.85.H08.1.454.CMB.1.raw
  modified_base (284)..(284): a, c, t, g, unknown or other
  misc_feature (284)..(284): n is a, c, g, or t
  modified_base (339)..(339): a, c, t, g, unknown or other
  misc_feature (339)..(339): n is a, c, g, or t
  modified_base (452)..(452): a, c, t, g, unknown or other
  misc_feature (452)..(452): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatccctccctgtctgcatctgtcggagacagatcaccatcacttgtcggcaagtcaagactaataaataattaattaaattggtatcagcaagaaccaggaaccacccagctcctanatattacttctgactacttctactttgactaaggtcgggtccaatcgtaaggttnaagtgactaggtgatcgtgggaacagtactttccactctcctaaccacgtccgactacgtctagacctaacgtagaacgttaatttagaccttaaatttacttacgtcgtaanaagtacgacttacaactaagtaggtacgtacttacggtttacggaccgtaacgggaccgtagtacggtaacggaaggaacggtaaacgtacgtaggtcgtagtccgacgtactattcgttaccg

SEQ ID NO: 35312 - DNA, 921 bp, Homo sapiens
  misc_feature: GYAE6OF02H4MRK.8.85.H08.1.454.CMB.1.raw
tcagctcgcgtgtccacgaccggtgctcgatttagtatcactcagtcgcgggggagtcgagtctcagtcaggacacgagcatggacatgagggtcccgctcagctccgtggggcctcctgctactctcggctccggaggtcgccagactgtgaccatccgagatcgacccagtctcccgatccctccctgtcctcgacagttctcgggcgtaagaccaggtacgtccaaacctgtccgtaagttcgggaccgggtacctaaaaggtcaaacgtaactttaaaaactaaagtttaaattttaaacgttttaagttacggtaaacgttcaacggtaacgtaaaacgtaaaccggaaacggggtaaacctacccccgtaaaaggttccccttaccgtaacctagttaaactaccgtttcgtagaacctaaccttttacgtaacgtttacgtaacggtaaaacggggtttccggggtaaccccttaacggtaaccggtttaaagggttaccgttaaacgggtacgttaccgggtaaaacgggtcgtaaggtttccggtaacgggtaacgtttaaaggttccccttttaaagaccccctttaggttaaaccctcgtaaacccggtccttaacgacggtttaaccgtcgtaaaccgaccgtttaagggtaaccgtttaagttttaccgtaactttaaacgtttagttttaaacgccgttaaacgggaaagtttaacctaacgttactaaacggaatttaaccggggaaattccggtttaaaccgtttacggggaaacccgtacggggtaacccgttaacggtacgggaaaccggggtttacggtaaaagggtaacccgggttaaacgttaccgggttacgggaacctttacggggaacccttaacccggttagaacccttttccggg

SEQ ID NO: 35313 - DNA, 805 bp, Homo sapiens
  misc_feature: GYAE6OF02GP6KA.8.85.H08.1.454.CMB.1.raw
  modified_base (96)..(96): a, c, t, g, unknown or other
  misc_feature (96)..(96): n is a, c, g, or t
tcagctcgcgtgtccacgaccggtgctcgatttagtatcactcagtcgcgggggagtcagtctcagtcaggacacagcatggacatgagggtcccnctcagctccgtgggctctgctactctggctcgaggtgaccgagacgtggtacgacacgtacccgaagtactacggaacccctagttaccgtcctaacttcccgttcccttggtacctcgtcacttcgtcggtacgggacgaacgtagtaccgttccaaccgtactaccgtacggttcggtaccgggactaacggtactaacgtaacttaaattaaactttaatttaaagttttaaagttaggttacgtacgtacggacgtaaacgaaaccggaccggggtaaccctaacccgtaacgtcctacccgtaacgtattacttacgttaccacgtacttacttacttaccgtttagaaccggttacggtaccggtccttagtacgttaggtactacggtgacgtaggtggtacgtcggtaaggactagggttacctttacgaccttacgtaccctaacgtcctacgacgtacctacctacggtaaaccgttaacggtaagttacgtttaggtttacggttaacctttagttaccgttacgttacggtaacgtacggtaaccttacaaccgtaagtacgttaagtccgggttaacgttcggttaacggaccggtacgacggttaggtacccgggttaagggaaaccggtaccgttaacggtaaccggttcgggttaccgtagttacccgtacctacgttaccgtacttaaccgg

SEQ ID NO: 35314 - DNA, 299 bp, Homo sapiens
  misc_feature: GYAE6OF02HPV75.8.85.H08.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (274)..(299): a, c, t, g, unknown or other
  misc_feature (274)..(299): n is a, c, g, or t
tcagctcgcgtgtccacgaccggtgctcgatttagtatcactcagtcgcggaagatgaagacagatttcactctcaccatccgcagtctgcaacctgaagattttgctaatttattactgtcaagagactcacaatggaggcacttttggccaggggccaagctggagaggaaacgaactgtggctgcaccatcgtgtcttnagtcttccgccagtcctgagacacgngtagctgagcggtactgggacaagggtcgcaagtttgancctnagnnnnnnnnnnnnnnnnnnnnnnnnnn

SEQ ID NO: 35315 - DNA, 741 bp, Homo sapiens
  misc_feature: GYAE6OF02GAKKT.8.85.H08.1.454.CMB.1.raw
  modified_base (734)..(734): a, c, t, g, unknown or other
  misc_feature (734)..(734): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtagacatccagattcgaaccctagtcctacccacgttccctccctgtcctgcacttcgtgtcggaagacaggtacgtcaacctagtcacgttaggtccggataacgtcgaagttaacgtaaattaaattaaatttaaattttaaattggtaactacgacgaacaacggtaaacgacgggaacccgaccctaacggtccttaccagtaattaacgttactttacgtacgtaactttacgttacttaacgtttacggaacggtaaacggttaccgggtacccttaagtaaccgttaacggttagacggtacggtacgtaaggtacggtattaaccgggtggaaacgttaagttacgttttacccaacgttccctaaccgaacctaccgttaccgacgttaaacgtccttaacgaccggttaaacgtaggtaaacgttactttacggtaactttaaacgttttaacgtaacgtacttaaaccgaaattaaccggtactaacggtaacgtaagtaggtacgtacgtttacgggtactacgggaacgtacgaggttacgaggtaagaacgaacgtagagtcggccgtagactacgntcggtac

SEQ ID NO: 35316 - DNA, 595 bp, Homo sapiens
  misc_feature: GYAE6OF02GTVFQ.8.85.H08.1.454.CMB.1.raw
  modified_base (126)..(126): a, c, t, g, unknown or other
  misc_feature (126)..(126): n is a, c, g, or t
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (392)..(392): a, c, t, g, unknown or other
  misc_feature (392)..(392): n is a, c, g, or t
  modified_base (460)..(460): a, c, t, g, unknown or other
  misc_feature (460)..(460): n is a, c, g, or t
  modified_base (588)..(588): a, c, t, g, unknown or other
  misc_feature (588)..(588): n is a, c, g, or t
tcagctcgcgtgtccacgaccggtgctcgatttagtatcactcagtcgcggggggagtcagtctcagtcaggacacagcatggacatgacgggtccccgctcagctcctggggctcctgctactcnggctccggaggtcgccagatgtgacatccagatcgacccagtctaccactcctccctgtctncatctgacgganacagactccaaccatacgactttcggacggtactaacggtcaagtaacttaataaaattaactttaagtttaaatggtaatacagacaagaaaccaagggaacccacccgtaagcctacctaacgtataacgttattcagtactacgttacacgtttagacgaaaggtcggtaccatacgtaagtctagcgngataggatcgagactatacgttcactcaccactacgtccacgtacgtatcgaactacgtagtaagttntttaagacgtttaactttaagtactactaagaagtacgtactaggactaagtcggagtacttacggtacgacgacggtaacgagtcggaaggaacgaacggacgtaagtcgtagcgtacgactacgtnttagtcg

SEQ ID NO: 35317 - DNA, 817 bp, Homo sapiens
  misc_feature: GYAE6OF02FWHFA.8.85.H08.1.454.CMB.1.raw
tcagctcgcgtgtccacgaccggtgctcgatttagtatcactcagtcgcgggggagtcagtctcagtcaggacacagcatggacatggacgggtccccgctcatctccgtggggctcctgctactcgtcggctccgaggtcgccagatgtgacatccagatcgaccagtcctaccactcctcctgtctgctatcgtggtcggacgacagacgtccaacgactcgtacgttggtacggacaagtacaagtaactaattaaaacgttaatttaaatttaaagttcggtaataccgaagtaaccgaaacggtaaaaccggaaccgggaaccgtaacccccgttaaacgacccttaccgtaacgtaaacttaacgttaaccttcgtacggtacttaaccgttaaccttaccgttttacgggaaacgttaaacggggttccggggtacccctaagttaaccggtaaaagggttcaacggggttacggaccgtaagggttacgtaacgttaccgggtagggtaaccgtaaggttactttacccaacgttcctacctaaccgtacgtacccgactacggttaccacgtaacctaacggttagtaaacgtttagtttaacgacgttttaaactttacgttaacgttaggaaacctaacgggtaacctaaccgttacgaaaccggttaaggttaaccgggcttaaccgggtttacggtttaccgggaaccggtaacggtaccgaacggtacgtaagggaaacggtaaacgggtaaacccgtagttacgggtactacggtacccgaatacccgtagtcccgttaagg

SEQ ID NO: 35318 - DNA, 744 bp, Homo sapiens
  misc_feature: GYAE6OF02G7FCP.8.85.H08.1.454.CMB.1.raw
tcagctcgcgtgtccacgaccggtgctcgatttagtatcactcagtcgcgggggagtcagtctcagtcaggacacagcatggacatgagggtcccgctcagctccgtgggctcctgctactctgactccgaggtgccagatgtgacatccagatgacccagtctcatccctcctgtctgcatctgtcggagacagacgtcaccatcacgttggtcgggacaagtcagactaataaattaattaatttaaattgtatacaataacgaaaccgacgggaaccgccctaagccttactactaattattacttactcgtactactttcctaacgtttacgacgtaaacggttcggggtaccctaacgttaccgtaaacggtttcgaagggtcggtacggtaggttacgggtaacgttcggttacggggaactaacggttactttaccgtaccttacgtaccacccttaccgtaccctaacgtacgttacctacggaacctaaacccgttaaggtaacggtttaacgttttacgtaactttaaacgttttaacttaccgttacgttaacgtaaacgtaacgtaacctacgtaacgtaacgttaacgggacgttaccgtttaaccggttttacggaacccgggttaaccggggaaccgtaacgggtaccggttaagggaacggtaaaccgggaaacgtacggtacggtacggtaccgtacgtaccgtaacctagttccgttaagttcccg

SEQ ID NO: 35319 - DNA, 727 bp, Homo sapiens
  misc_feature: GYAE6OF02HEXP8.8.85.H08.1.454.CMB.1.raw
  modified_base (137)..(137): a, c, t, g, unknown or other
  misc_feature (137)..(137): n is a, c, g, or t
tcagctcgcgtgtccacgaccggtgctcgatttagtatcactcagtcgcgggggagtcagtctcagtcaggacacagcaatggacatgagggtccccgctcagctcctggggctcctgctactctggctccgaggtnccagatgtgacatccagatcgacccagtcctccatccctcccgtgtctgcattcgtggtcggagacaggctccaccattccacgtttcgggtaccggactaacgtccagtaaacttaattaaaagtttaatttaaattttaaagtttaggtaatcgaagtaccgaaacgaaaaccggaaccggtaaacccgccccgtaaatccctacctactattacttacgttctacgacctatttcctactttacggagtaaacggggttcggtacctaagtacgtaaggttaccgtagtgggactacggtggtactcggtagacgtatactttaccgcttcctaccacgtaccgtccgacgtcgtgtaccgacgttaacctaggttaaagttcgtttacttaacttaaattttaccgttagttacgttaaccgtaaaggtacctaactaccgtaaacgaaggttcgggtaaaccgtttcggtttaccggttaacgggaccggtaccgggttaacgacggttacggtaaacggtacggaaacggtaacgtaacggtcggttacgaccggttccaacggttaacctcgttcgttacccg

SEQ ID NO: 35320 - DNA, 667 bp, Homo sapiens
  misc_feature: GYAE6OF02HPQQ0.8.85.H08.1.454.CMB.1.raw
  modified_base (315)..(315): a, c, t, g, unknown or other
  misc_feature (315)..(315): n is a, c, g, or t
tcagctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatccctccctgtctgctatctgtcggagacagagtcaaccatcacttggtcgggactaaggtcagtaactaataaaataatttaatttaaattggtatcagacaagaaaccagggaaccgcccctaagcctcctacattatactttcncgctattcctactttgactaaaggtcggggtcccaagttacgtaaggttcgaaggtcggtactaggtggacgtcggtacgggaactaggtactttacgacttacctacacctactcccgactacgtcctacgactaaccgtagtaaacggttattttacggaacttaacttttaacgttacgttaggtaacctaaaggtaaccgtaacttaccgtaaacgttaaggtacgtaacgggtaccgttacgttacgggtaccgtaacggggtacctaacggtaggtaacggaacggaacgggaaaccgtacggtacggtcggtacgtaccggtacccgaacgttactcggttacgg

SEQ ID NO: 35321 - DNA, 755 bp, Homo sapiens
  misc_feature: GYAE6OF02HQUFO.8.85.H08.1.454.CMB.1.raw
  modified_base (159)..(159): a, c, t, g, unknown or other
  misc_feature (159)..(159): n is a, c, g, or t
tcagctcgcgtgtccacgaccggtgctcgatttagtatcactcagtcgcgggggagtcgagtctcagtcaggacacagcatggacatgacgggtcccgctcgagctccgtggggctcctgctactctggctccggaggtcgccagatgtgacatccagntcgacccagtctaccatcctcctgtactgacctatcctaggtaccggagacctagcgtccacctatcgtacgttcgggaccgggtacaacgtcgaagtaacttaaattaaacgttaaattttaagtttaaaacgttgggttaacttcgaacggtaacaaacggaaaacccggtaacggggtaaccgtaaccccgtaacgtaccttaccctataacttaacttagttactcgacttacttaacgtactttagacgtaacggtcggtacctaatacgtaacggtaacgtcggaggtaccgagttagggtaactcgggtacggtaacgaaggttttcttacgtaacccgttctaccgtaaccgtaacgttccggaacttaccggttacttacgggttaacccgaacttaaggggtaactttaacgtttacgggtaaacttaaactttacgtttaaacgtcgttaaacgacggtaaactaccggttaaccaacggttaacgaacggtacgtaccgttagttacggacgtacggacgtaacgtgggtaacgaaggaacgtaaacggtactaggcggactaccgtacgaaccttgcttaccg

SEQ ID NO: 35322 - DNA, 513 bp, Homo sapiens
  misc_feature: GYAE6OF01EE7ZZ.45.79.H02.1.454.CMB.1.raw
  modified_base (302)..(302): a, c, t, g, unknown or other
  misc_feature (302)..(302): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttangagggcagtaagcggccctcaggggtttctaatcgcttctctggctccaagtctggcaacacggcctcctgacaatctctgggctccaggctgaggacgaggctgattattactgctgctcatatgcaggtagtagttactttggtgttcggcggagggaccaaggtctggaccgtcctaggtccagcccaaggctcgcccctggctaccg

SEQ ID NO: 35323 - DNA, 553 bp, Homo sapiens
  misc_feature: GYAE6OF01DZ3OM.45.79.H02.1.454.CMB.1.raw
  modified_base (301)..(301): a, c, t, g, unknown or other
  misc_feature (301)..(301): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacaggctcctgggcccagtctgccctgactcagcctgcctccgtgtctgggtctcctggacagtcgatcaccatctcctgcactggaaccagcagtgatgttgggagttataaccttgtctcctggtaccaacagcaccaggcaaagcccccaaatcatgatttangaggcagtaagcggccctgagggtttcaatcgcttctctggctccaagtctggcaacncggcctccngacaatctctgggctccgaggctgaggacgaggctagattattactgctgctcatatgactaggttagttagttacgtttgggtcgttcgggacggtacgggacctaaggtccttaggacccggttccgtagggttaccaacggtaccccgaagggtccctacccggtccccccgtgggtacccc

SEQ ID NO: 35324 - DNA, 530 bp, Homo sapiens
  misc_feature: GYAE6OF01E3IXL.45.79.H02.1.454.CMB.1.raw
  modified_base (323)..(323): a, c, t, g, unknown or other
  misc_feature (323)..(323): n is a, c, g, or t
  modified_base (428)..(428): a, c, t, g, unknown or other
  misc_feature (428)..(428): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaaacgcccccaaaactcatgatttatgaggcagtaagcgccctnaggggtttctaatcgcttctctggctccaagtctggcaacacgcctccctgacaatctctcgggctccgaggctgaggacgaggctgattatactgctgctcatntcgcaggttagttagttacgtttggtggtttcgggcggagggtaccaaggccgtcgaccgtccgtaggtcagcccgaaggcctcgcccccgtggtcctaccg

SEQ ID NO: 35325 - DNA, 510 bp, Homo sapiens
  misc_feature: GYAE6OF01BD710.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccagctgaggacgaggctgattattactgctgctcatatgctaggtagtagttactttggtgttcggcggagggaccaagctgaccgtctaggtcagcccaaggctgccccctggtcctacg

SEQ ID NO: 35326 - DNA, 558 bp, Homo sapiens
  misc_feature: GYAE6OF01B9BDG.45.79.H02.1.454.CMB.1.raw
  modified_base (441)..(441): a, c, t, g, unknown or other
  misc_feature (441)..(441): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaacgcccccaaactcatgatttatgaggcagtaagcgccctgagggttctaatcgtcttctctggtctcgaagtctggacaacaccggcctccgtgactaactctcgtcgggctccaggctaggaggacgagtctgaagtttatacgtgctgcttacgattntagctaaggtagtagttacgtttgggtgttaccgggcggtacgggaccaaggtccgtggtacccgttccgtaggtcaacggacccgtaacggtccctcggccccctggtcctacccg

SEQ ID NO: 35327 - DNA, 596 bp, Homo sapiens
  misc_feature: GYAE6OF01CS2Q3.45.79.H02.1.454.CMB.1.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctctggacagtcgatcaccatctctgcactggaaccngcagtgatgtggattatacttgtctctgtacacagcaccagcaacgccccaactcatgatttangaggcagtacgcgcctgtagggttctaatcgtcttctcgtcggtctcgaagtcgtcggacaacgtcggcccttccgtagaacctaactcctcgtcgggtcctccgaggctcgaacggacgacggtcttagtacttttacgtttcgttgtttcgtcttactaacgttagtcgacgacggggtaccaggtcctacggtttgggtcggttccggacgggtacgggaccgtagggttacgacccggttacgtacggtccgaccggtacccgaacggtcccgttaccggtcccccgtcggtccgtaccgttcccg

SEQ ID NO: 35328 - DNA, 535 bp, Homo sapiens
  misc_feature: GYAE6OF01DZ01Z.45.79.H02.1.454.CMB.1.raw
  modified_base (269)..(269): a, c, t, g, unknown or other
  misc_feature (269)..(269): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacngcaccaggcaaacgcccccaaatcatgatttatgagggcagtaagcggccctgagggtttctaatcgcttctctggctccagtctggcaacacggcctcctgactaatctcgtggctccgagctgacggacgnggctgatttattacgtgctgctnatatgcagttagtagttactttggtgttcggcggtagggacctaaggctcggtacccggtacgtacgggtacacgcccgtaaggcctaccgcccccgtcggtcctacccg

SEQ ID NO: 35329 - DNA, 567 bp, Homo sapiens
  misc_feature: GYAE6OF01BIDRL.45.79.H02.1.454.CMB.1.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggattataacttgtctctgtaccaanancaccagcaaacgcccccaaactcatgatttatgaggcagtaagcgccctgtagggtttctaagtcgcttctctgctccaagtctggcaacgacgccctcctgactatctcgtcgggcctccgaggctggaggacgnggctagtattattctgctgctnatagtgacgtaggttagttacgtttacgtttgggtcgttcgggacggtacgggacctaacggtccgtacggtacccggttaccgttacgggtccaccggaccccgtaacggtcccgtccgccccccgttcggtcccttacccg

SEQ ID NO: 35330 - DNA, 588 bp, Homo sapiens
  misc_feature: GYAE6OF01CXZPB.45.79.H02.1.454.CMB.1.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
  modified_base (296)..(296): a, c, t, g, unknown or other
  misc_feature (296)..(296): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattatacttgtctctgtaccanagcaccaggcaaacgccccaaactcatgtatttangaggacagtaagcggccctcgtagggtttctaagtcgtcttctctcggctaccaagtctaggcctaacgaccggccctcctacgacctaattcctcggtcgggtcctccgaggtcgtaggacggacggaggctagtatttaatactgtctcgctacatagtgctaagggttagtagttacgtttggtcggttcgggacggtagggtaccaaggtcgtacggtacccgttacccgtagggtacccaacggacccggtaacgtccgtacccggtcccccgtcggtccctacccg

SEQ ID NO: 35331 - DNA, 505 bp, Homo sapiens
  misc_feature: GYAE6OF01A8BKU.45.79.H02.1.454.CMB.1.raw
  modified_base (322)..(322): a, c, t, g, unknown or other
  misc_feature (322)..(322): n is a, c, g, or t
  modified_base (417)..(417): a, c, t, g, unknown or other
  misc_feature (417)..(417): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaaactcatgatttatgagggcagtaagcgccctnagggtttcaatcgcttctctggctcaagtctggcaacacggcctcctgacaatctctggctccaggctgagacgagctgattattactgctgctnatatgcaggtatagtactttggtgttcggcggaggaccaggctcgaccgtcgtaggtcagcccgaaggcctagccccctggtctaccg

SEQ ID NO: 35332 - DNA, 597 bp, Homo sapiens
  misc_feature: GYAE6OF01BG97H.45.79.H02.1.454.CMB.1.raw
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattttagtttgtctcctggtaccaacaacaccccggcgaagcccccaaactaatcatttatagggacactaagcggccctcgggggtttcaagtcgcttctctggctccaagtctggcaacncggcctccctgacaatctctggctccaggctcaggacgaggctgattatttctgttnctctatatgacaggttagtagttacgtttgggtaggtttcgggacgggtagggtacccaaaggtcgtacggtacccgtccgtagggtccaacggtccccgaagggtccttaccggcccccccgttcgggtcctaccgttccgttaccgtttcccccgccccttcccgtccgtacccgg

SEQ ID NO: 35333 - DNA, 466 bp, Homo sapiens
  misc_feature: GYAE6OF01AIR50.45.79.H02.1.454.CMB.1.raw
  modified_base (456)..(466): a, c, t, g, unknown or other
  misc_feature (456)..(466): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcctaatacgtattactttgatagtaggggagtttttgatatctggggccaagggacaatggtcaccgtctcttcagcctccaccaagggcccatcggtcttccccctggcaccctcctccaagagcacctctgggggcacagcggccctgggctgcctggtcaaggctactcctcgatcgcgtctgagcgggctggcaaggcgcatagnnnnnnnnnnn

SEQ ID NO: 35334 - DNA, 460 bp, Homo sapiens
  misc_feature: GYAE6OF01B26K5.45.79.H02.1.454.CMB.1.raw
  modified_base (367)..(367): a, c, t, g, unknown or other
  misc_feature (367)..(367): n is a, c, g, or t
  modified_base (451)..(460): a, c, t, g, unknown or other
  misc_feature (451)..(460): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaacccctcctcaagagtcgagtcaccatatcagtagacacgtccaagaaccagttctccctgaagctgagctctgtgaccgctgcggacacggccgtgtattactgtgcgagagatcctaatacgtattactttgatagtagggagttttgatatctggggccaagggacaatggtcaccgtctcttcagcctccaccaagggcccatcggtcttcccctggcaccctcctccaagngcacctctggggcacagcggccctgggctgcctggtcaaggctactcctcgatcgcgctgagcgggctggcaaggcgcagtagnnnnnnnnnn

SEQ ID NO: 35335 - DNA, 610 bp, Homo sapiens
  misc_feature: GYAE6OF01BNIME.45.79.H02.1.454.CMB.1.raw
  modified_base (226)..(226): a, c, t, g, unknown or other
  misc_feature (226)..(226): n is a, c, g, or t
  modified_base (469)..(469): a, c, t, g, unknown or other
  misc_feature (469)..(469): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggattataaccttgtctcctggtaccaacagcacccaggcaaacgcccccaaatcatgatttatggagggcagtaacgcggccctcgtagggtttctaatcgtcttctcgtcggcctccgaacgtcgtggaccaaccgaccggtccctcccgtagactaactccgtcgtcgggcctccgaggtctacgacggacggaggtctagtatttacgttactcgtctcgctctatntcgcgtaggttagttacgttacgtttgggttcggttcgggacgggtacggtaccgtaagtccgtacggtacccgttaccggtacggtccgacggaccccgtaaacggtcccgtacccggtcccccgttcggtccctacccg

SEQ ID NO: 35336 - DNA, 529 bp, Homo sapiens
  misc_feature: GYAE6OF01AYDYX.45.79.H02.1.454.CMB.1.raw
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaacgcccccaaatcatgatttatgaggcagtaagcggccctgaggggtttcaatcgcttctctggctccaagtctggcaacacggcctcctgacaatctcgtggcctcgagctggaggacgaggctagtattattactgctgctcatgtgctagggttagtagttacttggtcgttcggcggtagggaccaagccgtgacccgttcgtaggtccacgcccgtaaggcctacggcccccttggtcctaccg

SEQ ID NO: 35337 - DNA, 510 bp, Homo sapiens
  misc_feature: GYAE6OF01BFZ6M.45.79.H02.1.454.CMB.1.raw
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattatacttgtctctgtgcaacngcaccaggcaaacgccccaaatcatgatttangaggcagtaagcgcctgagggtttctaagtcgtcttctctggctcagtctggcaacgcgcctcctgacactctcgtggctcaggctggacggacgaggctgattatactgctgctcatatgactaggttagtagttacgttggtggtcggaggacggactaaggctagacccgttcgtacggtcacgtcccaaggtcctccgtccccgtggtaccc

SEQ ID NO: 35338 - DNA, 740 bp, Homo sapiens
  misc_feature: GYAE6OF01EH28O.45.79.H02.1.454.CMB.1.raw
  modified_base (215)..(215): a, c, t, g, unknown or other
  misc_feature (215)..(215): n is a, c, g, or t
tcagacgcgatcgacacgaccggtgctcgatttagtgtcacacgaaggtaagggggggttcggacaaggaggccagcgctcgtacgggacgtccgtcctaccattggcctggctctgctgactcctcactctcctcactcgaggtacgacagggtcctgggtcccagtctgtcccttgactcacgcctgcctcgtagtctgggtctcgtgggacngtcgactcacctagtcctcctcgcacgtcgaaccctagtctagtgattggttaggtattaattaaccgtttggtcctaccgtcggtaacccaactacgaccaacccgaggtacccaaaccgacccccgaaactccgaagtcgtaagtttacgtggaggtcgtaggtaacgtccggtaccctacgtacgggtttactaacgtcgtactttcgtcgtaggtcgtccgtaagttcgtaggtacgaacggaccggtccttccgtagactaacttccgtaccgtcgggtacctaccgtacggtaccttaggaacggtacgtaggtaccttagtactttaacgtaacgtcgtactcgtacctacacttacgtacggacgtaaggttaacgttacgtttacgttttggttacggttccggtacgggacggtaaccgtaacggtccggtaccggtacccggtaccgggtacggtaccgtacgggacccccggtaacggtcccgtacccggtcccccgttccgtccgtaccccg

SEQ ID NO: 35339 - DNA, 540 bp, Homo sapiens
  misc_feature: GYAE6OF01AL2Z2.45.79.H02.1.454.CMB.1.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (391)..(391): a, c, t, g, unknown or other
  misc_feature (391)..(391): n is a, c, g, or t
  modified_base (458)..(458): a, c, t, g, unknown or other
  misc_feature (458)..(458): n is a, c, g, or t
tcagacgcgatcgacacgaccggtgctcgatttagtgtcacacgaagggaaagggggggtcacaagaggcagcgctctcgggacatctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattataaccttgtctctgtaccanagcaccaggcaaacgccccaaactcatgattatgaggcaagtaagcggcctcgtagggtttctaatcgcttctctgctcaagtcngcacncgcctcctgactatctctgggctccgagctggaggacgngctgtaattcgtactcgcttgcctcatatggactaggttagttagttacgtttgggtcgttccgggnggtacgggaacctacggtcgtacgtacccggttccgtaggtccgaacgtcccgaagggtccctccggtcccccgtggtaccc

SEQ ID NO: 35340 - DNA, 595 bp, Homo sapiens
  misc_feature: GYAE6OF01B3FF7.45.79.H02.1.454.CMB.1.raw
  modified_base (232)..(232): a, c, t, g, unknown or other
  misc_feature (232)..(232): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtnagtgttgggattataacttgtctctgtacaanagcaccagcaaacgccccaaatcatgatttangaggacagtaacgcggaccctcgtaggggtttctaagtcgtcttcgtcgtcggctaccaagtctcggacaacgaccggtcccttccctagactaatcctcgtgggcctccgaggtctggaggacgaggctagtattaattactgctgctacatatgcgtaaggttacgtagttacgtttgggtcggttacgggcgggaacgggacccaaggtccgtaccggtaacccggttaccgtacgggtaccgaacgaccccgtaaacgggtcctaccccgggcccccttacgggtccctaacccg

SEQ ID NO: 35341 - DNA, 563 bp, Homo sapiens
  misc_feature: GYAE6OF01C4069.45.79.H02.1.454.CMB.1.raw
  modified_base (299)..(299): a, c, t, g, unknown or other
  misc_feature (299)..(299): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtaccaacagcaccaggcaaagcccccaaatcatgatttangaggcagtaagcgccctagagggttactaatcgcttctcgtggctccaagtctggcaacgcggccctcctgaactaatcctcgtgggcctaccgaggctgaggacgaggtctggtaattattactgtcgttcgctactattctgcgtaagggttagtacgttacgttttgggtcgttcgggcgggtaacgggaccaaggtccgtcggtacccgttccgtaggtcacggacccgtaaggtccctccgcccccgtggtcctacccg

SEQ ID NO: 35342 - DNA, 582 bp, Homo sapiens
  misc_feature: GYAE6OF01CKZ5L.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatggcctgcactggaaccaacagtgatgttgggtatttttagtttgtctccttggtaccaacaacacccggacgaacgcccccaaataactcatttatagggacactaagcgcctcggggttcaagtcgcttctctggctccaagtctggcaacacggcctccctgacaatctactgggctccgaggctcaggacgaggctgatttatttcgtgttgctcatatcgctagggaccagctacgttggggtgttcgggacgggtagggacctaggttcgaccggtccgttaggtccaggccccaaagggtcctcggaccccccttcgggtacccaccgttccgtccggttacccccgccccttcctccgtcgtaccg

SEQ ID NO: 35343 - DNA, 552 bp, Homo sapiens
  misc_feature: GYAE6OF01EQSBC.45.79.H02.1.454.CMB.1.raw
  modified_base (367)..(367): a, c, t, g, unknown or other
  misc_feature (367)..(367): n is a, c, g, or t
tcagacgcgatcgacacgaccggtgctcgatttagtgtcacacgaagggaaagcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctgtaccaacagcaccaggcaaacgcccccaaatcatgtattatgaggcagtaacgcgcctcgtagggtttctaatcgcttctcgtgctcagtctgcacacgcctcctnacatctcgtcggctccgaggtcgtgacggacgagtctagtattacttacgtgctgctctatatgacgtaggttagttagttacgtttgggtcggttcgggacgggtacggaccgtaggtcgtacggtacccgtccgtacggtccacggtacccgaaggtccctcccggtcccccgtggtaccccg

SEQ ID NO: 35344 - DNA, 513 bp, Homo sapiens
  misc_feature: GYAE6OF01BFOJR.45.79.H02.1.454.CMB.1.raw
  modified_base (425)..(425): a, c, t, g, unknown or other
  misc_feature (425)..(425): n is a, c, g, or t
  modified_base (508)..(508): a, c, t, g, unknown or other
  misc_feature (508)..(508): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctctggtaccaacagcaccaggcaaacgcccccaaactcatgatttatgagggcagtaagcgccctcgagggtttctaatcgcttctctgctccaagtctggcaacacggcctccgtgacaatctctgggctccaggctagaggacgagctgtattattctgttgctcatangcgtaggacctagctagttgggtctcggcggaggcctagggtcgaccgtcgtaggtcagacccgagtcctcgcccctggtccnctccg

SEQ ID NO: 35345 - DNA, 534 bp, Homo sapiens
  misc_feature: GYAE6OF01CBGDU.45.79.H02.1.454.CMB.1.raw
  modified_base (515)..(515): a, c, t, g, unknown or other
  misc_feature (515)..(515): n is a, c, g, or t
  modified_base (525)..(525): a, c, t, g, unknown or other
  misc_feature (525)..(525): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattttagttttgctcctggtaccaacaacacccggcgaagccccaactaatcatttatagggacactaagcggccctcggggtttcaagtcgcttctctggctcaagtctggcaacacggcctcctgacatctctggctccagctcaggacgaggctgattatactgctgctcatatgacgtaggtagtagttctttggtgtttcgacgggaggtaccaaggcttcgaccgttcgtaggtccagtcccgaaggcctcgccccgtcgtcaccttntcgttccccncttccctcg

SEQ ID NO: 35346 - DNA, 564 bp, Homo sapiens
  misc_feature: GYAE6OF01DF2X1.45.79.H02.1.454.CMB.1.raw
  modified_base (299)..(299): a, c, t, g, unknown or other
  misc_feature (299)..(299): n is a, c, g, or t
  modified_base (428)..(428): a, c, t, g, unknown or other
  misc_feature (428)..(428): n is a, c, g, or t
  modified_base (461)..(461): a, c, t, g, unknown or other
  misc_feature (461)..(461): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatggcctgcactggaaccaacagtgatgttgggatttttagtttgtctcctggtaccaacaacacccggcgaacgccccaaatatcatttanaggacactaagcgccgtcggggtttcaagtcgcttctctggctcaagtctggcaacgacggcctcctgacaatctctgggctcgaggctcgaggacgaggctagtatttatttctgtttcgctcattangacgtagggaccagcctaggttgggtgttcggnggaggtaccgtaggttcgaccgtcgtaggtaccacgtacccgaacgggcctacggccccctcggtccacgttcctccgttaccccaccctccctcgtcgtacg

SEQ ID NO: 35347 - DNA, 515 bp, Homo sapiens
  misc_feature: GYAE6OF01A4HBK.45.79.H02.1.454.CMB.1.raw
  modified_base (459)..(459): a, c, t, g, unknown or other
  misc_feature (459)..(459): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaaactcatgatttatgagggcagtaagcggccctcgaggggtttctaatcgcttctctggctccaagtctggcaacacggcctccctgacaatctctgggctccaggctgaggacgaggctagattattactgctgctcatatgcaggtagtagttactttggtgtcggnggagggaccaagctgaccgtcgtggtcagcccgaaggcctcgcccctggtcctccg

SEQ ID NO: 35348 - DNA, 690 bp, Homo sapiens
  misc_feature: GYAE6OF01AR8BB.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggattataaccttgtctctgtaccacagcaccaggcaaacgcccccaaactcatgatttatggaggacagtaacgcggccctgtagggtttctaatcgtcttcgtctggcctacaagtctcggcaacgaccggtccctcccgtagactaatccgtcgtcgggtcctccgaggtctaggacggacggacggtctagtaatttacgttacgtcggtccttcggtaccttaccgtaagttacgtacggtaccgtaaggggtttaacgtttacggttttaaccggttttggggttacgggtttaccggggtaccggggtaacggggtaacccgtaaacggtcccggttaccgggtaccccggtttaccggttaaccgggttacccgaaccggtacccccggtaaacgggttccccgttacccggttccccccccgttgggttaccccgtaccccgg

SEQ ID NO: 35349 - DNA, 631 bp, Homo sapiens
  misc_feature: GYAE6OF01CVZ0M.45.79.H02.1.454.CMB.1.raw
tcagacgcgatcgacacgaccggtgctcgatttagtgtcacacgaagggaaaggggggggtcacaagaggcagcgctcgtcgggacgtctccaccatggcctgggctctgctgctcctcactctcctcactcaggacacagggtcctgggcccagtctgccctgactcagcctgcctcgtgtctgggtcctccgtggacagtcgatcaccatctcctgcactggaaccagcagtgatgtggattataacttgctctgtaccacagcaccagacaacgccccaatcatgattatgaggcagtagcgcctcgagggttctaagtcgtacttcgtctggcctaccgaagtcgtcggtacctaacgaccggtccctcccgtagtaacctacgttccgtcgtcgggtcctccgacggtcttacgggacggaacggtacgggtccttaggtaactttacgttaccgtcgtccgtcggtctacctaacgtacgtacggtacgtagggttacgttacgttacgtttcggttcgttccgtacggtacgggacggtaccgtacggtcgtacggtaccgttccggtacggtaccgaccgtacccggtaacggccgttacccgtcccccgttcggtaaccccg

SEQ ID NO: 35350 - DNA, 731 bp, Homo sapiens
  misc_feature: GYAE6OF01D2VUX.45.79.H02.1.454.CMB.1.raw
  modified_base (137)..(137): a, c, t, g, unknown or other
  misc_feature (137)..(137): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacncagggttcctgggcccagtctgccctgactcagcctgcctcgtgtcgtggtctctggacagtcgactcaccattcctcctgcacgtcggaaccagctagtgtagttggttagggatttaacttaaccgttgtccttccgtacggtaaccaacgacgaccacccgaaggacccaaaaccgacccccctaatccgaattagttaacgtttacgaggtacgggacgtaccggttaacgccgggttcccttaagtcgggtttactacgtacctcgttactcgtacgtacgtcgtacgacgtacgaccgtacccgtaccgcctacctacgactaacggtcttccgtacggtccgtcgtacggacggtacggacggtacggacgtactacgttagtacttacggttcctcgtacgttacgtacgtacgtaacggttacggttacgggttaacggtttacgggttacggtttacgggttacgggttacgggtaccgggtacgggtaccggtaacggtaccgtacgtaccggtaccgtaccggtacccgtaacggtacccgtaccggtaccccgtaccggtccccgtcccgtcccgtacccg

SEQ ID NO: 35351 - DNA, 647 bp, Homo sapiens
  misc_feature: GYAE6OF01CVTOY.45.79.H02.1.454.CMB.1.raw
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattataaccttgtctcctggtaccacagcacccaggacaaacgcccccaaactcatgatttangagggcagtaacgcggccctcgtaggggttctaatcgtcttctctggctcaagtctggacaacncgtcctcctgaacatctcgtgggctccgaggctggaacggacgagggcttgaatttaattacgtcgtctgtcctacgtattaagtcgtacgtaagggttacgttaaggtttacgtttttaggggttcggttaccggggaccggggtaacgggtaaccctaaagggtccgttaccgggtaacccggttacccggttaacgggttacccgaacggtaacccccggtaaacgggtccccttccccgggtaccccccccggttccgggttacccgttacccccg

SEQ ID NO: 35352 - DNA, 498 bp, Homo sapiens
  misc_feature: GYAE6OF01CB8JD.45.79.H02.1.454.CMB.1.raw
  modified_base (474)..(474): a, c, t, g, unknown or other
  misc_feature (474)..(474): n is a, c, g, or t
  modified_base (490)..(498): a, c, t, g, unknown or other
  misc_feature (490)..(498): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcctaaatacgtattactttgattagtaggggtagtttttgattatcgtggggccaagggacaatggtcaccgtctcttcagcctccaccaagggcccagtccggtccttcccccgtggccacccctcctccaaagacgccacctcgtgggggcacacggccggcccgtgggcctggccctgggtccaaagggaccttacgttcctaactgactagtctgaggcgggntcggcaaggcgcatgnnnnnnnnn

SEQ ID NO: 35353 - DNA, 536 bp, Homo sapiens
  misc_feature: GYAE6OF01BF425.45.79.H02.1.454.CMB.1.raw
  modified_base (303)..(303): a, c, t, g, unknown or other
  misc_feature (303)..(303): n is a, c, g, or t
  modified_base (468)..(468): a, c, t, g, unknown or other
  misc_feature (468)..(468): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttangagggcagtaagcggccctgaggggtttctaatcgcttctctggctccaagtctggcaacacggcctccctgacaatctcgtgggcctccgaggctggaggacgaggctgatttattactgctgctcatatgacgaggttagtagttacgtttgggtgttcgggnggtacggaccaaggtcgtcggacccgttcgtaggtcacggcccaaggcctacgccccctggtctaccg

SEQ ID NO: 35354 - DNA, 622 bp, Homo sapiens
  misc_feature: GYAE6OF01CGSHA.45.79.H02.1.454.CMB.1.raw
  modified_base (260)..(260): a, c, t, g, unknown or other
  misc_feature (260)..(260): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtggattatacttgtctctgtacaanagcaccaggcaacgccccaaactcatgatttatgaggcagtaagtcgtccctcgtagggttctaagtcgtcttcgtctggctcgaagtctggcaacgacggcctcctgaacaactctcgtgggcctccgaggtctggaacggacggtacggctagtaatttacttacgtgtacctgaccttctaagttgtacggacgtaagggttagttacggtttacgttttgggttacggttccgggacgggtacggtaaccgtaaggtccgttacgggtacccgttaccggttacgggtacccgtaacggtacccccggtaaacggggcccttacccgggccccccgggtttcggtccgttaaccccgg

SEQ ID NO: 35355 - DNA, 806 bp, Homo sapiens
  misc_feature: GYAE6OF01DG7QX.45.79.H02.1.454.CMB.1.raw
  modified_base (311)..(311): a, c, t, g, unknown or other
  misc_feature (311)..(311): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactatcctcactcaggacacaggatcgtgggccctttctcgccctgactcagcctgcctccgtgtctgggtctccgtggacagtcgatcaccatcggcctgcactggaaccaacagtgatggttgggtagtttttagtttgtctcgtggtaccaacaacgacccggacaaccgaccccaaatactctaatttanagggacacgtaagccggtcccgttggggtttacaaggttccgtctttcgtcgtcggcctaccgaagttcgtacggaccaaaccgtcccgggtccccttacccgtaggaaaccctaacttcccgtaccggttcggggaccctacccggtaacgggccttaccggaacggggtaacccggtaacgggttcccgttaaggtttaacgttttaacgtttttccgttacggtttcgtaccgtttacgtaacgtttaacggtacgtaccgggtaacgggtaaccccgtaggtacccgttaacgggttttcggggttacgggtttcccggggaaccgggggtaaccgggtacccggttaagggtttccggtaccccggttaccgttaacgggttaccgaccggtaccccgaacgggtcccgtacccggtcccccggttcggttaccctacccgttccgtttccccgtaccccctaccccgttcccttcccgtcggtaccccg

SEQ ID NO: 35356 - DNA, 518 bp, Homo sapiens
  misc_feature: GYAE6OF01EXKZK.45.79.H02.1.454.CMB.1.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcaccaggcaaacgcccccaaatcatgatttangaggcagtagcgcctgagggtttcaatcgcttctctggctcagtctggcacacgcctcctgacatctctcggctcgaggctgaggacgaggctagtatttatactgctgctcatagtgacgagggaccagctagttgggtcgttcggcggacggaccgtagggttcgaccggtcgtaggccgacgcccgaacggtctccgcccccgtggtcctaccg

SEQ ID NO: 35357 - DNA, 603 bp, Homo sapiens
  misc_feature: GYAE6OF01ECNHY.45.79.H02.1.454.CMB.1.raw
  modified_base (305)..(305): a, c, t, g, unknown or other
  misc_feature (305)..(305): n is a, c, g, or t
  modified_base (438)..(438): a, c, t, g, unknown or other
  misc_feature (438)..(438): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccagcagtgattggttggattataaccttgtctcctggtaccaacagcacccaggcaaacgcccccaaatcatgatttangaggcaggtaagcgcctgagggtttcaatcgtcttctctggctcaagtctggacaacgaccgcctcctagaactatctcgtcggcctccgagcgtggaggacgagctagtatttacttacgtgcgtcgtactntatagtcgtagtaggggttagttaagtttcggttttgggttacgggttccgggtacgggtaacgggtaccgtaaacggtcgtacggtacccgttccggtaacggtccgaacggaccccgtaagggtccccttacccggtcccccgttccggtcccgttaacccgg

SEQ ID NO: 35358 - DNA, 628 bp, Homo sapiens
  misc_feature: GYAE6OF01CHA67.45.79.H02.1.454.CMB.1.raw
  modified_base (226)..(226): a, c, t, g, unknown or other
  misc_feature (226)..(226): n is a, c, g, or t
  modified_base (397)..(397): a, c, t, g, unknown or other
  misc_feature (397)..(397): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattataaccttgtctctggtaccaacagcaccaggcaacgccccaaactcatgattatgaggcagtaagccgcctcgagggtttctaatcgtcttctctcggtctccaagtctggacaacgacgccctcctagactaatcctacgtcggcctccgngctgacggacgaggtctgtatttattacgtcgtactgtcctagtatacgtggtacgtaacgggttaagttacggtttaacgtttcggggttgggttacccgggtacgggtaacgggaacccgtaaggtccggttaccggtaaccccgggttcgttaaccggggtccaacccgggaccccgtaaacgggtccccgttccccggtcccccggttcggttacccgttaccccgg

SEQ ID NO: 35359 - DNA, 540 bp, Homo sapiens
  misc_feature: GYAE6OF01C8G3Q.45.79.H02.1.454.CMB.1.raw
  modified_base (231)..(231): a, c, t, g, unknown or other
  misc_feature (231)..(231): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctccactcaggacacaggatcgtgggcccaggtctgccctgacctcagcctgcctccgtgtctgggtcctccgtggacagtcgatcaccatctcctgcactggaaccngcagtgatgttggagttataacttgtctctgtaccaacagcaccaggcaaacgccccaaatcatgattatgaggcagtaagcgcctcgagggttcatcgtcttctctgctcatcngcacncgctcctnacatctctcggctcgagctgaggacgagtctgtattatactgctgctacattagtcgtacgtaggttagttagtttacgtttgggtgttccgggacggacgggtaccaagtcgtagaacccggttccgtaacgggttccacggtacccgtaacggccgttacccgcccccgttcggtaccc

SEQ ID NO: 35360 - DNA, 554 bp, Homo sapiens
  misc_feature: GYAE6OF01EDDVI.45.79.H02.1.454.CMB.1.raw
  modified_base (307)..(307): a, c, t, g, unknown or other
  misc_feature (307)..(307): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttggattataaccttgtctcctggtaccaacagcacccaggacaaacgcccccaaatcatgtatttagnggagggcaggtaacgccggccctgtagggtttcaatcgcttctcgtgctcagtctgcacacgcctcctgacatctcgtcgggcctcgaggctaggacggacgaggctagtattatactgctgctgatagtgacgtaggttagttagttacgtttggtggttcgggacggtacggaccgaaggtcgtacggtaccgtaccggtggtaccgacgacccgtaggccctaccgcccccgttggtcctaccg

SEQ ID NO: 35361 - DNA, 528 bp, Homo sapiens
  misc_feature: GYAE6OF01EKRIP.45.79.H02.1.454.CMB.1.raw
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (368)..(368): a, c, t, g, unknown or other
  misc_feature (368)..(368): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaatcatgatttangagggcagtaagcgccctnagggtttcaatcgcttctctggctccaagtctggcaacacggcctccngacaatctctggctccgaggctgacggacgaggctgatttattactgctgctcatatgacaggttagtagttacgtttgggtgttcgggcggtagggaccaaggtctcggacccgttcgtggtccaggcccctaaggcctccggccccctggtctacccg

SEQ ID NO: 35362 - DNA, 556 bp, Homo sapiens
  misc_feature: GYAE6OF01DRMP9.45.79.H02.1.454.CMB.1.raw
  modified_base (338)..(338): a, c, t, g, unknown or other
  misc_feature (338)..(338): n is a, c, g, or t
  modified_base (370)..(370): a, c, t, g, unknown or other
  misc_feature (370)..(370): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggtgggattataaccttgtctctggtaccaacagcaccaggacaaacgcccccaaactcatgtatttatgatgtacagtaactcggccctcgtacgggtttcngattcgcttctctcggctccaagtctgcaacncggtccctccctagacctactccttccgtcgggcctccgaggtcgtaggacggacgaggtctgtatttattacgtgctagtctatagtatcggccacgcagctatcgtacttcgtaaggttcgtcgggacggacgggaccaacggtcgtacggtacccggttacgtaggtaccacgcccgtaacgg

SEQ ID NO: 35363 - DNA, 556 bp, Homo sapiens
  misc_feature: GYAE6OF01BR7P0.45.79.H02.1.454.CMB.1.raw
  modified_base (436)..(436): a, c, t, g, unknown or other
  misc_feature (436)..(436): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataacttgtctctggtaccaacagcaccagacaaacgcccccaaatcatgtatttatgaggcagtaagcgcctgtagggttctaagtcgcttctctggctcaagtctggacaacacgcctcctgaacactctcgtcgggcctccgacggtctaggagggacgaggctagtatttacttacgtgctgcttanatgtgacgtaggtagttacgttagtttgggtacgttcgggacggtacggaccgaagtcgtacggtacccgtcgtacggtcgaccgacccgacggtcctaccgcccccgtggtcctacccg

SEQ ID NO: 35364 - DNA, 574 bp, Homo sapiens
  misc_feature: GYAE6OF01CCZ1O.45.79.H02.1.454.CMB.1.raw
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (434)..(434): a, c, t, g, unknown or other
  misc_feature (434)..(434): n is a, c, g, or t
tcagacgcgatcgacacgaccggtgctcgatttagtgtcacacgaagggaaagggggggtcacaagaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttacttgtttttaagatgtctccgtggtatcagcaacaccaggaccaaacgtccccaaactcatacatttatgatgtacaataacgtccggaccctcgaaggggtttcaatcgcttctctggctcaagtctaggctaacncggcctccagacaatcncgtggctcgaggctggacggacgagcgtagtattagttactntctgctacgatatgactaggtagtagttacgtttgggtgttcgggacggtaacggacgaagtccgtacggacccgttcgtacggtcaacgacccgaaggtccctccggaccccgttcggtacctaccgttcgttaccccg

SEQ ID NO: 35365 - DNA, 558 bp, Homo sapiens
  misc_feature: GYAE6OF01C1KBX.45.79.H02.1.454.CMB.1.raw
  modified_base (376)..(376): a, c, t, g, unknown or other
  misc_feature (376)..(376): n is a, c, g, or t
  modified_base (433)..(433): a, c, t, g, unknown or other
  misc_feature (433)..(433): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggtattttagtttgtctctggtaccaacaacacccggacgaacgcccccaaaactaatctaatttaatagggacactaagccggccctcgaggggtttctaagtcgtcttctctgctccagtctgcaacacgctccngacatctcgtggcctccgaggctggacggacgaggctgtattattacgtgctgctanattatgcgtagttagtagttacgttttggtgttcggcggtaggactagcgtcgtaccgtcgtaggtcgacgtccgaaggcctcgccccgttcggtcctacttcgtccgttccccgtcccttcccg

SEQ ID NO: 35366 - DNA, 556 bp, Homo sapiens
  misc_feature: GYAE6OF01DE1QX.45.79.H02.1.454.CMB.1.raw
  modified_base (299)..(299): a, c, t, g, unknown or other
  misc_feature (299)..(299): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctgtaccaacagcaccaggcaaagcccccaaactcatgatttangaggcagtaagcgccctgtagggttctaatcgcttctcgtgctccaagtctggccaacgaccgcctcctgactaatctacgtgggcctccgaggctggaggacgagtctagtattattacgtgtctgctactatatgacgtaaggttagttagttacgtttgggtggttcgggacggtagggaccctaaggccgtaggacccgttcgtacggtccgacggaccctaagggccctccggcccccgttggtcctacccg

SEQ ID NO: 35367 - DNA, 717 bp, Homo sapiens
  misc_feature: GYAE6OF01DQJGZ.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctctgacagtcgatcaccatctcctgcactggaaccagcagtgatggttggattataaccttgtctcctgtaccaacagcaccagcaaacgcccccaaactcatgtatttatggaggactaaggtaacggccggaccctgtacgggtttctaacgtcgtcttcgtcgtggtcctaccgaagtcctcggaccaacgaccggtcccttaccccgtacggacctaacgttccgtaccgtcgggtacccgtaccgtacggtaccgttacggaacgggaaccggtaacggtccgttaggtaacttttaacgtttaccgtacgtaccgttcgtccttacgtaagttacgtacggtaccgtaagggttacgttacggtttaacgttttggggttacggtttaccggggacgggtaacgggtaacccgtaaagggtacccgttacgggtaccccgttaccggtaccggttaccgaccggtacccccgtaaagggtccccgttacccggtcccccccgttcgggtaccccgtttaccccg

SEQ ID NO: 35368 - DNA, 535 bp, Homo sapiens
  misc_feature: GYAE6OF01ATTQO.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaactcatgattatgaggcagtaagcgccctcgaggggtttcaatcgcttctctggctcagtctggcaacacgcctccctgacatctctggctccgaggctgaggacaggctgattattactgctgctcgatatgctaggtagttagttactttgggtcgttcggcggtaacgggaccaaggtcgtacgtacccggtcgtacggtaccacgacccgtaaggccgtaccgccccccgtggtccctaccg

SEQ ID NO: 35369 - DNA, 562 bp, Homo sapiens
  misc_feature: GYAE6OF01EKRQ5.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggccaaacgccccccaaaactcatgatttatgagggcagtaagcggccctgagggtttctaatcgcttctctggctccaagtctggcaacacggccctccctgacaatctcgtcgggtctccgaggctggaggacgaggctgatttattactgctgctcatagtgctagggttagttagttacgtttgggtggttcgggcgggaacgggaccaaggtccgtacggacccggttcgtaggtccaacgccccgtaaggtcctcccggccccccgttggtccgtacccg

SEQ ID NO: 35370 - DNA, 664 bp, Homo sapiens
  misc_feature: GYAE6OF01B76AS.45.79.H02.1.454.CMB.1.raw
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctccngcacgtggaaccngcagtgagtgtaggattatacttntctctgtacaangcaccgagacaacgaccccaactcatgtattangaggcagtacgcgtccgtacgtagggttctaagtcgtcttcgtcgtcggctacgtaacgtcgtacggacaacgacccgtcctacccgtagaacctaacttccgtcgtcggtacctaccggacggtcgtacggaacggaaccgacgggtacttacgtaatttacgttacgtcgccgttacgtcctaacgtaagtacgtacgtacgtaagggttacgttaacgtttacggtttcgggttcggtaccggggtacgggtaacgggaccgttaacggtccgtaaccggtaacccgttaccggtacggttaccgaacccggtacccggtaacggtccccgttacccggtccccccgttgggtacccttaccccgg

SEQ ID NO: 35371 - DNA, 589 bp, Homo sapiens
  misc_feature: GYAE6OF01ACY6Q.45.79.H02.1.454.CMB.1.raw
  modified_base (316)..(316): a, c, t, g, unknown or other
  misc_feature (316)..(316): n is a, c, g, or t
  modified_base (356)..(356): a, c, t, g, unknown or other
  misc_feature (356)..(356): n is a, c, g, or t
  modified_base (442)..(442): a, c, t, g, unknown or other
  misc_feature (442)..(442): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcggcctgcacgtggaaccaacagtgatggtttagggtatttttagttttgtctcctggtaaccaacaaccaccccggacgaacgaccccaaaactaactcatttanaggacactagcggcccgtcggggtttcaagtcgtcttctntggcctcaagtctggacaacgcgcctcctagacaatctcgtcggctcaggctggacggacgaggctagtattattactgtctgctnatatgcgtaaggttagtagttacgtttgggtagtcgggacggtagggaacctaggctacgacccgttcgtacggtaccacgtacccgaggtcctcccggtcccccgtcgtccaccgttccgttacgtccccctccctcgtcgtaccg

SEQ ID NO: 35372 - DNA, 518 bp, Homo sapiens
  misc_feature: GYAE6OF01BGH7O.45.79.H02.1.454.CMB.1.raw
  modified_base (226)..(226): a, c, t, g, unknown or other
  misc_feature (226)..(226): n is a, c, g, or t
  modified_base (323)..(323): a, c, t, g, unknown or other
  misc_feature (323)..(323): n is a, c, g, or t
  modified_base (426)..(426): a, c, t, g, unknown or other
  misc_feature (426)..(426): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattataaccttgtctcctggtaccaacagcacccaggcaaagcccccaaaactcatgatttatgagggcagtaagcgccctnaggggtttctaatcgcttctctggctccaagtctggcaacacggcctccctgacaatctctgggctccaggctgaggacgaggctgatttattactgctgctnatatgctaggtagttagttactttggtgttcggcggtagggaccagctggaccgtcctaggtcagcccaaggctcgccccctggtctacccg

SEQ ID NO: 35373 - DNA, 549 bp, Homo sapiens
  misc_feature: GYAE6OF01BCIXC.45.79.H02.1.454.CMB.1.raw
  modified_base (361)..(361): a, c, t, g, unknown or other
  misc_feature (361)..(361): n is a, c, g, or t
  modified_base (424)..(424): a, c, t, g, unknown or other
  misc_feature (424)..(424): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaacgcccccaaactcatgatttatgaggcagtaagccggccctcgagggtttctaatcgcttctctgctcagtctggcacncgcctcctgacatctcgtggctccgaggctggacggacgaggctgtatttattactgctgctnatagtgcgtaggttagttagttacgtttggtgttccgggcggaacgggacctaaggccgtacggtacccgtccgtaggtccacggtacccgtaacggcctaccggcccccgtcggtccgtacccg

SEQ ID NO: 35374 - DNA, 536 bp, Homo sapiens
  misc_feature: GYAE6OF01A2IJF.45.79.H02.1.454.CMB.1.raw
  modified_base (301)..(301): a, c, t, g, unknown or other
  misc_feature (301)..(301): n is a, c, g, or t
  modified_base (376)..(376): a, c, t, g, unknown or other
  misc_feature (376)..(376): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggtattttagtttgtctcctggtaccaacaacacccggcgaacgcccccaaataatcatttanaggacactaagcggcctggggttcaagtcgcttctctggctccaagtctgcaacacggcctcctgacaatctcgnggctcgagctgaggacgaggctgattatactgctgctanatangactaggtagttagttacgtttggtggttcgggcggtagggaccaaggtctcgaccgtcgtaggcacgcccgaggctccgccccgtgtccacttcgtcgttccccgccctccgtccg

SEQ ID NO: 35375 - DNA, 534 bp, Homo sapiens
  misc_feature: GYAE6OF01EN6D2.45.79.H02.1.454.CMB.1.raw
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccagcagtgatgttgggattataaccttgtctctggtaccaacagcaccaggcaaagcccccaaactcatgatttangagggcagtaagcgcctgagggtttctaatcgcttctctggctcaagtctggcaacacggcctccngacatctctgggctccaggctgacggacgaggctgattattactgtctgctnatntgcaggtagtagttagtttggtgttcgggcggtacggtaccaaggtccgtcggacccgtccgtagggtccacggaccccgtaaggtccctacggccccccgttggtcctacccg

SEQ ID NO: 35376 - DNA, 524 bp, Homo sapiens
  misc_feature: GYAE6OF01A0VB3.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcgaggggtttctaatcgcttctctggctccaagtctggcaacacggcctccctgacaatctctgggctccaggctgaggacgaggctgattatactgctgctcatatgcaggtagtagttactttggtgttcggcggtagggaccaaggcgtcgaccgtccgtaggtccagcccgtaaggcctcgccccctggtcctacccg

SEQ ID NO: 35377 - DNA, 599 bp, Homo sapiens
  misc_feature: GYAE6OF01DNK21.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaacccagcagtgatggtggattataaccttgtctcctggtaccaacagcaccaggcaaacgcccccaaactcatgatttatggaggcagtaagccggccctacgagggttctaatcgtcttctctggtcctaccgaagtctaggacaaccgacggccctccgtgacctaatcctcgtcgggcctccgaggcgtgacgggacgaagggtctagtatttacttacgtgcgtgacctatatatgtacgtacgggttagttagttacgttttgggttacggtttcgggaccgggtagggtacccgaggtacgtacggtacccggttcgtacggtaccgacggacccgtaacggccgttccgccccccgttggtccctacccg

SEQ ID NO: 35378 - DNA, 550 bp, Homo sapiens
  misc_feature: GYAE6OF01D8NFY.45.79.H02.1.454.CMB.1.raw
  modified_base (311)..(311): a, c, t, g, unknown or other
  misc_feature (311)..(311): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggattataaccttgtctcctggtaccaacagccaccgagacaaacgcccccaaactcatgtatttatgaggnagtaacgcggccctagtagggtttactaatcgctttctcgtggctcgaagtctcggacaacgacggccctccgtgacaactctcgtggtcctcgacggctgaggacggtagctagattatcgtnctgctcatntgactaggtagttagtcgtttggtgttcggacggtacggaccgagtccgtcggtaccgtacgtaggcgacgcccgtaacgccgtcccgcccccgtggtcctacccg

SEQ ID NO: 35379 - DNA, 609 bp, Homo sapiens
  misc_feature: GYAE6OF01DLIRZ.45.79.H02.1.454.CMB.1.raw
  modified_base (121)..(121): a, c, t, g, unknown or other
  misc_feature (121)..(121): n is a, c, g, or t
  modified_base (170)..(170): a, c, t, g, unknown or other
  misc_feature (170)..(170): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
tcagacgcgatcgacacgaccggtgctcgatttagtgtcacacgaagggaagggggggtcgacaagaggcagcgcctcgtcgggacgtctccaccagtggcctgggctctggctgctcctnactctcctcactcaggacacagggtcctgggcccagtctgccctgactnagcctgcctcgtgtctggtctctggacagtcatcacntcgtcngcactggaaccagcagtnatgttgggattatacttgtctctgtacanagcaccagcaacgacccaactcatgtattagtgaggacgagtaacgccgtcctcgtagggttctaactcgtcttctcgtggtcctacgtaagtctcggacaacgaccggtccctccgtacgactaactctcgtcggctccgaaggtcgtagacggacggacgtcgtagtacttaattacgtgtctcgtctctagtgagtacgaggttaagttacgttaacgttttggttcgggttacgggtgggtaaccgggaccgtaacggtaccggtacggtacccgttaccggtacggttccgacggtaccccgaacggtcccgtcccgtacccccggttccgtccgttaccccgg

SEQ ID NO: 35380 - DNA, 589 bp, Homo sapiens
  misc_feature: GYAE6OF01AH81H.45.79.H02.1.454.CMB.1.raw
  modified_base (303)..(303): a, c, t, g, unknown or other
  misc_feature (303)..(303): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggagttataaccttgtctcctggtaccaacagcacccaggcaaacgcccccaaactcatgattangaggcagtaagcgccctgtagggtttctaatcgcttctctggctaccaagtctggcaacgcgcctcctgacatctcgtggctccgagtctggacggacgaggtctagtattatacgtgcctgctctatatcgtagtagggttagttacgttacgttttgggtcggttcgggacgggtacgggaaccgtaacggtccgtacggtaccccggttaccgttacggtaccgaccggtaccccgtaacgggtcccttaccccgggtccccccgttgggtaccctaccccgg

SEQ ID NO: 35381 - DNA, 576 bp, Homo sapiens
  misc_feature: GYAE6OF01EFU4F.45.79.H02.1.454.CMB.1.raw
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
tcagacgcgatcgacacgaccggtgctcgatttagtgtcacacgaagggaaagggggggtcgacaagaggcagcgctctcgggacggtctccaccatggcctgggctctgctgctcctccactctcctcactcaggacacagggtcctgggcccagtctgccctgactcagcctgcctccgtgtctgggtctcctggacagtcgatcaccatctcctgcactggaaccagcagtgatgttggggagttataaccttgtctcctggtaccaacagcacccaggcaagccccccaaactcatgatttatagagggcagtaagcggccctcaggggtttctaatcgctctctggctctaatctgcacacggcctccctgacaactctctgggctcacgggctgnggacgaggcngtatttatcttgctnctcatattggctacgggtagttagttacgttttggtggtttccgggaggggaccgggtaccgaacgtcgtacggtacccggttaccttcggggtacctacggacccccgtaagggccccgttcggcccccccttccggttccgtaacccc

SEQ ID NO: 35382 - DNA, 622 bp, Homo sapiens
  misc_feature: GYAE6OF01AU73B.45.79.H02.1.454.CMB.1.raw
  modified_base (300)..(300): a, c, t, g, unknown or other
  misc_feature (300)..(300): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatggcctgcactggaaccaacagtgatgttgggtattttagtttgtctctggtaccaacaacacccggcgaacgccccaaataactcatttanacggtacactaagcggccgtggggttcaagtcgcttctctgactccaagtcctaggccaacgaccggcctcccgtagactaatctcgtacgggtcctaccgaggtcctacgacggtacggaaggtccgtagtaactttactttcgtgtttacgtcttacgtattacgtcgacgacgggacctagtaccgtacgttcgggtacgttcgggacgggtacgggtaccgtagggttcgaccgtcgtacggtaccacgtaccgtaacggctaccggccccgtcggtacctaccttccgtccttaccccaccctcctcctcggtaccg

SEQ ID NO: 35383 - DNA, 660 bp, Homo sapiens
  misc_feature: GYAE6OF01DMRH8.45.79.H02.1.454.CMB.1.raw
  modified_base (265)..(265): a, c, t, g, unknown or other
  misc_feature (265)..(265): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggattataccttgtctctgtaccaangacaccgagacaacgaccccaaactcatgtatttagtggacggacaaggtaacgccggtcccttcggtacggggtttactaacgtcgtcttctcgtcggtcctaccgtaagtccgtacggacctaaccgacccggtaccctcccgtacgaacctaacttccgtccgtacgggtcctaccggtaaggtcgtacggaacgggtacggacgggtccttagtacgttttactttacgttgtttcgtccttactacttagtcgacgttaggttaagttacgtttacgtttgggttacggttcgggacgggtacggaccgtaacggtcgtacggtacccgttcggtacggtccgaccgtacccgacggtcctcccggccccgttcggtcctaccgttcccg

SEQ ID NO: 35384 - DNA, 603 bp, Homo sapiens
  misc_feature: GYAE6OF01CVKG0.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagccacccaggacaacgcccccaaatcatgatttatgaggcagtaacgcgccctgacgggttcaatcgcttctctggctacaagtctggcaacgacgtcctccgtgaactaactcctcgtacgggtccttccgaggtctaggacgggtacgaggccgtgtaactttattactgtctagctacagtaactggtactaagggttagttagttcgtttggtgggttacggaccggggtacgggtaccgtaaggccgtaccggtacccgttcgtaacgggttcccgaacggacccgtaacgggtaccgttcccggcccccgttgggtccccttaacccg

SEQ ID NO: 35385 - DNA, 721 bp, Homo sapiens
  misc_feature: GYAE6OF01DOOPE.45.79.H02.1.454.CMB.1.raw
  modified_base (268)..(268): a, c, t, g, unknown or other
  misc_feature (268)..(268): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcacatctcctgcactggaaccagcagtgatggttgggattataaccttgtctcctaggtaccaacngcaccaggcaaacgccccaaactcatacgtattatgaggacagtaagcgtcctgtagggttcaacgtcgtacttcgtctcggcctactaagtctaggacaacgtacggccctcctgactaactcgtccgtcgggactccgaggtcgtggaacgggacgacggtcgtacggtaatttacgtttcgttcggtttacgtccttacgttaattaacggttacggaccggtaacggggtaacccgtacggggttaccgttaaaccgggttttcgggggtttccgggttaccggggtaccggggtaacggggtaaccccgttagggggttttacccggtacccgggtttaacccgttacggggtttcccaaacccggggtaccccgtaaacggggtaccccgtttaccccgggttacccccccggtttacgggtttccccgtaacccgttttcccccgg

SEQ ID NO: 35386 - DNA, 542 bp, Homo sapiens
  misc_feature: GYAE6OF01EDZUR.45.79.H02.1.454.CMB.1.raw
  modified_base (319)..(319): a, c, t, g, unknown or other
  misc_feature (319)..(319): n is a, c, g, or t
  modified_base (461)..(461): a, c, t, g, unknown or other
  misc_feature (461)..(461): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggagttataaccttgtctcctggtaccaacagcaccaggcaaagcccccaaatcatgatttatgaggcagtaagcggcctnaggggtttcaatcgcttctctggctcaagtctggcaacacggcctccctgacaatctctgggctccaggtctgaggacgaggcctgtatttattacgtgctgctcatatgcgtaggtagttagttactttgggtgttcgggnggagggaccaaaggtccgtcggacccgttcgtagggtccaggccccgtaaagggccctacgccccccgttgtcctaacccg

SEQ ID NO: 35387 - DNA, 735 bp, Homo sapiens
  misc_feature: GYAE6OF01E6ERM.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctcgccctgactcagcctgcctcgtgtcgtgggtctccgtggacagtcgatccacctatcctcctgccacgtacggaaccagcgtagtgagttgggttaggtaatttactaccttcgttcctcgtacggtaaccaacgacgacccacccgaggacccaaaccgaccccctaatcagtgtaatttacggaggacggacgtaaggtaccggtccggtcccgttagggttacgggtttacctacgttccgtccgtttcgtcgtcgtaccctaccgtaacggtcgaccggaaccaaccgtcccgtcccttacgacgtacctacgttccgtcggtccggtactaccggaggtcgtacgggaacggtaccggaggttactagttacttacgttccgcgtctcgtactacgtagtcggtacggtaccggtttaagggttacggtttcggtttacgggttgggtaccggggtacggaaccgggtacggtaccgtaacgtccggtacccggttacgaccggttaccggaccgtacccggtcccggtacggtccccgttaccccgtccccggtccgtaaccttccccgg

SEQ ID NO: 35388 - DNA, 556 bp, Homo sapiens
  misc_feature: GYAE6OF01A7YOY.45.79.H02.1.454.CMB.1.raw
  modified_base (360)..(360): a, c, t, g, unknown or other
  misc_feature (360)..(360): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattataccttgtctcctgtaccaacagcaccaggacaaacgcccccaaactcatgatttatgaggcagtaacgcgccctcgtagggtttctaatcgcttctcgtggctcaagtctgcaacncggccctcctgaacactctctcgggctccgaggctaggacggacgaggctagtacttattaccgtgctgtctacgtatacgtgacgtagggtagttagtttacgtttgggtcgttccgggacggtacgggacctagcgtacgaccgttcgtaggtccacggaccgaaggtcctaccggcccccgttcgtctacccg

SEQ ID NO: 35389 - DNA, 777 bp, Homo sapiens
  misc_feature: GYAE6OF01DGVGK.45.79.H02.1.454.CMB.1.raw
  modified_base (233)..(233): a, c, t, g, unknown or other
  misc_feature (233)..(233): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcgtggacagtcgatcaccatctcctgcacgtacggaacccaagngtgtagttggttggggttattttttagtttcgtcctccgttaggtaacccaaactaaccgaccccggacgaaaccgaccccctaaaatactctaagtttagaacggacctaacgtacgccggtcccggttacggggtttacaacgtccgtctttccgtcgtcggctaccgaagtcgtacggaccaaaccgccggtcccttcccgtagaaccctaagttccgtacgttcgggccttaccgacgggtctacggaacggtaccggtaacggtccgtttaagtacgttttacgtttcgttacgtttacgtacttaccgtagttaacgtcgtacggaacgggtaaccctaggtaccgttaacgggtttcgggtttacgggttaccgggacggggtaaccgggttacccggttagggttacccggtacccggttaccggttacgggtaccgtaccggtaccggtaacggtcccgtaccccgttccccggttccggtaccctcgttccccgttacccttacccccgacccttccgttcccgtccgttaccg

SEQ ID NO: 35390 - DNA, 694 bp, Homo sapiens
  misc_feature: GYAE6OF01DK6RV.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtcctctggacagtcgatcacatctcctgcactggaaccagcagtgatggttggattataccttgtctctgtaccacagccaccagacaaccgaccccaaactcatagtatttagtaggagggtacaacggtaacggccgtcccgttacggtacggggtttactaacgttccgtccttcgtcgtcggtcctaccgtaagtcgtacggaccaaccgacccggtccctccgtacgaaccgtacttccgtcgtccggccttacccgaggtccgtagggtaacggacggacggtaccttaggtaacttttacgttacgtgtaccgttcgtacctacgtaagttagtcggtacggttagggttaaggtttacgttttacgggtttgggtttcggttccggggaacgggtaacggtaccgaacggttccgttaccggtacccgttacggttcggacccgaccggtaaccccgtaacggtcccgttcccggtacccccgttcggtccgtaccccg

SEQ ID NO: 35391 - DNA, 529 bp, Homo sapiens
  misc_feature: GYAE6OF01A5M3Y.45.79.H02.1.454.CMB.1.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (415)..(415): a, c, t, g, unknown or other
  misc_feature (415)..(415): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccngcagtgatggttggattataacttgctctggtaccaanancaccagcaaagcccccaaatcatgatttangaggtcagtaacgcgccctcgtagggtttactaagtccgtcttctctggctccaagtctgccaacncggcctcctnactatctcgtggctccgagctggagacgagctagattatacgtnctgctctatctgcgtaggtagttagttactttgggtcgttcggcgggtaggacctagtcgtcggtaccgtctaggtccgagacccgtaaggcctaccgccccgtgtccgtaccg

SEQ ID NO: 35392 - DNA, 784 bp, Homo sapiens
  misc_feature: GYAE6OF01DY7GS.45.79.H02.1.454.CMB.1.raw
  modified_base (229)..(229): a, c, t, g, unknown or other
  misc_feature (229)..(229): n is a, c, g, or t
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtcctcctggacagtcgatccaccatcctcctgcacgtggaaccngcagtgatggttggattactacttgtctctgaacangccaccgagacaacgccccaaatcatatattangaggcagacgcgtccctagtacgggtttacaactcgtctttcgtcgtacgcccttacgtaacggttcgtacgggacctaaacccggtccggtccccttacccgtacggtaacctaacttcccgttccggtaccgggtaaccctccggtaacgggccgttaacggggaaacgggtaccgacgggtacttaacggtttacgtttaaacgtttaccgcggttacccttacggtacccttacgtaaagttacgttacggtaaccggttaagggtttaaccggttttaacggtttaccgggtttttaacgggttccggggttaaccggggacggggggtaaaccggtaaaccccgttaagggtaccggttaaccccggtaacccggggttaccggtttaaccgggaccgttaccccggaaacccccggttacggttccccgttaccccccccgggtttcccggttaccccgggttccctttaaacccccgg

SEQ ID NO: 35393 - DNA, 563 bp, Homo sapiens
  misc_feature: GYAE6OF01BO622.45.79.H02.1.454.CMB.1.raw
  modified_base (305)..(305): a, c, t, g, unknown or other
  misc_feature (305)..(305): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataccttgtctcctggtaccaacagccaccaggcaaacgcccccaaactcatgtatttanggaggcagtaacgccggccctgtagggtttctaatcgtcttctctggctccgaagtctgacaacaccggcctcctgacaatctcgtgggcctccgaggctggacggacgaggctgtattagtactgtctgctcatgtgacgtaggtagtagtttacgtttgggtcgttcgggcggtaggaccaaggtcgtacggtacccggttccgtaggtaccgacggcccgaacggtcccgtccggtcccccgttggtcctacccg

SEQ ID NO: 35394 - DNA, 717 bp, Homo sapiens
  misc_feature: GYAE6OF01DINKI.45.79.H02.1.454.CMB.1.raw
  modified_base (311)..(311): a, c, t, g, unknown or other
  misc_feature (311)..(311): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatcaccatctcctgcactggaaccagcagtgatggttggagttataaccttgtctccgtggtaccaacagccaccacggacaaacgacccccaaatcatgtatttagnggacggcagtacgccgtcctacgtacgggttactagtcgtcttcgtcgtgacctccgaagtccgtcggaccaacgacccggtccctcccgtagaaccgaacttccgtcggtacgggtccctaccgtagggtccgtacggaacgggaccgtagggtccgttagtacgttttaaacgtttccgtacgtccgtttacgacctttaactaacgttacgtggtaccggttaagggtttaacggtttaggtttaacggtttttaggggttcggtttaccggggaccgggttaaccgggtaaaccgtaacggtccgttacggtaaccccggtttccggtaacggggttcccaaccgggtaccccgtaaccgggtcccttccccggtacccccgtttcgggacccttaccccgg

SEQ ID NO: 35395 - DNA, 560 bp, Homo sapiens
  misc_feature: GYAE6OF01AKGYZ.45.79.H02.1.454.CMB.1.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
  modified_base (529)..(529): a, c, t, g, unknown or other
  misc_feature (529)..(529): n is a, c, g, or t
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (553)..(556): a, c, t, g, unknown or other
  misc_feature (553)..(556): n is a, c, g, or t
  modified_base (558)..(558): a, c, t, g, unknown or other
  misc_feature (558)..(558): n is a, c, g, or t
tcagacgcgatcgacacgaccggtgctcgatttagtgtcacacgaagggaaagggagctggatccggcagccccagggaagggactggagtggattgggtatagtctattacagtgggagcaccaacgtacaaccctccgtcaagacgtcgagtcaccatatcagtagacacgtccaagaaccagttctccctgaagctgagctctgtcgaccgctgcgacncggccaaatnttactgtgcaaagacggaggcctggaaatttacgtccttcgaccgacgtcggccgtacggtaaccgtcgtcgtaccgtcgtcctcgcgccctccgaccgacggccncgtccgtcctcccgcgccncctcctcacgcgcaccgtcgtcggcacgcgccgccgtcgcgtcgcgtcggtacgaacggtaccgttaccgttccgtcgtaccgtccggtccgttcgtcggtacggtccggtcgtcgggacgaacggccgacgtacgtacgcgcgcgcgcgcgcgcgcgngcgcnctcgcgcncgcgcgngcgcgncngcgngcncnnnngngc

SEQ ID NO: 35396 - DNA, 568 bp, Homo sapiens
  misc_feature: GYAE6OF01A8IK0.45.79.H02.1.454.CMB.1.raw
tcagacgcgatcgacacgaccggtgctcgatttagtgtcacacgaatggaaaggggggggtcacaagaggcagcgctctcgggacgtctccaccatggcctgggctctgctgctcctcactctcctcactcagtacacagggtcctgggcccagtctgccctgactcagcctgcctccgtgtctgggtctcctggacagtcgatcaccatctcctgcactggaaccagcagtgatgttgggagttataaccttgtctcctggtaccaacagccacccaggaccaaacgcccccaaactcatgtatttatgaggacagtaagcggcctcgaggggtttctaactcgcttctcgtggctcaagtctaggcaaccgacggcctccctgacaatctcgtcggcctccgagcgtagaggacgacggctagtaagttacttacgtcgtctcgctacgaattatgacgtaggtagttacgttacgtttggtcggttcggcgggtacggtaaccgacgtcgtacgaccggtccgtaggtccacggtacccaaggccgtccgtcccccgtggtaccc

SEQ ID NO: 35397 - DNA, 836 bp, Homo sapiens
  misc_feature: GYAE6OF01AFCL3.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcacgtggaaccaacagtgagttggtttggggtagtttttagttttgtccttccgtaggtaacccaaaccgaacccgacccccgggaccgaaaccgaccccccaaaacgtcaagttagtaatttagtggaacgggtcaaggtaacggcccggtcccttacggtacggggttttactaacgttccgtcctttccgtcgtcggccttaccgtaaggttccgtacgggacccaaaccgtacccgggtccccttacccgtaggtaaaccctacgttccgttaccggtcgggtccctaccggacggtcctaccggaacggggtacggacgggtacttaggttacttttacgttttccgttgggtttacgtcctacgtaacttagtcggacggtaaccgggtaccgtacggtaccgttacgggtttcgggggttacgggttacccggggtacggggtaacggggtacccgttacggggttacccggtacccggttacccggttacgggttaccccgaaccgggtacccccggtaacgggtccccgttacccccgggttccccccggttccggttaccccgtaccctttcccgttacccccggtttccccccgtacccccgtttcccgg

SEQ ID NO: 35398 - DNA, 710 bp, Homo sapiens
  misc_feature: GYAE6OF01B1EEH.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccagcagtgatggttggattataaccttgtctctggtaccaacagcacccaggaccaaacgccccccaaactcatcgtatttagaggagggacaggtaacgccggtccctcggtacgggtttactaacgtcgtctttctcgtggtcctaccgaagtcgtacggaccaaccgacccggtccctacccgtagaacctaacttccgttaccgtcgggtaccctccggacgggtcgtacgggaacgggaccggtagggtaccgttagttaacgttttacgttacgtcgtcgttacggtccttaccgtaagttacgtacggtacggttaaggggttaagtttacgggtttacggttttggggttacgggttccggggacggggtaacgggaccgtaacgggtccgtaccggttacccgttaccggttacgggtacccgaccggaccccgtaacgggtcccgtacccggtccccccgttcggtccctaacccg

SEQ ID NO: 35399 - DNA, 577 bp, Homo sapiens
  misc_feature: GYAE6OF01B1AM7.45.79.H02.1.454.CMB.1.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattataaccttgtctcctggtaccaacagcacccaggcaaacgcccccaaactcatgatttangaggcagtaagcgcctcgtagggtttctaatcgcttctctgctccaagtctaggcaacgaccgccctcctgacaatctcgtgggtcctccgaggtctggacggacgaggctgtaatttacgtacgtgactgcttacatactgacgaagggttagtagtttacgtttggtcggttcgggacgggtacgggtaaccgtaggtccgtcggtacccgttcggttaggtacccgacggtaccccgaaggtcccgttaccggccccccgttcggtcctaccg

SEQ ID NO: 35400 - DNA, 738 bp, Homo sapiens
  misc_feature: GYAE6OF01E2MQK.45.79.H02.1.454.CMB.1.raw
  modified_base (228)..(228): a, c, t, g, unknown or other
  misc_feature (228)..(228): n is a, c, g, or t
  modified_base (326)..(326): a, c, t, g, unknown or other
  misc_feature (326)..(326): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctctgcactcggaaccngcagtgagtggttgggaatttactaccttgtcctccgtacggtaaccaacacgccaacccgaggaccaaaccgaccccccaaactcatagtatttagnggagggacaaggtaacgccggtcccgttagtacggggtttactaagtccgtcttcgtacgtcggccttaccgtaagttcgtacggaccaaccgaccggtcccctacccgtgtaacctaacttccgtcgtcggtcctaccgaggtccgtagggaacgggacggtaggtaccgttaggttaactttacgtttaccgtgtaccgttagtaccttacgtagttacgtacggtacgttaagggtttaagtttacgggtttacggttttacgggttacgggtttacgggaacgggtaacccgggtaaccgtaacgggtccggttaccggtacccggttaccggttaacggtacccgtaacgtacccccgggtaacggtccccgtaccccggtcccccggttccggtcccgttacccgg

SEQ ID NO: 35401 - DNA, 699 bp, Homo sapiens
  misc_feature: GYAE6OF01EKI1Q.45.79.H02.1.454.CMB.1.raw
  modified_base (275)..(275): a, c, t, g, unknown or other
  misc_feature (275)..(275): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgccactgaaccagcctaggtgattggtaggtattaacttacttgtcctcgtcgaacaacngaccaccgagacaacccgaccccaaaactcattagtagtaattttaggacgtccgtaaggtacggtaccgtccgttacggttacggaacgttcttaacgtccgtacttcctcgtacgtcctacgaacgtccgacggaccctaccgtaccggtaccctaccgtactaaccgtacgttcctacgggtcggcctacgggacggtacgtagggtacggtcgaaacggttctaggttactttacgtacccgtgtacgtacgtccgttacgtaaggttacgtacggtaccgttaagggtttaacggtttacggttacggtttcggggtaccgggttaccgggacgggtaccggtaaacccgtacgtccgtacggacccgtccgtacggccgtccgacccgtacgtcccgtcccgttccccgtcgttcccg

SEQ ID NO: 35402 - DNA, 593 bp, Homo sapiens
  misc_feature: GYAE6OF01BRQYS.45.79.H02.1.454.CMB.1.raw
  modified_base (227)..(227): a, c, t, g, unknown or other
  misc_feature (227)..(227): n is a, c, g, or t
  modified_base (375)..(375): a, c, t, g, unknown or other
  misc_feature (375)..(375): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattgttggtagttttagtttgtctcctggtaccaacaaccacccggcgaacgacccccaaataactctaattatacggacacgtaacgcggtcccgtcgggggtttacaagtcgcttctactggctccgaagtctgacaacncgcctcctgacaatctcgtcggctccgagtctgacggacgaggctagtattagtactgctgctacattagtgacgtaggtagtagttacgtttagggtcggtcgggtacggacgggtaaccaaggtctaggacccgtcgtacggtcgacgcccgtaaggccgtccggcccccgttacggtacctaccgttcgtcccgtaccccgtccctccgttcccg

SEQ ID NO: 35403 - DNA, 749 bp, Homo sapiens
  misc_feature: GYAE6OF01BEBR9.45.79.H02.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctctggacngtcgatcaccatctcctgcactggaaccngcagtgatggttggattatacttgtctctgtacangcaccagacaacgccccaactcatagtattagtgaggcagtaacgcgcctcgtagggtttcaactcgtcttctcgtcggctaccgtaacgtcgtacggacaaccgaccgtcccttaccgtacgtaacctaacgttccgtacgtcggggtaccttaccgaagggtccgttagggaacggtacggtaacgggtaccgttacgttaacgttttaactttaaccggttcgtaccgttacggtaccttaaccgttaacgttaacgttacgggtaaccgttaacggggtttaacggtttaacggtttaccggtttttacggggtttacgggttacccggggtacggggtaacggggtaaacccgttaaacggtcccgggttaaccgggttaaccccggttccggtttaaacgggtaccccgttaaccggaaccccggttaaacgggttcccgttacccccgggttccccccggttacggttccccgttaaccccgg

SEQ ID NO: 35404 - DNA, 541 bp, Homo sapiens
  misc_feature: GYAE6OF01EKNY2.45.79.H02.1.454.CMB.1.raw
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctctggtaccaacagcaccaggcaaagcccccaaatcatcgatttatgaggcagtaacgcggccctnagggtttctaatcgcttctctggctcaagtctggcaacncggcctcctgacaatctctgggctcgagctgaggtacgaggctgtatttacttacgtgtctgctctatagtgtacgtaggtagttagttactttgggtcgttacgggcggtagggaccgaagtcgtcggaccgtcgtacggtcacgacccgaaggtcctaccgcccccgtggtccgtaccg

SEQ ID NO: 35405 - DNA, 556 bp, Homo sapiens
  misc_feature: GYAE6OF01EZ4ZU.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggattataaccttgtctcctggtaccaacagcaccaggcaaacgcccccaaactcatgatttatgagggcagtaagcggccctgtagggttctaatcgcttctctggctcagtctggcacacggcctccctgacaatctcgtcgggcctccgaggctggacggacgaggctgtattacttactgctgctcatatgacgtaggttagtagtttacgtttgggtgttcgggacggtagggtaccgaagtcgtcggacccgttcgtacggcctacggaccccgtaagggtccctaccggtcccccgttggtcctacccg

SEQ ID NO: 35406 - DNA, 587 bp, Homo sapiens
  misc_feature: GYAE6OF01CY1W6.45.79.H02.1.454.CMB.1.raw
  modified_base (139)..(139): a, c, t, g, unknown or other
  misc_feature (139)..(139): n is a, c, g, or t
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (437)..(437): a, c, t, g, unknown or other
  misc_feature (437)..(437): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgngggtcctgggcccagtctgccctgactcagcctgcctcgtgtctggtcctctggacngtcgatcaccntctcctgcactggaaccngcagtgatggttggattatacttgtctctgtaccanagcaccaggacaacgccccaaancatgtattanggaggnagtaacncggtaccctgtagggttactaagtcgtacttctcgtacggtcctaccgtaagtcgtcggacaacgaccgtcctcctgaactactctcgtcggctccgagtcgagtacggacgaggtctagtattactcgngtacagtctacgtaagtctcggacaccgagacgtactacgttccgacttaccgttaagtacggttaccgggaagggtaaccggtacccaacggtccgtaccgtacccggtaccgtacggacctaccggacccgtaaggccccttacccgg

SEQ ID NO: 35407 - DNA, 559 bp, Homo sapiens
  misc_feature: GYAE6OF01BI1O7.45.79.H02.1.454.CMB.1.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggggattataaccttgtctctggtaccaacagcacccaggccaaagccccccaaatcatgatttanggagggcagtaagcggccctgagggttctaatcgtcttctcgtggctccaagtctggcaacncggcctccngactatctcgtgggcctccgaggctaggacggacgaggtctagaatttatactgctgctcatactgactagggtagttacgttacgtttgggtcgttcgggacgggtacgggaccaaggtccgtggtacccggtcgtaggtcaacggtccccgaaggtcctaccgccccccgttggtcctacccg

SEQ ID NO: 35408 - DNA, 704 bp, Homo sapiens
  misc_feature: GYAE6OF01BUKK7.45.79.H02.1.454.CMB.1.raw
  modified_base (228)..(228): a, c, t, g, unknown or other
  misc_feature (228)..(228): n is a, c, g, or t
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgtcctgactcagcctgcctccgtgtctgggtctccgtggacagtcgatcaccatctcctgcactggaaccngcagtgatggttggattatacttgtctctgaccanagcaccagcaaacgccccaaactcatgtactttagngacggcaagtaacgccggtccctacgtacggggtttactaacgtcgtacttcttacgtggtcctaccgtaagtccttcggaccaaaccgtccggtcccctacccgtacgaactaactccgtcgtcggactccgaggctaggacggaccggtaggcctaggttaactttacgttctacgcgttcgtactaccgtatacgtcggtaccggttaagggttaacgtttaacggtttacggtttttcgggtacggggtttccgggtaaccgggggtaacgggtaccccgttaaagggtcccgtaccgggtaaccccggttacccggtaacgggttacccgaaccgggtacccccggtaaacgggtcccccttacccgggtcccccccgttacgggttcccgttaccccgg

SEQ ID NO: 35409 - DNA, 728 bp, Homo sapiens
  misc_feature: GYAE6OF01BBQB6.45.79.H02.1.454.CMB.1.raw
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggagttatacttgtctctgtacanagcaccagacaacgccccaaactcatgtattanggaggcagtaacgccggtcctcgtagggttactaatcgtcttctcgtcgtcctaccgtaagtcgtcggtacaaccgtaccggcccttaccctagaacctaacgttccgttaccgtcgggtcctaccgacgggtacttacgggaacggtaacggtaacggtcgttagttaactttaacgtttacgtcgttccgttacggaccttaccgtaagttacgttacggtacgttaaacggggtttaacggtttaacggtttacgggtttttacggggtttacgggttaccggggtaccggggtaaccggggtaaccgtaaacggggtcccgttacgggtaccccggtttaccggttaacgggttacccgaaccggtaccccgtaaacgggtcccgttaacccccgggtccccccgttaccggggttacccttaccccggg

SEQ ID NO: 35410 - DNA, 596 bp, Homo sapiens
  misc_feature: GYAE6OF01CEMEV.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggattataaccttgtctcctggtaccaacagcacccaggcaaacgcccccaaatcatcgatttatgaggcagtaagcggccctcgtaggggtttctaatcgtcttctctggctccaagtctggactaagaccggtcctcctagacctatctcgtcgggctccgaggtctagaacgacgaggcttagatttattacgtgctacgactacattaattacgttagttcgttacctagtcgtattacgttcgggaccggtaggacccgtaagttccggtaacccgttccggtaacggtccaccggacccgtaaacggtccgttacccgggacccccttccgggttccctaccgtttccccgg

SEQ ID NO: 35411 - DNA, 547 bp, Homo sapiens
  misc_feature: GYAE6OF01B5FX3.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaaaagcaccaggcaaagccccaaactcatgatttatgaggcagtaagcggccctcaggggtttctaatcgcttctctggctcaagtctggcaacacgcctcctgacatctctggctcgaggctgaggacgaggctgattattactgctgctcatatgactaggtagttagttacgtttggtggttcggcgggtacgggaccgtaagtcgtcggacccggttacctagggtccacggaccccaaggccgtaccggccccccgttcgggtccctaccgttcccgg

SEQ ID NO: 35412 - DNA, 583 bp, Homo sapiens
  misc_feature: GYAE6OF01DN23T.45.79.H02.1.454.CMB.1.raw
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctccgtggtaccaacagcacccaggacaaacgcccccaaactcatgtatttatgaggcaagtaacgcggccctgtacgggttctaacgtcgtcttctcgtcgctaccgaagtctaggacaacgcggtccctccctagactaactctcgtcggcctccgaggtcctcgaggacgaggcttagtatttacttcgtgtttncttanattagtcgaccgacggacctagccttacggtttgggtcggttccgggagggtacggccgtaggttccgaccgttcgtacggcgaccgcccgaagtcctacccggcccctacggtcctcgttcccg

SEQ ID NO: 35413 - DNA, 587 bp, Homo sapiens
  misc_feature: GYAE6OF01DFJWK.45.79.H02.1.454.CMB.1.raw
  modified_base (227)..(227): a, c, t, g, unknown or other
  misc_feature (227)..(227): n is a, c, g, or t
  modified_base (262)..(262): a, c, t, g, unknown or other
  misc_feature (262)..(262): n is a, c, g, or t
  modified_base (461)..(461): a, c, t, g, unknown or other
  misc_feature (461)..(461): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaaccngcagtgatggtggattatacttgtctctgtacaanagccaccaggacaaacgccccaaactcatgtatttatgaggacagtaacgcggccctgtagggtttctaagtcgtcttctcgtcggtctaccgtaagtccgtcggacctaaccgaccggtccctaccctagacctaactccgtcgtcgggcctccgaggcgtaggacggacgaggtctagtatttatactgtactgctnatgtgcgtaggtagttagttacgtttgggtcgtcgggacggtacgggacctaagtcgtacggtccgttacgtcgggtactaccggacccgtaacggtccctaccggcccccttcggtccgtacccg

SEQ ID NO: 35414 - DNA, 589 bp, Homo sapiens
  misc_feature: GYAE6OF01BOJZ8.45.79.H02.1.454.CMB.1.raw
  modified_base (390)..(390): a, c, t, g, unknown or other
  misc_feature (390)..(390): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacagcacccaggcaaacgcccccaaatcatgatttatgagggcagtaagcgcctgagggtttcaatcgcttctctcgctcaagtctggacaacaccggccctcgacgactatctcgcgctacgngtcgtaggacggacgacgtcgtagtactttactacgtcgctgtcctacgtatagtacgtacggtaagggttacgtttagtttacggtttgggttcggttcgggacgggtacggaccgtaacggtcgtacggtacccgttacggtacggtaccgaccgacccgtacggttccccttaccccggtcgtccctcgttcccgg

SEQ ID NO: 35415 - DNA, 662 bp, Homo sapiens
  misc_feature: GYAE6OF01CSPCC.45.79.H02.1.454.CMB.1.raw
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcatggaaccngcagtgatgtggattataccttgtctcctgtaccaacagcacccagacaacgcccccaaactcatgatttagngagggcagtaagcgtacctcgagggttctaatcgtcttctcgtcggtctccgtaagtcctggactaaccgacggtcctcccgtgacaacttcgtcgtcgggccttacgacggcgtcgtaagggacggacggtcttaggtaactttaacgtttacgtagtccgttgtccttacgtaagttacgttacggtacgttaacggggttaacgttacgggtttacgtttttacggggtcggtttaccggggaccgggtaacgggaaccggtaacgggttacgtaccgggtacccgttaccggtacggttaccgaaccggtcccgtaaacgggtcccgttaccggtccccccgtgggtacccttaccccggg

SEQ ID NO: 35416 - DNA, 477 bp, Homo sapiens
  misc_feature: GYAE6OF01DK7NY.45.79.H02.1.454.CMB.1.raw
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
  modified_base (458)..(477): a, c, t, g, unknown or other
  misc_feature (458)..(477): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaacccctccctcaagagtcgagtcaccatatcagtagacacgtccaaagaaccagttctccctgaagctgagctctgtgaccgctgcggacacggccgtgtattactgtgcgagagatcctaatacgtattactttgatagtagggattttgatatntgggcaaggacatgtcacgtctctcagcctccacaacgggccatcgtccttccccnggcaccctcctccaagacgccactcgtggggcacagcggcccgtgggctgcctggtacaaggactacttaccgtcgactcgcgtcctgagcgggcgtggcgaaggcgcactaagnnnnnnnnnnnnnnnnnnnn

SEQ ID NO: 35417 - DNA, 861 bp, Homo sapiens
  misc_feature: GYAE6OF01CH7DQ.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctcgccctgactcagcctgcctccgtgtcgtgggtcctccgtggacagtcgatccacctatcctccgtgctacgtacggaaaccaacgtagtgtagtttgggttaggggttatttttttaggtttcgttccgttccgttaggttaacccaaactacgaccaacccgacggaaccaaaacccgaccccctaaactccgaagttacgttaattttaaggtacggaacggggtactaacggtaaacggtcccggtacccgttacggttaacgggggttttaacctaaacgttccgttaccgtttcgttccggttcggtacccttaaccgtaaaggttccgttacgggaaccgaaacccggtaacccggtccccttaacccgtacggtaaaccttaacgttcccggttaccggttaccggggtacccttaacccggacgggtaccggttaacgggaaaccggggtaacggtaacgggtacgtttaacggttaacgttttaacgtttacgtcggtaaccgttcgtaccctagttacgttacgtacggtaacggttaaggttaacggtttacgtttaggttgggttcgttaccggggtaggaaccggtaccgtaggtccgtacgtacccggttaccgtacggtaccgtacggacccgtaacggtcccgtaccgtacccccggttagtacccttccgtccggtttacccccg

SEQ ID NO: 35418 - DNA, 597 bp, Homo sapiens
  misc_feature: GYAE6OF01C9LIP.45.79.H02.1.454.CMB.1.raw
  modified_base (239)..(239): a, c, t, g, unknown or other
  misc_feature (239)..(239): n is a, c, g, or t
  modified_base (570)..(571): a, c, t, g, unknown or other
  misc_feature (570)..(571): n is a, c, g, or t
  modified_base (573)..(597): a, c, t, g, unknown or other
  misc_feature (573)..(597): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaacccctccctcaagagtcgagtcaccatatcagtagacacgtccaaagaacccagttctccctgaagctgagctctgtcgaccgctgcggacacggccgtgtattacngtgcgagagatcctaatacgtatttactttagataggtaggggtagtttttgatatcgtggggaccaagggacaagtggtaccaccgtctcttcgacgcctccaaccgaacggcccctagtccggtccttcccccgtcggccctacccctccctaccaacgacgccaccgtcggtcggggacacgacgccgggcccgtcgggtcctcggtcccgtgggtaccgaaacgggtacccttaaccgtttcccgtacggtaacgttcccggtaccggttccgtcgggacggggtccgggtaccgtcgggaaccgtaacgggccgtacgtagtacgnngnnnnnnnnnnnnnnnnnnnnnnnnn

SEQ ID NO: 35419 - DNA, 597 bp, Homo sapiens
  misc_feature: GYAE6OF01CKJRW.45.79.H02.1.454.CMB.1.raw
  modified_base (192)..(192): a, c, t, g, unknown or other
  misc_feature (192)..(192): n is a, c, g, or t
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
tcagacgcgatcgacacgaccggtgctcgatttagtgtcacacgaagggaagggggggtcacaagaggcagcgctctcgggacgtctccaccagtggcctgggctctgctgctcctcactctcctcactcaggacacagggtcctgggcccagtctgccctgactcagcctgcctccgtgtctgggtctccnggacagtcgatcaccatctactgcacgtggaaccagcagtgagtgttagggacttataacttgtctctggtaccaanacgccaccaggacaaacgtccccaaatcatgtattangaggacagtaacgccgccctgtacgggtttactaactcgtctttcncgttcggctaccaagttcgnggaccaaacgaccggtccctacccgtagaacctaacttcctcgtcgggacctcgacggtctaggacggacgagtcaggtatttatacgtgactcggtcttacaagtacgtgcgtaagggttagttaacgttgtttgggtcggttacggcgggacggtaccgagttcgccgtaccgtcgttaggccacgacccgtacggtaccgtcccgccccgtggtcctacccg

SEQ ID NO: 35420 - DNA, 744 bp, Homo sapiens
  misc_feature: GYAE6OF01CI0V2.45.79.H02.1.454.CMB.1.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatgtggattataccttgtctcctggtaccaacagcaccaggacaacgacccccaaatcactgtattatggacggcgaagtaacgcccggcccgttagtacggggtttactaagtccgtcctttccgttaccgttcgggtacccgttacccgtaaaggtttcccgttacgggacctaaaacccggcccgggtaccccttccccgtacggaaaccctaacttcccgttccggttcgggtaccccttcccggtacggtcccttaccggaagggtaccggaacgggtcttacgggtattttaacgtttcttggttcgtctaccgtattaagtcgtaccgtaacgggtacccgtagtaccgtacggtttacggggtacggttccggggtacggggtacgggaccgttacggggttaccggtaccccggttaccggtaccgggttccgaacccggtccccgggtaaacggtcccgttacccgggcccccctttcgggtcccttacccgtttcccccgg

SEQ ID NO: 35421 - DNA, 524 bp, Homo sapiens
  misc_feature: GYAE6OF01E2B2B.45.79.H02.1.454.CMB.1.raw
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (423)..(423): a, c, t, g, unknown or other
  misc_feature (423)..(423): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacagcacccaggccaaacgccccccaaactcatnatttatgaggcagtaagcggccctgtagggtttcaatcgtcttctctgctcagtctgcacncgcctccngacatctcnggtctccgagctagaggacgaggctgtattattactgtctgctnatgtgacgtaggttagttagttacgtttggtggttcggcggaggaccaagccgtgacccgtcgtggtcacgacccgtacggcctccgcccctggctacccg

SEQ ID NO: 35422 - DNA, 778 bp, Homo sapiens
  misc_feature: GYAE6OF01DJMDS.45.79.H02.1.454.CMB.1.raw
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatcaccatctcctgcactggaaccagcagtgatggttggattatacttgtctctgtacaacngcaccagcaaacgccccaatcatgatttangaggcagtaagcgcctagtagggttctaagtcgtcttctcgtcggtctccgtaagtctcgggaccaaccgaccggtccctcccgtacgtaacctaacgttccgtcggtttcggggcccttacccggaaggggtaccttacgggaacgggtaaccggtaacggggtcgttacggtaacgtttttaacgtttaaccgtcggtaccggtttacgtaccctttacgtaagtttaacggtacggtaaccggtttaaagggggtttaacggtttaacggttttaacccggttttttagggggttccgggttttaccgggggaacccggggttaaacgggggtaaaccccgttaaagggtccccggttaaacgggttacccccggtttaacccggttaacggggttacccgaaacccgggtaccccgtaaacggggtccccgtttacccccgggttaacccccccggtcgggtttaccccgttaaccccgg

SEQ ID NO: 35423 - DNA, 615 bp, Homo sapiens
  misc_feature: GYAE6OF01C6PT9.45.79.H02.1.454.CMB.1.raw
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
  modified_base (291)..(291): a, c, t, g, unknown or other
  misc_feature (291)..(291): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatccacatcctcctgcactggaaccngcagtgatggttggtattatacttgtctctgtaccangcaccgagacaacaccccaactcatntattatgaggcagtagcgcctgtacgggttctaatcgtcttcgtctcggtactaccgtagtcgtggaccaacgaccgtccctcctacgacacttctcgtggtcctacgagtcgtaggacggtacgaggtcctagtaactttacttacgtcgtacgttcgctactattacgtggtaccggtagggtttacgttaggtttacgtttcggggttcggttacgggacgggtaccgggaccgtaggacccggttcggtaccgttacggtcgggtacacccggtacccggtaacggttcccgtaccccgtccccggtcgttccgtacccg

SEQ ID NO: 35424 - DNA, 610 bp, Homo sapiens
  misc_feature: GYAE6OF01B1DG1.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctctggtaccaacagcaccaggcaaacgaccccaaactcatgatttatgaggacagtaagccggcctcgtaggggtttctaacgtcgtcttctctcggtctaccaagtcgtcggacaaccgacggtccctcccgtcgaactaactcctccgtcgggtcctccgacggcgtaggacgggacggtacggcgttagtaagtttacttacgtcgtctgtcttacagttagtacgtcgtaaggttaacgttacggttacgtttgggtcggttcgggcgggtacgggtaccgaagtccgtcggtacccgttcgtacggtccgacgacccgtacggtcctaccggccccgttccggtcgtacccg

SEQ ID NO: 35425 - DNA, 759 bp, Homo sapiens
  misc_feature: GYAE6OF01CRAFU.45.79.H02.1.454.CMB.1.raw
  modified_base (307)..(307): a, c, t, g, unknown or other
  misc_feature (307)..(307): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaaccagcagtgatggtgggattataaccttgtctcctggtaccaacacgcaccgaggacaaacgcccccaaatcatgtatttagngaggcaagtaacgcggccctgtagggtttctaagtcgtcttcgtctcggtctaccgtaagtcgttggactaaaccgaccggtcccttaccccgttacgaaacctaacgttccgttcggttaccgggtccttaccccgaacgggtcgttacggaacgggaacggtacgggtccgttaagggtaacttttaacgtttaaaccgttcgtaccgttacgggacctttaaccgtaagtttaactagggtacccggttaaggggtttaacgttttaacggtttaacggtttttacggggttacggttttacccggggacgggggtaacgggaaacccggtaaaggttaccggtaccggttaaccccggttccggttaacgggtacccgtaacgggtaacccccgtaaacgggttcccgtaccccggtcccccccggtttggtaccccgttaccccggg

SEQ ID NO: 35426 - DNA, 550 bp, Homo sapiens
  misc_feature: GYAE6OF01DC5JI.45.79.H02.1.454.CMB.1.raw
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
  modified_base (437)..(437): a, c, t, g, unknown or other
  misc_feature (437)..(437): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacagcaccaggcaaacgcccccaaatcatgatttangaggcagtaagcgcctgagggtttctaagtcgcttctctggctccgaagtctggcaacncggcctccctgacaatctcgtcggcctaccaggctggaggacgtaaggcctagatttattacgtgtctgctcatangtacgtaggtagtagttacgtttggtcgttcgggacggtaggaccgtaagtcgtacggacccgttcgtaggaccgacgacccgtaggtcctaccggcccctcgggtctacccg

SEQ ID NO: 35427 - DNA, 722 bp, Homo sapiens
  misc_feature: GYAE6OF01AH5PC.45.79.H02.1.454.CMB.1.raw
  modified_base (272)..(272): a, c, t, g, unknown or other
  misc_feature (272)..(272): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggagttataaccttgtctcctcggtaccaacngcaccaggcaaacgcccccaaactcatgattagtgagggacaggtaacgccggtccgtcgtacggggtttctaagtcgtccttcttcgtcggtcctaccgaagttcgtcggacaaccgtaccggcccctcctacgaactacttcgtccgtcgggccttacccgagggtccgtaggaacgggaccgggacggtaccgttaggtaactttaacgttaccgtcggtacctcggtaccttacaagttacgtacggtacgtaaggggttaagtttacggtttacggttttggggttacggttaccggggtaccgggtaacgggggtaccccaaagggtcccggttaccggtaacccgggttacccggttaacgggttaccgtaacccgggtaccccggtaaaccgggtccctaccccgggtcccccccggtttccgggttccccttacccccggg

SEQ ID NO: 35428 - DNA, 830 bp, Homo sapiens
  misc_feature: GYAE6OF01D8KBF.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtcctgccctgactcagcctgcctcgtgtcgtggtctccgtggacagtcgatccaccattcctcctgcctacgtacggaacccagacgtagtgtagttggttagggtaattacttaaccttgtccttccgttacggtaacccaaacgacgtaccgacccgtacggaccaaaaccgacccccctaaaacttacctaactttaagtttaagtaggacgggtacgtaacggtaacggtcccgggtaccccgttacggtacggggttttacctaaacgttccggtactttccgttcgttaccgggtaccttaacccgtaaacggttcgttacggtaccgaaacccgtaccggtacccccttacccgtaacgaaccgtaacttccgttccggttcgggtccctacccgtacgggtccgtagggaaccgggtaaccgggtacgggtacgttaagggttaacttttaacggtttaaccgtcgttccgtacggttacctacgttaagttacgtacggtaccggttaagggtttaaggttaaccggttttacggtttacgggttcgggtttccggggaacgggtacggtaccgtaggtacgttcccggtaaccgttccggttacgggttaccaccggtacccgaacggtcccggtacccgtcccgtccggtactccgtttaccccg

SEQ ID NO: 35429 - DNA, 632 bp, Homo sapiens
  misc_feature: GYAE6OF01ARIBR.45.79.H02.1.454.CMB.1.raw
  modified_base (268)..(268): a, c, t, g, unknown or other
  misc_feature (268)..(268): n is a, c, g, or t
tcagacgcgatcgacacgaccggtgctcgatttagtgtcacacgaagggaaaggggggggtcgacgaagaggcgagcgctctcgggacgtctccaccatggcctgggctctgctgctcctcactctcctcactcagacacaggtcctgggcccagtctgccctgactcagcctgcctccgtgtctgggtcctcctggacagtcgatcaccatctcctgcactcggaacagcagtgatggtggattatacttgtctctcgtaccacacnccaccgagacaaccaccccaactcatcgtattcaggacggctagtacgccgcctcggtaggtttacacgtcgtcttctcgtcgacctctaagtcgtgaccaacgccggacctccagactacttctccgtcggtcctacgcggtacgtaggaacggacgtacgtcttagttactttaagtccgtcgtcgtctactactaagttctacggagtaggttacgttacgttgtttcgggtacggttacgggacgggttaacggtacccgtaacggtaccgtccggtaccggttaccggtaccggttccgaacccgggacccggtaacggtcccgttacccccggttccccggtaccgttaccggtcccg

SEQ ID NO: 35430 - DNA, 599 bp, Homo sapiens
  misc_feature: GYAE6OF01D3KUP.45.79.H02.1.454.CMB.1.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcacgtggaaccngcagtgatggttggattataacttgtctctgtacacagcaccaggcaaacgcccccaaactcactgtatttagtggaggcaggtaacgccggccctcgtaggggtttactaagtcgtcttctcgtggctccaagtctggaccaaccgaccggtccctcccgtagaacctaacttccgttcgtcgggtcctccgagggtcctaggacgggacgtaggcctagtatttacttacgtgtctgctcagtgtcgagtaggttagttagtttacgtttgggtcgttcgggacggacggacctaacggtcgtacgtacccgttcggtacggtcgaccggacccgtacggtccctcccggtccccgtcgtcccgtacccg

SEQ ID NO: 35431 - DNA, 811 bp, Homo sapiens
  misc_feature: GYAE6OF01D2EOW.45.79.H02.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccntctcctgcactggaaccngcagtgatggtggattataacttgtctcctagtaccaacacgcaccaggacaacgcccccaaatcatgtatttanggaggcagtaacgcgcctgtagggtttctaagtcgtcttctcgtcggctacctaagtctcggtacaaccaccgggtccctcccgtacgaaccaactttccgtaccggttcgggtaccctacccggtaagggtccgttacgggaacgggtaaccgggacgggtacccgtttagggttaaactttttaaacgtttaccgttacggacctttacgggtaccctttacgtaattacgttacggtacccggttaaaggggttaacggtttaacggttttaccgggtttttaggggtttaccggggttttacccgggggaaccgggggttaacgggggtaaaccccgtaaagggtttacccgggttaaacccggttaacccccgggtttacccgggtttaaccggggttaaccccggtaaacccgggtaccccccgggtaaaacggggtttcccccggttaaccccgggtttacccccccccgggtttcggggtacccccgttttaaaccccccgg

SEQ ID NO: 35432 - DNA, 578 bp, Homo sapiens
  misc_feature: GYAE6OF01CUSYP.45.79.H02.1.454.CMB.1.raw
  modified_base (247)..(247): a, c, t, g, unknown or other
  misc_feature (247)..(247): n is a, c, g, or t
  modified_base (257)..(258): a, c, t, g, unknown or other
  misc_feature (257)..(258): n is a, c, g, or t
  modified_base (260)..(260): a, c, t, g, unknown or other
  misc_feature (260)..(260): n is a, c, g, or t
  modified_base (274)..(275): a, c, t, g, unknown or other
  misc_feature (274)..(275): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctgccctgactcagcctgcctcgtgtctgggtctcctggacagtcgatcaccatctcctgctactggaccagcagtgatgtggattatactnctctgtacanncnccagcagccccaannatgattatgaggcagtacgcgcctcgtagggttctaactcgtacttctcgtggctaccgagtctggccaacgaccggtcctcccgtagacctaactctacgtggtcctccgacgctacgaggacgagctgtactttagtttctagttacgctctaattagtcggacgacgggtaccagtcgttacgttgggtcggttccgggacggggtaccggaccggtacggttacggtacccggtacgtacgggtaccgccggaacccgtacggtccgtacccgtacccccgttcggtctccgttccccg

SEQ ID NO: 35433 - DNA, 747 bp, Homo sapiens
  misc_feature: GYAE6OF01B5J1L.45.79.H02.1.454.CMB.1.raw
  modified_base (142)..(142): a, c, t, g, unknown or other
  misc_feature (142)..(142): n is a, c, g, or t
  modified_base (206)..(206): a, c, t, g, unknown or other
  misc_feature (206)..(206): n is a, c, g, or t
tcagacgcgatcgacacgaccggtgctcgatttagtgtcacacgaaggggaaagggggggtcacaagaggcagcgctcgtcgggacgtctccaccatggcctgggctctgctgctcctcactctcctcactcgaggacacgngggtcctgggcccagtcctcgccctgactcagcctgcctccgtgtcgtgggtcctccgtggacngtcgatccacctatctcctgcacgtaggaaccagcgagtgtagtgggttaggtacttaacttaaccgttgtacctccgttacggtaaccaacgacgaccgaaccgaaggaccaaaaccgtacccccaaatcgaacttagtatttaaggcggaacgggactaaggtaacgccggtacccgttaggtacgggttactaacgtcgtcttctcgtcgtacctacgtaacggttcgagacctaacgacccggtccctacgtacgtaaacctacgttccgtaccggtcggcccgttacgagggtaccgtagggaacgggtacggtacgttacgttaacgttaagtttaccgttacgtcgtcgttacggtacttaacgtataacgtcggtaacggttaagggtttacgttacggttttaacggtttcgggttacgggttaacggggacgggtaacgggtaccgtaaggtaccgtaccggttaccgtaccgttacgggaccgtaacccgaccggaacgtccgtaccccgtcccgtcgtcccgttacccg

SEQ ID NO: 35434 - DNA, 762 bp, Homo sapiens
  misc_feature: GYAE6OF01DG4OJ.45.79.H02.1.454.CMB.1.raw
  modified_base (331)..(331): a, c, t, g, unknown or other
  misc_feature (331)..(331): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctcgccctgacctcagcctgccctccgtgtcctgggtctccgtggacagtcgatcaccatcctcctgcacgtggaaccagcagtgagtggttggtattactaaccttgtcctcgtacggtaaccaacacgaccaccacggaccaaaaccgacccctaaaactcatacgtatttagnggacggactaaggaacgccggtacccttcggtaacgggtttactaacgtcgtcctttccgtacgttcgtaccgtaccctaaaggttccgtacggaacctaaccgtaccgtaccctcccgttaagaacctaacgttccgtcgtaccgggtcttaccggaggtcgtacggaaggtaccgaggtaccttaggtaatttacgtaccgtgaccgttctacgtactaacttacgtacggcgttaaagggtttaccgttaagtttacgggttttaccgggtcggggttaacccgggtacggggtaaaccgtacccgtaaagggttccggttaacccgggtacccgttacccgggttacggtaaccgaacccgggtaaccccgtaaacgggtcccccgtaccccgggttaccccccggttgttccccgttaacccccgg

SEQ ID NO: 35435 - DNA, 830 bp, Homo sapiens
  misc_feature: GYAE6OF01EDPRH.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctcgtgtctggtctcctggacagtcgatcacatctcctgctactggaacccagctagtgtagttgggttaggggaatttaacgttaaccgtttcggtcttaccgttacggttaacccaacgaacgccaaccccgaggaaccaaaaccgaccccccctaaaactcctaagttcgtaacgttttaacgtagggaacgggtacgaacgggtaaacggtccggtaccccgtttacggttaacgggggtttttacctaaacgttcccgggttacctttaccgttccggttacggggtacccttacccgttaaaacggttcccgttacgggaacccaaaccggtaacccgggtccccttaccccgtacggaaaccctaacgttcccgttaccgtccgggtacccgttaccggtacggtaccgtacgggaacgggaacgggtacggtacttacgggtaatttttaacgttaccgttacgtccttcggtaccttacgtagttaacgtcggaacggttaaggtttaacggtttaacgttttacggtttcggggttaggtccggggacgggtaacgggtacctaacggtccggttaccgtaccggttaccgtacgggtacaaccgacccgtaacggtcgacccccggtccgtccggtcctacccg

SEQ ID NO: 35436 - DNA, 602 bp, Homo sapiens
  misc_feature: GYAE6OF01EEKZA.45.79.H02.1.454.CMB.1.raw
  modified_base (202)..(202): a, c, t, g, unknown or other
  misc_feature (202)..(202): n is a, c, g, or t
  modified_base (235)..(235): a, c, t, g, unknown or other
  misc_feature (235)..(235): n is a, c, g, or t
  modified_base (282)..(282): a, c, t, g, unknown or other
  misc_feature (282)..(282): n is a, c, g, or t
  modified_base (322)..(322): a, c, t, g, unknown or other
  misc_feature (322)..(322): n is a, c, g, or t
  modified_base (485)..(485): a, c, t, g, unknown or other
  misc_feature (485)..(485): n is a, c, g, or t
  modified_base (539)..(539): a, c, t, g, unknown or other
  misc_feature (539)..(539): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcgaggacacgagggtcctgggcccagtcctgccctgactcagcctgcctcgtgtctgggtctccgtggacngtcgatccaccatcctcctgccagtcggaaccngcagtgagttggttagggattactaccttgtctccgtgtaaccaacngaccaccgagaccaaccgacccccaatcatgtatttacgnggacggacaaggtacgccggtacccgttaggtacgggtttacaacgtccgtaccttctcgtgtccctacgtaacgtcgtacgaccaaccgtcccggtcccttccgtacgtaacctaactccgtacggtcggtcctaccggtagcgtaggacggtacggacgtntacgtattagtctgctgctgtatgagtgtagttagtcgttgttggtggtacggnggaacgtcgagtcggtcacgtacgtggacgacgccggtacgcctccggcccgtgccttcccgg

SEQ ID NO: 35437 - DNA, 686 bp, Homo sapiens
  misc_feature: GYAE6OF01C4OFS.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctcgtgtctggtctcctggacagtcgatcaccatctcctgcactggaaccagcagtgagtggttaggtattacttaacttgtcctccgtaggtaaccaacacgaccacccgaggaccaaaccgacccccaaactcaatacgtatttagtaggaggacaggtacgccggtacccgtaggtagggttactaacgtcgtcctttcgtcgtcgtcctacgtaagtcgtacgaccaaccgccggtccctccgtagaacctacgtccgtcgtccgggtctaccggaggtcgtaggtaacgggaccggtaggtacgttagttacttttacgtactcgtcttacgtactactaagtcgtagtcggttaagggtttagttaacggtttacggttttgggtaccgggttacggggtacgggtaaccgggtaacctaacggtccggtaaccgttacccggtaccggttcgaccgtaacggaccccgtacgggtccctacccggtccccgtcggtctaccccg

SEQ ID NO: 35438 - DNA, 662 bp, Homo sapiens
  misc_feature: GYAE6OF01AMONQ.45.79.H02.1.454.CMB.1.raw
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (305)..(305): a, c, t, g, unknown or other
  misc_feature (305)..(305): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctcggcccagtctgccctgactcagcctgcctccgtgtctgggtctccgtggacagtcgatccaaccntcctcctgccacgtggaaccngcagtgattgttgggattactacttgtctctcgacacncncaccagacaacgaccccaactcatcgtattgnggaggactaggacgccggtcctacggtacggttactacgtctcgtttactcgtcgtacctaccgtacgttcgtcgtaccgaaccgtaccgtccctcctacgacctacgtccttccgtggccctacggtacgcgttagggacgtaccggtacggacgttgtaactttaccgtcgtagtctcgtactccgtagtacgtcgtacggaggtttaggttacgtttagtttcgggttacgggtacgggtcgggtaaccgggttccgtacggggttacccgttcccgggtaacgttccgggtacggtacccgacccggtacggtccgttccccgacccggttacggtcccgtccgtttccccgg

SEQ ID NO: 35439 - DNA, 560 bp, Homo sapiens
  misc_feature: GYAE6OF01AZ9IF.45.79.H02.1.454.CMB.1.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggaccaaacgcccccaaactcatgtatttatgagggcaagtaacgccggccctcgtaggggtttctaagtccgtcttctctggctccaagtctggcaacgcgccctcctgactatccgtgtcggcctccgaggctaggagacggaggctagtattacttactgctcgctcatgtgtcgtaggttagtagtttacgttgggttcgttcgggcggtagggaccaaggtccgtcggtaccgtcgtaggtccacgacccgaacggcctccggcccctcggtcctaccg

SEQ ID NO: 35440 - DNA, 557 bp, Homo sapiens
  misc_feature: GYAE6OF01D27MZ.45.79.H02.1.454.CMB.1.raw
  modified_base (306)..(306): a, c, t, g, unknown or other
  misc_feature (306)..(306): n is a, c, g, or t
  modified_base (427)..(427): a, c, t, g, unknown or other
  misc_feature (427)..(427): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaacgcccccaaactcatgtatttangaggcagtagcgcctgagggtttcaatcgcttctctggctccaagtctggcaacgcgcctcctagacaatctcgtggcctccgaggctgaggacgaggctagtattattactgtctgtctnagtatcgcgtagggttagttagttacgtttgggtcggttcgggacgggtagggaccaaggtccgtacggtacccgtccgtaggtaccacggaccccgtaggcccgtaccggcccccctgggtccctaccg

SEQ ID NO: 35441 - DNA, 637 bp, Homo sapiens
  misc_feature: GYAE6OF01DJ7KI.45.79.H02.1.454.CMB.1.raw
  modified_base (222)..(222): a, c, t, g, unknown or other
  misc_feature (222)..(222): n is a, c, g, or t
  modified_base (264)..(264): a, c, t, g, unknown or other
  misc_feature (264)..(264): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (403)..(403): a, c, t, g, unknown or other
  misc_feature (403)..(403): n is a, c, g, or t
  modified_base (505)..(505): a, c, t, g, unknown or other
  misc_feature (505)..(505): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctggcccagtctgccctgactcagcctgcctcgtgtctgggtcctctggacagtcatcacatctcctgcactggaaccngcagtgatggttggattataccttgtctcgtaggtaccaacngccaccaggaccaaacgcccccaaatcatcgtatttacngatgtacaagtaactccgcctggtagggtttcngactcgtcttactgtacggctaccgagtcgtcggacctaaaccgccggtcccctccgtacgtaaccncgttcctcggtccggtcctaccgtacggtcgtacgggaacgggtacggtacgggtacttacggtaaattttaccgttaacgtcgtaccgtaagtcccgttanaaacgttcgtacgaccgtaaccgccgtaagcgtaacgttccgtaaacgttcccggtaagttaccggtccgggacgggttaaccggcgtaacgtccgtacggtaccctacgtaaggcccacggcccgtaccgg

SEQ ID NO: 35442 - DNA, 666 bp, Homo sapiens
  misc_feature: GYAE6OF01A5XKU.45.79.H02.1.454.CMB.1.raw
  modified_base (528)..(528): a, c, t, g, unknown or other
  misc_feature (528)..(528): n is a, c, g, or t
  modified_base (649)..(649): a, c, t, g, unknown or other
  misc_feature (649)..(649): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatctcctgcactggaaccagcagtgagttgttaggtattactacttgtctcgtaggaccaacagccacccaggaccaaaccgacccccaaactcatagtatttatggacgggctaacgtaacggccggtacccctaggtacgggtttacctaagtccgtctttctcgtcggactaccgtaagtctcggaccaacgtcccggtacccttcccgtacgtacctaacgttcctccggttacgggtccttaccgagggtccgttaagggaacggaaccgggaggtacttacgttaatttaacgttactacggcttcgtacctanacttgtcgacgtaagggttacgttacgttaggttttgggtacgtcggggtacggaaccgggaacctaggtccgtacggtacccgtacggacggtccgacgacccgtacgtcccggtacccnccccgtgtccgtacccg

SEQ ID NO: 35443 - DNA, 677 bp, Homo sapiens
  misc_feature: GYAE6OF01A8HG0.45.79.H02.1.454.CMB.1.raw
  modified_base (301)..(301): a, c, t, g, unknown or other
  misc_feature (301)..(301): n is a, c, g, or t
  modified_base (359)..(359): a, c, t, g, unknown or other
  misc_feature (359)..(359): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggattataccttgtctctggtaccaacagccaccaggccaaacgcccccaaactcatgattangaggcagtaagcgcctgtaggttcagtcgtctctctggctccgaagtctcggacaacnccgggtccctcccgtagaacctaactccgttacgtcgggaccctccgacggtcctacgaagggacgacggtccgttagtacttttactttcgttcggttctcttaccgattacgttcgaccggtaacggaacctacggttccgttaacgggtttcggggttacgggttaccggggtacgggtaaccggggtaccgttaacggggttaccgggtaccccggttaccgggttaaccgggttcccgaacccggtacccggaacgggtaccccgtacccgggttaccccccggtaccgttacccggtaccccgtttaccccg

SEQ ID NO: 35444 - DNA, 590 bp, Homo sapiens
  misc_feature: GYAE6OF01D4IQ8.45.79.H02.1.454.CMB.1.raw
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgtattttgggattataccttgtctcctggtaccaangcaccaggcaaagcccccaaatcatnattangaggcagtagcgcctgagggtttctatcgcttctctggtctaccaagtctggccaacgccggtccctccctgaactatcttcgtcgggcctccgagtcgtaggacggacggacggtctagtatttacttactgctcgctcattactgacgtaggttagttagttacgtttggtcggttcgggaccgggagggtacccaagggtcctcggtaccccggttcgtacgggtcccgaacgccccgtaaacgggtccctacccggtccccccttcgggtccctacccgttccccgg

SEQ ID NO: 35445 - DNA, 628 bp, Homo sapiens
  misc_feature: GYAE6OF01ADJ7B.45.79.H02.1.454.CMB.1.raw
  modified_base (609)..(609): a, c, t, g, unknown or other
  misc_feature (609)..(609): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcacgtcggaaccagcagtgattggttggattactacttgtctcgtcggtaccaacacgcaccagacaaccgaccccaaactcattgtaatttagtcggaggacaaggtaacgccggtccctacggtacgggtttctaacgtcgtacttctcgtcgcctaccgtaagtcgtagacaaccgaccggtcctccgtagtactactctcgtcggtcctacgacggtcgtggaacggacggtacgtacgtacgttaacgtttacttacgtcgtcgttcgtactacgtagtacgtcggtacgtaggtttacgttaggtttacgtttcggtcggtacgggcgggaacgaccgtagtccgtcggtacccgtacgtacggtccgaccgaccgtacggtcccncccggtcccgtgtcctccg

SEQ ID NO: 35446 - DNA, 902 bp, Homo sapiens
  misc_feature: GYAE6OF01D2JN2.45.79.H02.1.454.CMB.1.raw
  modified_base (231)..(231): a, c, t, g, unknown or other
  misc_feature (231)..(231): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcatccacctatcctctgctaacgtcggaaccngcagttgagttgggtaggtagtttaactaaccgttgtacctccgttacgtaaccaacacggaccacccgaacggaccaaacccgaccccctaaatccgtattcgtaactttacggaggaacggtagtaacggttacggcccggtacccgttacggttaacgggttttactaacgtccggttctttaccgtcgtcggcccttaacgtacggttcgtaccggaccaaacccgtcccggtcccttaccggtacgtaacgttaactccggttcggaccggttaccacccgggtagtaccgtgggaaccggaacggttacggacgttttaacgtaacgttttaagttaccgtcgtaccgttttacgacctttaaccgaaattttacgggaccgttaaccgggttaaacggggttttaaaaccggttttcccggtttttaaacgggggttttttcgggtacccgggggggtttccgggaaacggggggtttaaaccccgtaaaaccggggttaccccggttacgggttacccccggttaaacccgggtttaacccccgggttaaaccgggttaccccgggaaaccgtaaccccccgggggttaacctttaaccccggggttcccccggtaaacccccccccggggttttagggtaaacccccccttttacccccggg

SEQ ID NO: 35447 - DNA, 647 bp, Homo sapiens
  misc_feature: GYAE6OF01A53D6.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcatccaccatctcctgcactggaaccagccagtgatggttggattactaacttgtctcctggtaccaacagcaccgaggcaaacgccccaaactcatcgattatgaggcaggtaagcgcctcgtaggggtttactatacgtcttctcgtgctctaagtctggacaaccgacgcctcctagactaactctcgtcggccttacgacggtcgtagacgggacgcggactgtaactttacgttacgtcggacttcggaccttacctaagttacgtaggtaccgtaagggtttacgtacgttttacgtttgggttacggttacggggaccgggtaacggtaccgaacgggttaccgtcgggtaacccccgttacggttacgggttaacccaccgggtaaccccggaacggtcccgtaccccggtcccccgttcccgggttacccttaccccgg

SEQ ID NO: 35448 - DNA, 853 bp, Homo sapiens
  misc_feature: GYAE6OF01C5ON5.45.79.H02.1.454.CMB.1.raw
  modified_base (231)..(231): a, c, t, g, unknown or other
  misc_feature (231)..(231): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactcggaaaccaacngtgacttggttggggtatttttagtttcgtcttcctaggtaccaacaaccacccggcgaacgaccccaaactaatcaatttacagggacactaagcggtcccgtacgggggttcaagtccgtcttcgtactcggcctccgaagttctacggtacaaacgtaccgggtccctaccgttcgaacctaacgttacctccgttcggggtcctacccggtaggaccgttcgaacggtacggacggtacgttaggttaactttaacgtttttcgtacggtttcggtaccttaccgtaagtttacggttacgaccgggtaacggggtaaccccgtaacggttacccgggttaaacggttttcggggggttaccgggttttaacccggggggaccgggggttaaaccgggggtaaccccggttaaacgggggtttttacccgggtaaccccggggtttacccgttaacgggggtttaccccgaaaccgggtaacccccggtaaacgggtcccgtttacccgggtccccccccgtttacgggttaccccgtaaacccggtttcccgtttaccccgggtttttacccccccacccccgttttaccccgtttaccccgtccggggttaacccg

SEQ ID NO: 35449 - DNA, 869 bp, Homo sapiens
  misc_feature: GYAE6OF01D96T2.45.79.H02.1.454.CMB.1.raw
  modified_base (155)..(155): a, c, t, g, unknown or other
  misc_feature (155)..(155): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacaggatcgtggccctttntgccctgactcagcctgcctccgtgtctggtctctggactagtcgatccaccagtcggcctgcctacgtacggaaaccaacgtagtgtagttgggtttggggttaagttttttaggttttcgttcttaccgttacggtaacccaaaccgtaacccgacccccggtacgaaaccgaaccccctaaaacttaacttacctaatttaacggtaacggaacctacggtaaacggcccgggtacccggtttacgggggttactaacggtccgttcttccgtacgttcggtacctaccgtaagtccgtaacggacctaaaccggtccggtcccttacccgtacgaaaccttaacgttccttccggtacgggtcccctaccggaggtcccgtacggaacggtacgtacggtaccttagttacttttagtttcgttacggttacttaccgtacgttagttacgaccggtacgtaaccgggaacccgttaggtaccggttagggtttcgggttacgggttaccggggacggggtaccgggttaaccgggttacgggttacccggacccggtttaccggtacggtacccgtaccgggtaaccccggtacggttccccggttacccggtcccccccggtttacgggtaccccttaccgttaccccggttttaccccggttaccccccgttaaccccgtttccccgtccggttccccgttaccggg

SEQ ID NO: 35450 - DNA, 614 bp, Homo sapiens
  misc_feature: GYAE6OF01CE2D6.45.79.H02.1.454.CMB.1.raw
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (387)..(387): a, c, t, g, unknown or other
  misc_feature (387)..(387): n is a, c, g, or t
tcagacgcgatcgacacgaccggtgctcgatttagtgtcacacgaagggaaatggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccatctcctgcactggaaccagcagtgatggtggattatacttgtctcngtaccacacncaccgagacaacaccccaatcatgattagnggaggtagaagtacgccgtccgtcgtagggtttactaacgtcgtcttcgtctcggctaccgagtcgtcgacaacgccgtcctaccgtanactatcgtcgtcggctaccgagcgtggacggacgaggtctagttattagtacgtgtctctacctataacgttagtcgtacgttaaggtaagttacggtttaggtttcggttacgggttcgggaacggggtacggtaacccgaaggtccgtaaccggtacccggttacggtaccggtacccgaacggtacccgtacggtacccgtcccgtcccccggtcggtaccccg

SEQ ID NO: 35451 - DNA, 733 bp, Homo sapiens
  misc_feature: GYAE6OF01CYI9Y.45.79.H02.1.454.CMB.1.raw
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctgccctgactcagcctgcctccgtgtcgtggtctccgtggacagtcgatcacatctcctgcactggaaccngcagtnatgtggattatacttgtctctgtacacacgcaccagacaacgaccccaactcactgtatttagtagaggtacagtacgaccggtcccgttacggtacggggtttactaacgtccggtacctttcgtcgtacggtcctaccgtaagtcgtacgaccgaaccgtaccgtcccttccccgtagtaacctaacgttccgttaccgtcggggtacccttaccgtacgggtaccgttacgggaacgggtaccggtaacgggtacgttacgttaacgtttaaccggtttaacgtcggttccgttacgtcgttaaccggtttacttaacgttccggtaaccgtttaaggggttaactttaacgggtttacgtttttcgggtagggttccgggaacggtaaccgggtaccgtaaacggtcggttaccggtacccggttaccgttacgggtaccgaaccggtcccggacggttcccgacccgggtaccccgttcggtacccgttacccgg

SEQ ID NO: 35452 - DNA, 711 bp, Homo sapiens
  misc_feature: GYAE6OF01C64P2.45.79.H02.1.454.CMB.1.raw
  modified_base (128)..(128): a, c, t, g, unknown or other
  misc_feature (128)..(128): n is a, c, g, or t
  modified_base (238)..(238): a, c, t, g, unknown or other
  misc_feature (238)..(238): n is a, c, g, or t
  modified_base (476)..(476): a, c, t, g, unknown or other
  misc_feature (476)..(476): n is a, c, g, or t
  modified_base (637)..(637): a, c, t, g, unknown or other
  misc_feature (637)..(637): n is a, c, g, or t
  modified_base (692)..(692): a, c, t, g, unknown or other
  misc_feature (692)..(692): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctnactcacggacaccgacgggtcctcgggcccagtctcgccctagactcgacgcctcgccctccgtgttcgtggtcctaccgtaggactagtctatccacctatcctaccgngccacgtaacggaccagcgtagtgtaagttcgggttaggtaacttacttaccgttcgtaccttcgtacgtaaccaacgacgacccacccgaggaacccaaacccgacccctaactactagttagtaacgtttagacggacggaccgtaaggtaccgtcccggtaccgttacgtacgggttactacgtctcttcgtacgtcgctacgtagtcctacggacaccgtacgtccctaccganaacaccttcgtacgtacgccgtccgtagtacgacggtaacggacggtacgtgtacgttacgtttaatccggtacgtacctacgtcgtactaaggtctaacggtacggtaaacgttaggtttacgtttagggttcggtcggggtaccggtagggaaccgtanacggtcgtaacccggttcggttaacgcgtaaccggcccctaacgacggttccccncgtacccgtctcggtaccc

SEQ ID NO: 35453 - DNA, 830 bp, Homo sapiens
  misc_feature: GYAE6OF01APXDB.45.79.H02.1.454.CMB.1.raw
tcagacgcgatcgacacgaccggtgctcgatttagtgtcacacgaagggaaagggggggtcgacaagaggcagcgctctcgggacgtctccaccatggcctgggctctgctgctcctcactctcctcactcaggacacagggtcctcggcccagtctgccctgactcagcctgcctccgtgtctgggtctcctggacagtcgatcaccatcggcctgcacgtaggaaccaacgagtgattcggttgggtacttttagtttcgtctcgtacgtaccaactaaccgacccggacgaacgaccccaaacttaacgtctaacgtttacgtaacgggaactaaccgttaacggtacccggtacccggtttaccggggggttttacctaaccggttacgtccgtttaccgttcgttacggttccgtacccgtaacgtccgttaacgggacctaaaccggtaccggtcccgttacccgtacggtaacctaaacgtttcccgtccgttacgggtaccttcccggaacggttcccgtaccggaacgggtaacccgggtaaggtccgttacggttaacgttttaccgtttaaccgtttcggtttcgtaccttacgtaagtttacgtacggtacgtacgggtaaccctacgtaccgttaacggtttcgggttacggttacgggccggggtaacgggttacccgtaagggttcccggtacccggttacggttacggtccggtaccggacccggttaacgggtccgttacccgggtccccggttcggtacccgtacgttcccgttccgttaccccgtaccccttcgtacccgtcggtaacccg

SEQ ID NO: 35454 - DNA, 752 bp, Homo sapiens
  misc_feature: GYAE6OF01B7MNK.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgccctcgtgtcgtgggtctccgtggacagtcgatccaccattcctcctgccacgtcggaaccagcagtgagttggtagggaattactaccttgtctccgtacgtaccaacacgccacccgaggaccaaacgacccccaaatctagtacgtatttagtaggacggactaaggtaccggccgtacccgtacgtagggtttactaacgttccgtcctttcgtcgtcggtcctaccgaaggttccgtacggacctaacgtcccggtacccttcccgtaacgtacctaacgtccgttccgtacgggtccctaccgtacgggtccgtagggaaccgggtacggacggtaccgttaggttaactttacgttaccgtgtccgttacgtccgttataacgttagtacggtacggtaaagggttacggtttacgtttacgggtttcgggttacgggtaccgggtaccggggtacgggtaacccgtaacgggtcccggttaaccgttacccggtaccggttacggtcccgaaccggtacccccggtaacggttccccgtcccggttacccccgtcggttaacccttacccg

SEQ ID NO: 35455 - DNA, 494 bp, Homo sapiens
  misc_feature: GYAE6OF01A2PV1.45.79.H02.1.454.CMB.1.raw
  modified_base (244)..(244): a, c, t, g, unknown or other
  misc_feature (244)..(244): n is a, c, g, or t
  modified_base (472)..(472): a, c, t, g, unknown or other
  misc_feature (472)..(472): n is a, c, g, or t
  modified_base (475)..(494): a, c, t, g, unknown or other
  misc_feature (475)..(494): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccaaatattactgtgcaagngagggcctggaattatcctttgaccacgtggggcctgggaaccctggtcaccgtcctcctcacgccctccaccgacgggcccatccggtccttccccctggcccaccctccctaccaagacgccacctcgtggggccacgaggccggcccgtgggctcgccgtcggtacgaacggtactacttccgtcgatccgcgtctggacggcgggctcgggcgaagggcactanagnnnnnnnnnnnnnnnnnnnn

SEQ ID NO: 35456 - DNA, 779 bp, Homo sapiens
  misc_feature: GYAE6OF01C5PED.45.79.H02.1.454.CMB.1.raw
  modified_base (181)..(181): a, c, t, g, unknown or other
  misc_feature (181)..(181): n is a, c, g, or t
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (438)..(438): a, c, t, g, unknown or other
  misc_feature (438)..(438): n is a, c, g, or t
  modified_base (560)..(560): a, c, t, g, unknown or other
  misc_feature (560)..(560): n is a, c, g, or t
  modified_base (587)..(587): a, c, t, g, unknown or other
  misc_feature (587)..(587): n is a, c, g, or t
tcagacgcgatcgacacgaccggtgctcgatttagtgtcacacgaaggggaaaggggggggtcacaagaggcagcgctcgtcgggacgtctccaccatggcctgggctctgctgctcctcactctcctcactcaaggacacgtacgggtccgtcgggccctaggttctcgccctgacctcncgcctcgccgtccgtgtcgtggtcctcgtaggactagtcactcaacctntccgtctacncgtaccgaggaaccagtcgtagtgtagttggttaggttaagttaaccttacgttcgtcgtaccgtacgtaaccaacgacgaccctaacggacgaaaccaaccccgaccctaatctagtcgttaattaggacggacgagtaacggtaacgtcccggtacccgtagggtttaacggttacacggttccgttcgtttccgnggttacggacctaccggtagttaccgacggaactaccccggtacccggccctttaccgaacgtaacgttaccggtccgggtcgtaccggtccttaccggaggttagacggaagggtaccggngttaacgttataatttaccggttaccncggtactcgtactacgtagttacggtacggtaaggtaacggtttagtttacggtttacgggttacgggtcgggaacgggtacgaaccggtacgtaccggttcggtacccggttaacgttcggaaacccgggtccgaaacccgggacccgtcccgggttacccgttacccccggtccgttaccgtcccgtccg

SEQ ID NO: 35457 - DNA, 843 bp, Homo sapiens
  misc_feature: GYAE6OF01A9XUM.45.79.H02.1.454.CMB.1.raw
  modified_base (277)..(277): a, c, t, g, unknown or other
  misc_feature (277)..(277): n is a, c, g, or t
  modified_base (356)..(356): a, c, t, g, unknown or other
  misc_feature (356)..(356): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacgacgggtcctcgggcccagtctgccctgacctcacgcctgcctccgtgtcgtcggtctccgtggacagtcgatcaccacttctctcgcacgtacggaaccagcagtgtagttggttaggtaacgttaacttaccgttntccgtaccgtacggtaaccaacgcgaccgaacccgaaggaaccaaaccccgacccctaaacgtctaagtcgtattacgngggacggactaacggtacggccgtaccgtacgggttacggtttacctacgttcgtacttctcgtacgtccgtacgaacgtcgtacgaacctacggtacccgtcccttaccgagtaacctacgttcccgtcggtacggcccgtaaccgtcgggtaccgtagggaacgggtaccggtaaggtccttaacggttacgtttaaaccgtttacggtcggttacctacgttaacgttaaccgttagttaaccgtaccgggtacgggtttaaacgggttttaccgttaaaggggttttttcggtttaccgggggtttacggggttacccggggggtaacggttaaacccggggaaaccgttaccgggtaccccgggtttaaccgggtttaaccccgggaaccgggttttaacccgggaccgttaacccggttacccgggaacccggttcccccggttaccccggtaccccgttaccggttcccggttaaccccg

SEQ ID NO: 35458 - DNA, 647 bp, Homo sapiens
  misc_feature: GYAE6OF01B1N05.45.79.H02.1.454.CMB.1.raw
  modified_base (230)..(230): a, c, t, g, unknown or other
  misc_feature (230)..(230): n is a, c, g, or t
  modified_base (270)..(270): a, c, t, g, unknown or other
  misc_feature (270)..(270): n is a, c, g, or t
  modified_base (312)..(312): a, c, t, g, unknown or other
  misc_feature (312)..(312): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatcctcctgcacgtggaaccngcagtgatggttggattactaacttgtctctggtaccaanagccaccaggactaaaccgacccccaaactcatgtacttagnggaggacaggtaacgccgcccgtacgtacggggtttactaagtccgtacttctcgtcggctaccgaagtcgtcggacaccgaccgccctccgtagactacgtcttacgtcgggtccctaccgagtcgtaggaacggacggacggtcgttaagtaacgttttaacgttacctcggtcttacgaccttactaagtagttcgaggaaggtttaagttacggtttaacgtttgggttcggttacgggtacggggaaggtaccgaggttccgtcggtacccgttaccgtacggcaaccggaccgaacggttcccgacccgtcccccgtggtccttccccg

SEQ ID NO: 35459 - DNA, 717 bp, Homo sapiens
  misc_feature: GYAE6OF01AVY70.45.79.H02.1.454.CMB.1.raw
tcagacgcgatcgacacgaccggtgctcgatttagtgtcacacgaagggaaagggggggtcgacaagaggcagcgctctcgggacgtctccaccatggcctgggctctgctgctcctcactctcctcactcacggacacgtacgggtcctcgggcccctaggtcctcgcccctaggacctcacgtcctcgccttccgtgtcgtcgggttcctccgtaggactcggtcgactcacctattcctcctgccacgtacggaaccagcagtcgtagttcggttggggtaacttacttaccgttcgttcctcgtacgtacctaacacgacctaccgacggaccaaccgacccctaaacgtaactagtacgttacgtacggacggtacgaacggtacgaccggtccgtacggtacgggtttactaacgtcgttaccgttacgtcgttacggtaccttacgacggttcgtacggaccaacgtacccggtcccgtccgtacgactactcgttacggtcgtacctaccgtcggcgtacgggacggacgacggtacgtaacgtcttaacgttcgtcgtctcgtactacgtatcgtacgtacggtagtagttacgttaggtttcggtacgggttcggacgggtacggtacgtacggtaacgtcggtacctcggtacggtacgaccggtacgtacggtccgcccggtcctaccggttcgtccgttcccgg

SEQ ID NO: 35460 - DNA, 587 bp, Homo sapiens
  misc_feature: GYAE6OF01CIK12.45.79.H02.1.454.CMB.1.raw
  modified_base (261)..(261): a, c, t, g, unknown or other
  misc_feature (261)..(261): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (453)..(453): a, c, t, g, unknown or other
  misc_feature (453)..(453): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactggaaccagcagtgatgtggattataccttgtctctgtacaanacgcaccaggacaacgccccaaatcatgtattangagganagtagcgcctagtaggttcaagtctcttctctggctcaagtctaggacaacaccgtcctcccgtagactaacttcgtcgtacgggtcctaccgaggtacgtacggaacggacgacggtcgtagtaagtttaattcgtagctacgtctaactntagtgtctaagggtagttaacgttcgtttaggtcgttacgggacggtacgggaacctaacggccgttcgacccgttacgttacggacgaccgtacccgtaacggtcccgacccgtcccccgttggccttacccg

SEQ ID NO: 35461 - DNA, 795 bp, Homo sapiens
  misc_feature: GYAE6OF01BZX3R.45.79.H02.1.454.CMB.1.raw
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
  modified_base (406)..(406): a, c, t, g, unknown or other
  misc_feature (406)..(406): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgccactggaaccngcagtgatggtggattatactgtctctgtacacngcaccaggcaacgaccccaaactcatgtactttatcggagggactacggtaacgccggtacccgtacggtacggggttttactaacgtccgtcttacgtcgtcggtctaccgaagtcgtcgacaacgaccggtccctcccgtanaactaacttccgtcggttaccgggcctaccggacggtacgtcgggaacgggaccggtaggtaccgttagttaacgttttaacgttacgttacggtcccgtttacggtaccttacgttaacgtttaacggtacggttaccggttaaaggggtttaacggtttaacgggtttttacggttttacgggggtttccgggttaccgggggtaaccgggggtaacccggggtaaacccgttaaaaccgggtcccggttaacccgggttaaccccgggtttaacccggtttaaccggggtacccggtaaccgggttaaccccccgggtaacgggttacccccgttacccccgggtaccccccccggtttacgggtacccccggtttaacccccggg

SEQ ID NO: 35462 - DNA, 694 bp, Homo sapiens
  misc_feature: GYAE6OF01ENGSW.45.79.H02.1.454.CMB.1.raw
  modified_base (168)..(168): a, c, t, g, unknown or other
  misc_feature (168)..(168): n is a, c, g, or t
  modified_base (230)..(230): a, c, t, g, unknown or other
  misc_feature (230)..(230): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactnagcctgcctccgtgtcgtggtctcctggacagtcgatcaccatcctctgcacgtacgaaccngcagtgagttggttaggtattactaccgttgtctccgtacgtaccaacgacgaccaaccgagaacaaccaccccaatcatntagttagnggagacaggacgccgtctggtaggttcactcgtcttacgtcgtcgtactacgtagtcgtcggacctaacggaccccgtccttaccgacgtaacctacgttccgtcggtacggtacccgtaccgggaggtacggttaacggagggtaacccgtggtaccgtttagttaaacggtttactaaccgttggtaccctgtaaccttcgtaaagttcgtacggtacgtagggtttaacgtttccgggtttagttgggggtcgtaccggggaccggaaacgggtaccgtaaggtccggtaaccgtccgggttactaaccgggaccgtaccgggacccggttaccgaccgttcccccggtaccccgtttcggccttaacccgg

SEQ ID NO: 35463 - DNA, 785 bp, Homo sapiens
  misc_feature: GYAE6OF01CN8QS.45.79.H02.1.454.CMB.1.raw
  modified_base (130)..(130): a, c, t, g, unknown or other
  misc_feature (130)..(130): n is a, c, g, or t
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactnaggacacgagggtcctgggcccagtctcgccctgactcacgcctcgcctcgtgtcgtcggtcctcnggactagtcgactcaacctntcctccgtgaccacgtacgaaacctgcgtagtgagttggttagggtaacttacttaacctttgtcctacgtacggtaaccaacgacaccgacccgaagacccaaaccgaacccctaaactacgtatacgtattaagtagggaacggtacgtaacggtaacggtcccggtacccgttacgggtaacgggtttaccttaaccgtcggttccttcgtccgtacggtacctacgtaacgtccgtacggacctaacccggtccgtacccgtaaccgtacggtaaaccaaccggttccgtaccggttaccgggttcccgaccgtacggggtaccgtaaggggaaccgggtaacgggtacgggttacttaacggtttaacgtttaaccgtacgttcgttaacggtccgttaacgtaccgttagtacgtaggtaccggttaagggttagtttaccgggttagtttacgggtcggtacgggtaccggggaacgtaacgtaccggtacggtaccgtaccggtacggtacgtaccggacgtaccggtacgtccgtcccggtaccccgtgtacccgttccg

SEQ ID NO: 35464 - DNA, 700 bp, Homo sapiens
  misc_feature: GYAE6OF01AKGNQ.45.79.H02.1.454.CMB.1.raw
  modified_base (327)..(327): a, c, t, g, unknown or other
  misc_feature (327)..(327): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcacctctcctcactcaggacacagggtcctgggcccagtctgccctgactcagcctgcctccgtgtctgggtctccgtggacagtcgatcaccatcctcctgcacgtcggaaccagcagtgattggttaggggatttactaaccttgtcttccgtaggtaaccaactacgacacccgaggaccaaaccgcccccaaactcatcgtattanggaggcaagtacgccggcctgtacgggttctaagtcgtcttcgtcgtcggctaccgaagtctaggaccaaccgtaccgtccctacccgtagacctacgtctccggtggcctaccggaggtccgtaggaagggacggtacgggtactacgttaacgtttacttacgtcgtacttcgtctactagttacgtacggtacgttagggttacgttacggtttacggttcgggttacgggttacggggaccggtaacgggtaaccgacggttaccggtacggtacccggttaccggtaccgggtaaccgaacccgggtacccggtaaccgggttccccgttacccggtcccccccgggttcggtaccccgttaccccgg

SEQ ID NO: 35465 - DNA, 837 bp, Homo sapiens
  misc_feature: GYAE6OF01DBXD0.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgaggtcctgggcccagtcctgccctgactcagcctgcctccgtgtctgggtctcctggacagtcgatcacctatcctcctgccacgtcggaacccagcagtcgagtggttagggagtttataaccttgtcctccgtcggtaaccaacacgaccaacccgaggaaccaaaccgtccccccaaactctaatgtactttagcgaggtctaggtaacgcccggtccctaggtacggtttacaattccgtcttccgtcgtcggtcctacgtaacgttccgtacggacccgtaaccgacccggtccccttaccggtaacgtaacccgtaacttcccggttacccggttacccgggtccctaaccccggtacggggtaccgttaaacgggaccggggtaaccggtaacgggtaccgttttaacgggtaacttttaaccgttacggtcgttacgtcggtaccttaccgtaagttacctaggtaccggttagggttaacgtttaacgggtttacccggtttttgggttacccgggtacgggggttaaccccgggtaagggtaccccgttaaccggccgttaacccgggtttaaccccccggaggtttaacccgggtaaacccccgtaccgggtaaaccccccgtacgggttaccccccgtccccgggttaacccccccccggttcggtttaccccgtttaaccccccgg

SEQ ID NO: 35466 - DNA, 601 bp, Homo sapiens
  misc_feature: GYAE6OF01DNR9X.45.79.H02.1.454.CMB.1.raw
  modified_base (231)..(231): a, c, t, g, unknown or other
  misc_feature (231)..(231): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (461)..(461): a, c, t, g, unknown or other
  misc_feature (461)..(461): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccaggtnagtgagttgttaggggattacttacttgtactcctaggtaccacngcaccagcaaacncccctaatcatgtaattagnggngacagagccgctagtaggttnatcgtntcnctgctacgatcgngacaacacgccctctagaactattcgcgtacggtcacgcgggtacagggtacggacggtacgtaaccgtgttaatttactacgtcgtcgtactctactattaacgngtaacgtagggtaacgttacgtttaccgttgggtacggtcggtaacggacgggaaactaccggtcgtaccggtaccgttacggtaggacccgtacgggaaccctacgggttccctacccgggtaccccttggtccttacg

SEQ ID NO: 35467 - DNA, 716 bp, Homo sapiens
  misc_feature: GYAE6OF01C4B7U.45.79.H02.1.454.CMB.1.raw
  modified_base (306)..(306): a, c, t, g, unknown or other
  misc_feature (306)..(306): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattgtgggattataaccttgtctctggtaccacagcaccgaggacaacgcccccaaactcactagtatttacgnggaacggacaggtaacgccggtccctacgttacggggtttactaacgtccgtccgtttctacgtcggtccttacctaacgttccgttcggacctaaccggtaccggtcccttacccgtacgaacctaacgtcttccgtacgggtcctaccgaggtcgtaggacggtacgaggtcttagtactttaattacgtgtacttcgacttactacgttaacgtgtaccgttagggttaacgttagtttaccggttttagggttcgggttacgggtacgggaccgggtaccgtaaggtccggtaacccggtaccccggtttacccggttaacggtccccggtaaacccggtaccccggtaaaccgggtccccgttaccccgggttacccccccgtccgggttcccgttaacccccgg

SEQ ID NO: 35468 - DNA, 577 bp, Homo sapiens
  misc_feature: GYAE6OF01DLNVS.45.79.H02.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (304)..(304): a, c, t, g, unknown or other
  misc_feature (304)..(304): n is a, c, g, or t
  modified_base (334)..(334): a, c, t, g, unknown or other
  misc_feature (334)..(334): n is a, c, g, or t
  modified_base (384)..(384): a, c, t, g, unknown or other
  misc_feature (384)..(384): n is a, c, g, or t
  modified_base (421)..(421): a, c, t, g, unknown or other
  misc_feature (421)..(421): n is a, c, g, or t
tcagacgcgatcgacacgaccggtgctcgatttagtgtcacacgaagggaaagggggggtctcaggaggcagcgctctcgggacgtctccaccatggcctggctctgctattcctcaccctcctcactcagggcacagggtcctggcccagtctgccctgactcagcctgcctcgtgtctggtctcctggacaggcatcacntctcctgcactggaaccngcagtgacgttggttattanactntgtctcgtacgtaccaacaccacccgaggactaaaccgcccccaaatcatacgtatttangtatgtcagtacgtcgcctgtacgggttcngtactcgctttctctggctaccgagtcgtcgacgtacgaccgtcctcccngacctatcgtcgcgggtacctcgagtctaggaggcgngtctagtactattcgtcgatctactatactgacctacgcgtgtactagtcgtacttacggtacgttagtccgggacggacggtaaccaggtcccgtaacggaccccgttacgtaacggtcccaacggtccaacgggtccgtccccggtacccccgg

SEQ ID NO: 35469 - DNA, 670 bp, Homo sapiens
  misc_feature: GYAE6OF01AC3T7.45.79.H02.1.454.CMB.1.raw
  modified_base (232)..(232): a, c, t, g, unknown or other
  misc_feature (232)..(232): n is a, c, g, or t
  modified_base (518)..(518): a, c, t, g, unknown or other
  misc_feature (518)..(518): n is a, c, g, or t
tcagacgcgatcgacacgaccggtgctcgatttagtgtcacacgaagggaaaggggggggtcgacaagaggcagcgctctcgggacgtctccaccatggcctgggctctgctgctcctcacctctcctcactcacggacacagggtcctcggcccagtctcgccctgacctcacgcctgcctcgtgtctcgggtctcctggactagtcgactccgaccactcctcctgaccnccgtacggaaaccagctaggtagtacttgggttagggttacttacgtacttcgtcctaccgtacgtaaccacacgaccaccgacgaccaacctacccctaaactaactactattacgtacgacacgtacgccgtaccggtacggttactacgtctctctcgtcgtctacgactcgtacgtacaccgtccgtcctcctacgtactactccgtacgtcgtcctcgacgtcgtacgacggtacggtcgtacgtactagttacgtacgtcgtacgtcctatactcgtacngtacgtagttagttacggttgttacgggtcggttacgggacggtaacggtacctacggtcgtaccgtaccgttacggtacggtacccgtaccggaccttaccgtcccgtaccccggtcccgtaccgttaccctcttcccggttccggtcccc

SEQ ID NO: 35470 - DNA, 675 bp, Homo sapiens
  misc_feature: GYAE6OF01B0VY9.45.79.H02.1.454.CMB.1.raw
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacactagggtcctgggcccagtctgccctgactcacgcctgcctcgtgtctggtctcgtggactagtcgatccacntcctcctagcacgtcgaaccngtcagtgtagtggttagggtattactaccttgtctccgtaggtaccaacgtcaccgaccgaaggaccaaaccggacccctaactccagttgtaacgtttagcggaacggcgtaagtaacggccggtacccgtaggttacggggtttacaacgttcgtctttcgcgtcggtcctacgacggttcgacgacctaacgtcccgtcctaccgtagaactactccgtcgtcggtacctaccggaacgtcggtacggaaccgggtaacgtacggtacttagtaacgtttagtacgtggtctaacgctacgtatagtagtacgtaggttagttaccggttaggtttcggtggttaccgggaaggtaccgggtactaacgtccggacgttaccgacggttcgaccgtaccgtcgtaacggtccccgttaccgccccggttgtccgttacccg

SEQ ID NO: 35471 - DNA, 739 bp, Homo sapiens
  misc_feature: GYAE6OF01AKWR5.45.79.H02.1.454.CMB.1.raw
  modified_base (246)..(246): a, c, t, g, unknown or other
  misc_feature (246)..(246): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctcgccctgactcacgcctgcctccgtgtctcgggtctccgtggacagtcgactccaccatctcctgaccactaggaacccagcctaggtnagttggttaggatttacttaaccttgtccttcgtacgtaccaacgacgccacccgagaccaaaccgaccccctaaactctagttacgtaatttacggtacggacgggtactaacggtaacggccggtccccgtacggttaacggggttactaacgttccgtaccgttcgttcgtacgtaccgtacgtacggtacgtcggaaccctaacgacccgtcccgtaccgtacgtaactactccgtacgtcggtacctaccgacgtcgtacggaggacggacgtcgtagtaacgttacttaccgtcgacttcgtaccctagtaccgttaagtccgttagttacgggttaacttcggtttaacggtttcggttacggggttacgggtaacccgggacggtaacccgtacggtacccgtacggttaaccccggtacgtaccgggttaccgacccggtaccggtaacgtcccgtaccccggtccccgttgtaacccgtcccg

SEQ ID NO: 35472 - DNA, 735 bp, Homo sapiens
  misc_feature: GYAE6OF01E4IYT.45.79.H02.1.454.CMB.1.raw
  modified_base (173)..(173): a, c, t, g, unknown or other
  misc_feature (173)..(173): n is a, c, g, or t
tcagacgcgatcgacacgaccggtgctcgatttagtgtcacacgaagggaaagggggggggtcacgaagaggcagcgctctcgggaccgtctccaccattggcctgggtctctgctgctcctcaccctcctcactcaggcacagggtcctgggtccagtctgccctgacttcngctgccttacctgtctgggtctcctggacagtcgtatccgacctacgtccccgtgcctacgtgggactccgagggtccggtgaccgtttaccttggtttttaacgtattcgtcctccgtggtatcgtacgtactaacctacccgaggaccaaaccgtaccccccaaactaccatactatttatcgtacgtcgtacgtaaacttaacgtccgggtacccgtacggttacggggtttactcgtacgtcgtcttcgttcgtacgggtctaccgtaacgttcgtacggtacctaacgttcccggtccctacccgtacgaccctacgtccgttccggtcgggtacctccgtacggtacgtacggaaacggacgtacggtacgtaagtaacttaacgttacgtacgtaccgacgtacctaactataataacgttacgttacgttccgtaggttcgggtacggtacggggacggaggtaaccgtacggtacgtaccgttcgtaggtaccgaacggtaccgtaaagttccgtacccgtccccggtacgtccttacccgtccgttccccgg

SEQ ID NO: 35473 - DNA, 754 bp, Homo sapiens
  misc_feature: GYAE6OF01EH9LT.45.79.H02.1.454.CMB.1.raw
  modified_base (228)..(228): a, c, t, g, unknown or other
  misc_feature (228)..(228): n is a, c, g, or t
  modified_base (589)..(589): a, c, t, g, unknown or other
  misc_feature (589)..(589): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctcgcctcgactcacgcctcgcctcgtcgtcgtggtcctctggtacacgtcgactcacctactcctccgtncgtacgtacggaaccagcgagtagtagttaggttacgggtaagttacttaaccgttctaccgttaccgttacggaaccaaacaccgtccaacccgaacgaaaccgaaccccaaacccccgtaaactctaagttacgttaaagtttagtacgggacggtactaacggtaaccggtcccggtacccgttacggttaacggtttacgacttccggtacttccgcgtacgtactaccgtaagtcgaccggaactacccgtccgtccgtaacctagtaaccacgttccgttaggtcccggtactcggtcggtaacgtacggagaaccggtgtacttagttcgtaacttgtactccggtatacgtangtacgtagggtaaccttaggttacgtttaacggttcggttttacggtagggtaccgggagggtaaacccggtacgtaacgtccggtacgtaccggttaacggtccgaccgacccggttaacgacccggttcccttaccccggcccgttccggactttaccccggg

SEQ ID NO: 35474 - DNA, 666 bp, Homo sapiens
  misc_feature: GYAE6OF01BDHPF.45.79.H02.1.454.CMB.1.raw
  modified_base (207)..(207): a, c, t, g, unknown or other
  misc_feature (207)..(207): n is a, c, g, or t
  modified_base (228)..(228): a, c, t, g, unknown or other
  misc_feature (228)..(228): n is a, c, g, or t
  modified_base (425)..(425): a, c, t, g, unknown or other
  misc_feature (425)..(425): n is a, c, g, or t
  modified_base (467)..(467): a, c, t, g, unknown or other
  misc_feature (467)..(467): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctcgtgtctggtctctggacagtcatcacctntctcctgccacgtcggaaccngcagtgagtggttaggagttactaaccttgtctccgtacggtaccaacgacgccacccgaggaccaaaccgacccccaaactactatagttactttagtggagggactaaggtaacggccggcccgtacggttacggggtttactaacgttccgtcttctcgtcgctaccagtctcggacacgccggtccctccganactacttcgtacgtcggtcctccgagggcctggacgggacgnggtcttgtactttagtactgtcctgtcctactagttcgtacgtacggtagggtttaacgtttaggtttacggttttggggttacgggttacggggaccggtagggacctaagggtccgtacggttacccggttaccggtgggtaccgacggaacccggtcggtacccgtcccgggtacccctccgggtcccttacccgg

SEQ ID NO: 35475 - DNA, 759 bp, Homo sapiens
  misc_feature: GYAE6OF01BSCI6.45.79.H02.1.454.CMB.1.raw
  modified_base (211)..(211): a, c, t, g, unknown or other
  misc_feature (211)..(211): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacgaggggtcctcgggcccagtctcgccctgactcgacgcctcgccctccggtgtcgtgggtcctccgtggacncgtcactccaccacttcctccgtcgctacgtacggaaccagcaggtgtagttggttagggtaacgtttacttaaccgttcgtcctaccggttacggaacctaacgacgacccaacccgaacggaaccaaacccgacccccctaaacttccaacgttgttaagtttaggtagggacgggacgtaacggtaccggtcccgtacccggttacggtaacggggtttactaacgtccgtacttcgtcgtcggtacctaccgtacgtcgtacgacctaaccgccgtccctacgtacgacttacgtcctcggtcggtaccctcggacggtgtacggacgggacgtcgtacgttacgttacttacttcgtcgtccgtctacttactacgttactacgtacggtagggtttaacggtttacggtttacgggttttcggtacgggttaccgggaccgggtacggtaaccgaccggttcggtaccggttaccgttaccggtacgacccgaccggacccggtaacggtcccgtacccggtccccggtccgtaccgtaccg

SEQ ID NO: 35476 - DNA, 792 bp, Homo sapiens
  misc_feature: GYAE6OF01DQZPO.45.79.H02.1.454.CMB.1.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (260)..(260): a, c, t, g, unknown or other
  misc_feature (260)..(260): n is a, c, g, or t
tcagacgcgatcgacacgaccggtgctcgatttagtgtcacacgaagggaaaggggggggtcacaagaggcagcgctctcgggacgtctccaccatggcctgggctctgctattcctcaccctcctcactcagggcacagggtcctgggcccagtctgccctgactcagcctgcctcgtgtctgggtctcctggacaggcgatcacatcctcctgcactggaaccngcagtnatgtggattatactgtctctagtaccangcaccagacaaacgccccaatcatgtatttagtggacggacaggtaacgccggtacccgtgttacgggtttactaacgtcgtctttactccggtggtccttaccgtaacgttcgtacgggaaccaaccggtacccggtaccctacccgtacgaacctaacgttccgtacggtcgggtcctaccggagggtaccgtagggaacgggacggtacggacgttacggttaactttacgtttacgtaccggttctaccggtacttacgtaaatttacggtacgggtaaccggttaaggggtttaacggtttaacggttttacgggtttacggggttttaccggggttaccggggggttacgggggtaaaccgggttaacccggtaacggttacccgggttaacggggttaccccggttaaacggttaccgggttaacccaaccggggttaaacccccgggtaaggttcccccggttcccggtaaccccccccggtttgggtaaccccctttccgggttccccggttttaccccccgg

SEQ ID NO: 35477 - DNA, 639 bp, Homo sapiens
  misc_feature: GYAE6OF01DNA3E.45.79.H02.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaagggggggtcacgaagaggcagcgctctcgggacgtctccaccatggcctggctctgctgctcctacactctccgtcactcaggacacgagggtcctgggcccagtctgccctgactcagcctgcctcgtgtctgggtctccgtggacagtcatccaccntctcctgcactggaaccngcagtnatggttggattagtaccttgtctctggtaccangcaccaggacaacgcccaatcatgatttagngaggcagtacgccgcctcgtacgggttctactcgcttctcgtcggcctccagtctcgacaacgccggtccctcgtacgactaacttccgtaccgtggcctccgaggtactaggacggaacgtaggtactaggttaatttacgttcgtcggtacctcgtacctagtaacgttagtcggtacggttagggttaacgttaacggtttacggttttggtacggtttcgggacgggtaccgggtaccgtaagggtccgttaaccggtacccgttacggttaccggtaccgtaccgacccggtaacggtccgtacccggtacccccgtgggttacccgttacccgg

SEQ ID NO: 35478 - DNA, 757 bp, Homo sapiens
  misc_feature: GYAE6OF01CLUX9.45.79.H02.1.454.CMB.1.raw
  modified_base (358)..(358): a, c, t, g, unknown or other
  misc_feature (358)..(358): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgccctcgtgtcgtgggtcctccgtggacaggtcactccaaccatcctccagctacgtcggaaccagcagtgtagtgggttaggtatttaacttaaccgtttcgtccttccgttaggtaacccaacgtacggaccaacccgacggaaccaaaccgaccccccaaaacgtcaattagtactttaggnggtacgggtaccgtaggtaacggcccggtcccttacggtaacgggtttactacgttccgtcctttcgtcgttcggtcctaccgtaacgttcgcggaaccaaccgtaccgtccctacccgtagtaactacgttccgtcggtacggtcccgtaccgacggtacggtacgggtaacggtacggtaacgtcgttaagggttacttttaacgttaccgtggtacctttacgcgttaacctaagttccgtaggtacggttaagggttacgtttacggtttacggttttcgggtacggtaccgggacggggtaacgaaccggtacgtacgttaccggtccgttaacggtcggtaccgacggtaccccggaagttcccgtacccggccccgttacgtccctacccgg

SEQ ID NO: 35479 - DNA, 826 bp, Homo sapiens
  misc_feature: GYAE6OF01CUWQ1.45.79.H02.1.454.CMB.1.raw
  modified_base (620)..(620): a, c, t, g, unknown or other
  misc_feature (620)..(620): n is a, c, g, or t
  modified_base (628)..(628): a, c, t, g, unknown or other
  misc_feature (628)..(628): n is a, c, g, or t
  modified_base (816)..(816): a, c, t, g, unknown or other
  misc_feature (816)..(816): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctcgggcccagtctgccctgactcagcctgcctccgtgtctgggtcctccgtggacagtcgatcaaccagtggcctgactaacgtacggaaacccaaagaggtagtagttgggtttaggggtttagttttttacggtttttcgccttaccgttacggtaaaccccaaaccgaaacccgaccccgggacgaaaacccgtaacccccaaaaattaactacgtaagtttaagaacggggaacctaaacgaacggtcccggtaccgttacggggtttaacaacggtccgttcctttcgtcgtaggtacctaccgtaaggttccgttacggaaacctaaacgtacgttcccgggaccctttacccgtaaggtaacccttaacgtttccgtacccggtggggtaacccccttcgaacggggttcctacggaacggggaccggaggtcctttaaggttaacttttacgttttcgacggtttnaaccgttntaagtacgtcggacggacgggtaacaggtcttaacggggtttgggttacgggaccggggtacggaacggggtaactggggttacccgaccgttacggtacgggacctaaccgggaccctaacgggcccgttccccggaccccgttttcggacctttaccgttccgttaccgtaccccgtacccgggtnaccggttcgg

SEQ ID NO: 35480 - DNA, 680 bp, Homo sapiens
  misc_feature: GYAE6OF01D79GI.45.79.H02.1.454.CMB.1.raw
  modified_base (250)..(250): a, c, t, g, unknown or other
  misc_feature (250)..(250): n is a, c, g, or t
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (379)..(379): a, c, t, g, unknown or other
  misc_feature (379)..(379): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacgacgggtccgtcgggcccagtctcgccctgactcacgcctcgcctccggtgtcgtcgggtcctccgtggactagtcgactccacctactcctcctgccacgtacggaaccngcagtgtgttggttaggtagttactacttcgtcctcgtacgaccacncgaccaccgagaccaaccgaccccaatnagtntagttgagaggacagtaccgccggtctagggtacgttacactcgtcttcngtcgtacctacgtacgtcgacctacgaccgtaccgccttaccagtacctatccgtacgtccggctcgcggacgtggacggacggtagtactagttactatcgtcgtctcgtactatacgtgtacgtacggtaaggttacggtttacggttacgggtttacgggtcgggtaccggggtacgggtaaccgtacggtacggtacccggtccggttacccgtaccgggttaccgacccgggtaaacccgtacccggtacgggttccccccgtacccggttccccgttaccggtcccgttaccccg

SEQ ID NO: 35481 - DNA, 803 bp, Homo sapiens
  misc_feature: GYAE6OF01ESRUB.45.79.H02.1.454.CMB.1.raw
tcagacgcgatcgacacgaccggtgctcgattttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcccttccgtgtcgtgggttcctccgtggacagtcgatcaccatctcctgcacgtaggaaccagcagtgagttggttaggattactaaccttgtcctcgtacggtaccaacacgccaccgaggaccaaccgacccccaaactcatgtattagaggaggcaggacgccgtcctggtagggttctacgtcgtcttctcgtcgtcctacgtacgtcgtacggacctaacgacccgtccttacccgacggtaactaaccgttcgttccggtccgggtcctacccgggtaggttacccgtagggaaccgggtaaccgggtcgggttacgttacgttaattttacgttaaccggtcgtccgttagtacccgtttgtaaacgtttcgttacgggtaacggtttaaggggtttaaccgggttttacggttttacccgggtttaagggtttaccggggttacccgggggaaaccgggggtttaaccgggaaaccccggttaacgggttaccccgggtttacccgggttaaccccggggttcggttaacccgggttaccgaacccggggtaaccccctacggggtacccccgttaccccccgggtaccccccggtttccgggtaccccttaacccccgg

SEQ ID NO: 35482 - DNA, 692 bp, Homo sapiens
  misc_feature: GYAE6OF01BYN0J.45.79.H02.1.454.CMB.1.raw
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (285)..(285): a, c, t, g, unknown or other
  misc_feature (285)..(285): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctcgggcccagtctcgccctgacctcagcctgcctcgtgtctggtctcgngacngcgatccacatctcctgccacgtacggaaccngacaggtgagttggttaggtattactaccttgtacctccgtacgtaacccaacnccgaccaccgacggaaccaaacccgacccccaaatctaagtacgtaatttacgagggacggtaacgacggtaccggcccggtaccgtacggttacggttactacgtccgtcttcgtcgtcgtcctacgtacgtcgtacgacccaacggtacccgtcccttacccgaagtaacctacgttccggttccggtccggtaccgacgggtacgtacggagggacgtacggtagtcgttagttaactttacgtacgtcgaccgttcgtcttacgtacgcgtacgtaccgacgtcaacgttactgtaccgtacgttacggtacggtaccgggagggaaccgggaaccgtaggccgtccgggttaccgtacgtaccggtcggaacccacccggaccgtcgtcccccggttccccg

SEQ ID NO: 35483 - DNA, 872 bp, Homo sapiens
  misc_feature: GYAE6OF01D5HTD.45.79.H02.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctcgccctgactcagcctgcctcgtgtcctgggtctcctggacngtcgatccaccatcctcctgacacgtacggaaccngcgagtgagttgggttaggtatttaactaaccttgtccctcgttacggaacccaacgtacgaccacccgtaaggaccaaaaccccgtacccccaaactcgaacgttagttaacgtttaggtacgggaacgggacgtaacgggtacggacccggtaccccgttaacgggttaccggggtttaacttaacgttccggttaccgtttccgtaccggttaccggacccgttaaccgtaaacggtttccggtaccgggtaacccgtaaacccggtccccgggttaccccttcccccggtaaggtaacccgttaacttccccggtaccggtccgggttaccccgtaccgggtacgggttaccggtacggggaacggtaacccgggtaaggttaccgttaagttttaacgtttaaccgttacgtacgtccgtttacgacccttaagtagtttaaccgtacgggtaacggttaacgggtttacggtttaaacggtttcgggttttacggggttccggttacccgggtacgggtaaccgggacccgtagggttacccggtaccggtacccgttacggtacccggtacccgacggtaacccgtaccggtacccgttcccccggacccggttcgtccccgttacccgg

SEQ ID NO: 35484 - DNA, 744 bp, Homo sapiens
  misc_feature: GYAE6OF01CE23I.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcgagcctgcctcgtgtctgggtctcgtggacagtcatcacatctctgcacgtggaaccagctagtgagttggttagggattactaccgttgtcctccgtacggtaaccaacgacgacccaacccgaacgaacccaaaacccgaccccccaaaatccaattacgttaactttaggacgggtacgggactaacggtaacggcccggtacccgttagggttaacgggtttacctaacgttcgttactttcgtacggtcgtcctaccgtaagttccgtacggaacctaaccggaccggtcccttaccgtacgaaccttacgtccgttcggtacggtccctaccgggagcggtacgggaacggacggacgttcgtagttaactttacgtacgtcgtccgtacgttacctaagttacttcgtaccgggtaaggttaacgggtttacgttacggtttcggtttcgggtacgggttacgggaacgggtacgtaaccgaacggttccggtaccggtaccggtacggtacgtacgaccggttaacccgtacggtcccctacccgggtccccgttggtcccgttccgg

SEQ ID NO: 35485 - DNA, 711 bp, Homo sapiens
  misc_feature: GYAE6OF01BLCL2.45.79.H02.1.454.CMB.1.raw
  modified_base (320)..(320): a, c, t, g, unknown or other
  misc_feature (320)..(320): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgaggtcctgggcccagtctgccctgactcagcctgcctccgtgtctggtctccgtggacagtcgatcacatctcctgcacgtggaaccagcagtgagtggttaggattaataaccttgtacctcctaggtaaccaacgacgacaacccgagaccaaacgacccccaaactcatagtatttagnggaggcaacggttaacgccgggtaccctacggtacgggtttactaaacgtccgtcctttactcgtacgtctaccgtaagtcgtacggaccaaaccgaccgggcccttaccctacgaactaactccgtaccgtcgggtcctaccggacgtacgtacgaacgggtaaccgacggtacgttagttaacgtttaacgtttaaccgtgtaccgttgtacctacgtaagttatacgggtacgtaagggtttaagttaacgtttaacgttttgggtacggtttacggggacggtaaagggaccctaaagggtccgttaccggacccggttaccgttacggaccgtaacgaccccggtaaaggtccctacccggtacccccgttcggtcccgtaacccg

SEQ ID NO: 35486 - DNA, 775 bp, Homo sapiens
  misc_feature: GYAE6OF01ECCCH.45.79.H02.1.454.CMB.1.raw
  modified_base (230)..(230): a, c, t, g, unknown or other
  misc_feature (230)..(230): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctgccctgactcagcctgcctcgtgtctggtcctcgtggacagtcgatcaccatcctcctgctacgtcggaaccngcagtgaagttggttggtaattacttaactttcgtccttaccgtcggtaccaacgacgaccacccgacggacaaaccgccccctaaactcacgtagttagtttacgtaggacgggtacaacgggtaacggaccgggtaccccgttcggttaacggggttttacctaaacgttccgttccgttttaccgttccggttcgggtacccttaccggtaacggtttccgttacggaccgtaaaccgtacccgggtacccctttacccgtaacggtaacctaaccgtttcccggtccggttaccgggtaccgtacccgagggtaccgttacgggaacggtaacggtacggtcgttaggttacttacgtttacgtcgtccgttcgtaccttacagttagtacgtacggttaacgggtttagttaacgggtttgtttcgggttcggtcgggacgggtacggtaccgtacggtccgttaccgggtacccgttcggtacggttacccgacgtacccgtacgtcccgtaccccgtcccgtaccgtccgttaacccg

SEQ ID NO: 35487 - DNA, 787 bp, Homo sapiens
  misc_feature: GYAE6OF01BV8U7.45.79.H02.1.454.CMB.1.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtcgtgggtcctaccgtggacagtcgatcaccatctcctgcactggaaccngcagtnagtgtggattactacttgtctcgtagtaccaanagaccaccacggacaaaccgtaccccaaatcatagtacttanaggacggtacaaggtaacgccggtccctagtaacgggtttccacgtagtccgtcttcgtcgtcggactacgaagttcgtacggacctaacgtaccggtccctaccgtacggaacctacgttccgtccggttacgggtacccttccggaacgggttacccgtaagggtaaaccgggtaacggtacggtaccgttaagtaacgttttaaacgtttaccgtggttaacccgaagtaacccgtaacgttaaacgtttaaccgtttaaggtttaacggtttaccggtttaaccccggttaacgggtttacccggggttaaggttacccggggtaaccggggtaaacgggtacccccgtttaaaagggttcccggtaaacccggttacggtaccgggttaccaaacccgggtacccgtaaacgggtccccgtttacccgggtaccccccgttacgggtttccccgtacccggtttcccccgg

SEQ ID NO: 35488 - DNA, 908 bp, Homo sapiens
  misc_feature: GYAE6OF01BLFXL.45.79.H02.1.454.CMB.1.raw
  modified_base (219)..(219): a, c, t, g, unknown or other
  misc_feature (219)..(219): n is a, c, g, or t
tcagacgcgatcgacacgaccggtgctcgatttagtgtcacacgaagggaaaggggggggtcacaagaggcagcgctctcggggacgtctccaccatggcctgggctctgctgctcctcactctcctcactcaggacacaggatcggtgggcccttttctcgccctgacctcagcctgcctccgtgtccgtgggtcctccgtggactagtcatccactntcctctgactacgtcggaaccaggcagttgtagttgggttacgggtaatttaacgttaaccttcgtccttaccgtacggtaaccaactcggacccaacccgtaacggaacctaaacccgaaccccctaaaactcgtaattacgttaacgtttagacgggtaacgggaaccgtaacgggtaaccggtacccgggtacccggtttaaccgggttacgggtttttaaccttaacgttcccggttaccgtttaccgtcggtttaccggtacccgttaccgtaaggtttccggttacggaaacccgtaacccggtaccccggtcccccgtttaaccgttacggaaaccctttaaccgtttcccgggttaccgggttaccggggtccccgtttaaaccgggcgggtaacccggttacgggaaaaccggggtcctaacgggtttacggttacgtttaaaacggttttccttacgggtcgttaccgttaccggtacttaaccgttacgtaccggttacggttaacggttaccggtttaaggtttcgggttttacggttccggggtttacgggtaaccggggaggtaaccggttaccggtaaaccgcggttacccgggtttaaccggcgtttaaccgggaccgtcccggtaacccggacgttccccggtaacccgttccgtaccggtccttaccccgg

SEQ ID NO: 35489 - DNA, 860 bp, Homo sapiens
  misc_feature: GYAE6OF01BPURK.45.79.H02.1.454.CMB.1.raw
  modified_base (491)..(491): a, c, t, g, unknown or other
  misc_feature (491)..(491): n is a, c, g, or t
tcagacgcgatcgacacgaccggtgctcgatttagtgtcacacgaagggaaagggggggtcacaagaggcagcgctctcgggacgtctccaccatggcctggctctgctgctcctcactctcctcactcaggacacgacgggtcctcgggaccctagtctcgccctgtaacctcacgtcctcgtccttcgtacgttcgtcggtcctccgtggactagtcactccacctactccgttcctcgacctacgtacggaaccagctagtcgtagtcggttaggtactttactacttgtacctcgtacgaaccactcgaccaaccgagacctaaccgaccctaatactacgttcgtattacggaggacggtactacggtaccgccggttcgttaacgggttacgttactacggttccttacgttcgtccggtaaacgtccgtaacgttaaccgtcgtaccgtaaccgaacccgggtacccggtccttacccggtaanaaacccgtttccttcggtccggtaccggtccgttacggaccgttacgggtaagggtaacgcgggttacgttacgttaaagttactttaacgtacgtcttaccggtacttacgttaacgtaacggttccgtaagggttaacggttaacggtttacggtttaccgggtttttacgggttaccgggggtaaggggtccggggttaaaaccgggtaaaccggttacggtttaaacccgggtccggtttaaccccggggtaccccgtttaaacggggtcccgggtaaaccccgtaacggggttacccgttaaacccgggttaccccggtccccccggtttaaaccggttcccgttaacccgttttaaccccggg

SEQ ID NO: 35490 - DNA, 683 bp, Homo sapiens
  misc_feature: GYAE6OF01BZGNY.45.79.H02.1.454.CMB.1.raw
tcagacgcgatcgacacgaccggtgctcgatttagtgtcacacgaagggaaagggggggttcacaagaggcagcgctctcgggacgtctccaccatggcctgggctctgctgctcctcactctcctcactcaggacacagggtcctgggcccagtctgccctgactcagcctgcctccgtgtctgggtctccgtgacagtcgatcaccatctccgtgcacgtggaccagcagtgatggtggagttactaaccttgtcctccgtacggtaccaacacgaccacccgaggaccaaccgaccccccaaactcactgtattgaggaggcaagtacgccgtcctggtacgggttctagtcgtcttctcgtagtcctacgtaacgtcgtacggactaacccgacccggtcccttacccgacgaactacttcgtaccgttcggccctaccgtggaccgtagggacggacggagtacgttagtatttacgtacgtgccgttcgtactactagttcgtacggtacgttagggttacgtttacggttacgttttgggtacccgggttacggggacccgggttagggaccctaacggtccggttaccgtacccggtaccgttccgggacgacccggtaaccccggaacgggttccccgttacccccgggcccgttacccgtccgttaccccggg

SEQ ID NO: 35491 - DNA, 756 bp, Homo sapiens
  misc_feature: GYAE6OF01EI6O4.45.79.H02.1.454.CMB.1.raw
  modified_base (240)..(240): a, c, t, g, unknown or other
  misc_feature (240)..(240): n is a, c, g, or t
tcagacgcgatcgacacgaccggtgctcgatttagtgtcacacgaagggaaaggggggggtcacaagaggcagcgctctcgggacgtctccaccagtggcctgggctctgctgctcctcactctcctcactcaggacacgagggtcctgggcccagtctcgccctgactcagcctgcctcgtgtcgtcggtctccgtggacagtcgatccaccattcctcgtgacctaacgtcggaaccngacagtgagttgggttaggtatttaacttaaccgttcgttccttccgtacggtaacccaaaccaacccgtacccggacgaaccgaaccccctaaataattactaagtttaagacggaacaacgtacggcccggtaccggttcggggtttacaacgtccgttcttacctcgtgtaccctacgtacgttccgtcggtacaaccgacgtcccctacgtacgactacgttcgtcggtcggtcctaccgtaggtacctacggaacggtacgagtcttagttactttactttgtacggttcttcttacgtcttacgtcgacgaacggtctacggtaaccgttgggttacgggttcgggttaccgggagggtaccggtacggtacgggttacccggtacctaccggttagaccccggacggtaaccccgggtacgttcccggtccccgtccccgggtttaccggtacccgttcccgtttacccggttaccccgtttcccccgttaaccccgtcccggttaccg

SEQ ID NO: 35492 - DNA, 712 bp, Homo sapiens
  misc_feature: GYAE6OF01CLKON.45.79.H02.1.454.CMB.1.raw
  modified_base (209)..(209): a, c, t, g, unknown or other
  misc_feature (209)..(209): n is a, c, g, or t
  modified_base (249)..(249): a, c, t, g, unknown or other
  misc_feature (249)..(249): n is a, c, g, or t
  modified_base (327)..(327): a, c, t, g, unknown or other
  misc_feature (327)..(327): n is a, c, g, or t
tcagacgcgatcgacacgaccggtgctcgatttagtgtcacacgaagggaagggggggtcacaagaggcagcgctctcgggacgtctccaccatggcctggctctgctgctcctcgactctctcactcaggacacgagggtcctgggcccagtcctagccctgactcagtcctgcctccgtgtctgggtcctcctaggaccagtccganccaccattcctcctagcctacgtcggaacccagcaagttnagttggtggattataccgttgtctccgtggtaccaacacgtcaccgaggtacaaccgccccaaactcagtgactttanggacggcaaggtaggccgtccgtacgtaggggtttcaacgtccgtctttcgtcgttcgaccttaccgaagttccgtacgggaccaaacccggtccggtaaccccgttccccgtaacggtaccctaaacgttcccgttaccgtccggggtaccctcccggtaacggtccgttagggacggtaaccggaggtaccgtagtactttaacgtacgtgtcgtatactacattacgtacgtacgtacggttacgttacggtttacgtttaagggttcgggttacccgggaggtaccggaaccggttaaccgccgttacgggtacccgttacccgtaagttcccggaaactcccgaaacgtcccgtaccgtcccccgtcggtaccttccccg

SEQ ID NO: 35493 - DNA, 927 bp, Homo sapiens
  misc_feature: GYAE6OF01CHLPP.45.79.H02.1.454.CMB.1.raw
  modified_base (196)..(196): a, c, t, g, unknown or other
  misc_feature (196)..(196): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacgagggtcctgggcccagtctgccctgactcagcctgcctccgtgtcgtggtcctccnggacagtcgactccacctatcctcctgacctacgtacggaaccagcagtagtagttgggtagggtagttaacgttaaccgtttcgtccttccgtacggtaacccaaacgacgacccaaccgaacggaccaaaaccccgacccccaaaatacgtagttacttagtttacgacgggaacggtacgtaacggtaccggccggtacccgttacgggttaacgggttactaacgttccgtctttcgtacgtacggaccctacgtaacgtcgtacggaccgaaccgtccggtccctaccgtagtacctacgtccgtacgtacgggtccgtacggacggtacgtacggacggtaacggtacggtacgttacgttaacgtttacgttacgtttacgtacgtacgttaccgttaacgttaacgttacggttacgggtaacgggtttaacggggtttaacggttttaaacggtttttaccggggtttacggggttttacggggttaaccgggggttaaccgggggtaaacccggggtaaaccggttaacccggttaccccgggttaaccccggggtttacccgggttttaaaccccccccccgggttaacgggggttaaacccccgggttaacccccgggttaacccggggttaaaccccggggttccccccggttaaccccccgggtttaccccccgggtttaaccccgggtttaacccccggtttaacccccccggggg

SEQ ID NO: 35494 - DNA, 706 bp, Homo sapiens
  misc_feature: GYAE6OF01CNU1B.45.79.H02.1.454.CMB.1.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggcacgaggtcctgggcccagtctgccctgactcagcctgcctccgtgtctgggtctcctggacagtcgatcaccntcnctgcactgaccagcagtnagtgttggattatacgttgtctccgtagtaccaacagacaccctaggacaacgaccccctaatcactagtatttangacggctagtaacgacgtcccgtgtagggttcaacgttcgcttctcgtcggtctccgtaagtcgtggaccaaccgtccgtaccctcccgtagaacctaacttccgttccgtaacgggtcccttacccggacgggtacgttacgggaagggacccgtaaggggtcccttagggtactttaaacggtttaccgtcggtacctttacggttaccttaccggtaatttacgtacggtaccgttagggttaaccgtttaacgggttttgtttaaccggttcggggttacggtacccggggtacgggtaaccgtagtacccggttcgtaacccggtcggttaaccggaccgtaaccgccccggttaaagggccctaccggtaccccccgttgggtaccccttacccgg

SEQ ID NO: 35495 - DNA, 731 bp, Homo sapiens
  misc_feature: GYAE6OF01AIOKC.45.79.H02.1.454.CMB.1.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggtggattataaccttgtctccgtggtaccaacacgccacccgaggaccaaacgcccccaaactcatgatttatggacggtcaaggtacgccgtcctcgtacgggtttctaacgtcgtcttacgtcgtacggtcctaccgtaagttccgtaggaccaaccgtacccgggtcccttaccccgtagtaaacctaacgttccgtacggtccggggtaccttcccggaagggtcccgttagggaacggggtacggtaacgggttacctaggttaacttttacgttaaccgtcgccgttacgtcctacgtaacgttacgtcggtacggttaaggggtttaacgttacggttttacggttttcggggttacgggttaccggggacgggtaaccgggtaccgttaacgggttccggtaacccggttccggttaacggtccgaaccggtacccggaaggtccccgttcccggaccccccgttggttaccctccgtttaccccgg

SEQ ID NO: 35496 - DNA, 739 bp, Homo sapiens
  misc_feature: GYAE6OF01CS2LL.45.79.H02.1.454.CMB.1.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (422)..(422): a, c, t, g, unknown or other
  misc_feature (422)..(422): n is a, c, g, or t
  modified_base (483)..(483): a, c, t, g, unknown or other
  misc_feature (483)..(483): n is a, c, g, or t
  modified_base (617)..(617): a, c, t, g, unknown or other
  misc_feature (617)..(617): n is a, c, g, or t
tcagacgcgatcgacacgaccggtgctcgatttagtgtcacacgaagggaaagggggggtcacaagaggcagcgctcgtcgggacgtcctccaccatggccgtggctctgctgctcctcactctcctcacctgagacacgtaggtcctggccctagtctcgtccctagacctcgacgtccgtcgcccgttccgtcgttaccgtcgggttcctcccgtaggaccgtaacggtcgaactccacctacgttcccttcgcgaccgtacgtacggaaccngcgtagtgagtggttaggtacttactaccgttntccgtacgtagaaccagtcgccaacgtacgacctaaccgacctaatgagttatacgttagacgacggtactacggacgccgttacgtagggttacgttacacgttcgtaccgtnttacgaccggttcaaccgttaggcccgttacggaacgtacccgtaaccggtccttaccggnttaaacccgcggttcgtacggtcggctacgggtgaccggtacggacgtacgacgtattacggtattacgtcgcgacgtcgaagttacaagttctaggaaccgttggttaacgttacggttcggtttaaccgggnggtaccgtaaccggggtaccaccgttaacggtccggttcccgacgggttaccgtaccgggtacccaaccggtcggtaaccccgtcccggtaacccttaccccgttgttacccggtaaccccg

SEQ ID NO: 35497 - DNA, 583 bp, Homo sapiens
  misc_feature: GYAE6OF01C8DMU.45.79.H02.1.454.CMB.1.raw
  modified_base (214)..(214): a, c, t, g, unknown or other
  misc_feature (214)..(214): n is a, c, g, or t
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
  modified_base (404)..(404): a, c, t, g, unknown or other
  misc_feature (404)..(404): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggcacagggtcctgggcccagtctgccctgactcagcctgcctccgtgtcctgggtctcctggacagtcgatccaccatccncctgcactggaaccagcagtgatggttcggattactaaccttntctctggtaccaacagcaccagaccaagccccaactcatcattatggaggnagtagcgcctcgtaggggttactaatcncttctcgtggtcctactagtcgtgtacaacgcggtccctccgtcgactactctacgtcggactaccgnggctggagacggtaggtctgaattacgtctacgcgttacgtctacacgtatgaccgaggttacgttaggttactttgggttcggttcggtacgggaacggaccgtacggtccgtacgtaccggtaccgtcggtaccgacggtacccgacggacccgtaccgcccccgtggtccctaccg

SEQ ID NO: 35498 - DNA, 908 bp, Homo sapiens
  misc_feature: GYAE6OF01ENHUU.45.79.H02.1.454.CMB.1.raw
  modified_base (132)..(132): a, c, t, g, unknown or other
  misc_feature (132)..(132): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactnaggacacagggtcctcgggcccagtctgccctgactcagcctgcctccgtgtctgggtctccgtggacagtcgatccaccatcctcctgcacgtagaaccagcagtgagttggttgggaagtttaacttaaccgtttgtcctccgttacggtaaccaacgacgaccacccgaacggtaccaaacccgacccccctaaactcctaattaggttacttttaaggacgggtacgggactaacgggtaacggtacccgggtaccccgtttacgggttaaacgggggtttttacctaaacggtttccccggttccgtttccgttaccggttaccggtacccgttacccgtaaacggtttcccggtaaccgggtaacccgaaacccggttacccggtcccccgttaacccgttacgtaaacccgtaccgtttacccttccgggtaccggggtcccttacccgggagggtaccggttacggggaacgggtaaccgggagggttccttaacgggtttactttaacgttacgttacgtacccgttcgtacctaacgtaacgttacgttacggttaacgggttaagggtttaaccgtttacgggttttaccggtttacggggttaccgggttacgggggtaaccggggtaacccgggtaaccgtaacgggtaccgttacccgggttacccggttacccgggttacgggtaacccgacccgggtaaccccgttaaccggtcccgttaacccccgggtcccccggtttaccgggtcccttacccccgg

SEQ ID NO: 35499 - DNA, 892 bp, Homo sapiens
  misc_feature: GYAE6OF01DOLFW.45.79.H02.1.454.CMB.1.raw
  modified_base (175)..(175): a, c, t, g, unknown or other
  misc_feature (175)..(175): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactcctcctcactcacggacacgacgggtccgtgggcccagtctcgccctgactcncgcctgccctcgtcgtcgtcggtcctccgtggacgtagtcgactccacctactcctcctcgccacgtacggaaccagcgtagtgtagttgggttaggtaacgttaacgttaccttcgttaccgtccgtaacggtaacaaccgacgacccgaacccgtacgaacccaaacccgacccctaaactcgtaagttacgttatttaggacggacgggacgaacggttaaccggcccggtaccgttacgggtttaacgggtttacctaaccttcggttaccttccgtacgtacggtacctaccggtacgtccgtaccggtaaccgaacccggttacccgtccccgttaccgtaccgtaaacgttaccgttccggtaccggttaccggacccggtaccgggtaccgtacgggtaaccgggaaccgggtaaccgggtaacgggttaccgtttaagtttaaccgttaccggttaccgtaccggttcctacggttaccctaaggttactttacggttaacggtaacggtttaaggggtttacggtttacgggttttagggtttacgggggttacggtaccgggggaaccgggtaaccgggaaccgttaacgtaccggtaccgggttaaccggttaacccgggtaccggttccggaacccggtacccggttacccggttaccccggtaccccgggtttacccccggtacggttccccggttaaccccg

SEQ ID NO: 35500 - DNA, 837 bp, Homo sapiens
  misc_feature: GYAE6OF01D4OB7.45.79.H02.1.454.CMB.1.raw
  modified_base (218)..(218): a, c, t, g, unknown or other
  misc_feature (218)..(218): n is a, c, g, or t
  modified_base (361)..(361): a, c, t, g, unknown or other
  misc_feature (361)..(361): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctcgccctgactcagcctgcctcgtgtcgtgggtctccgtgacagtcgatccaccatcctcgngaccacgtacggaaccagactaggtagtagttgggttaggaagtttaactaccgttgtcctaccgtacggtaaccaacgcgacccaaccggaacgaacccaaaaccccgaccccctaaaatctaacgtagttaactttacggnggtaacgggacgtaacggtaacggtccccggtaaccgtttacgggttaacgggttttaactaaccgtccgttaccttttaccggtacgtccggtacccttaccggtaagtccgtaacggaaccgtaacccgacccggttccccttaaccgtacgtaaaccttacgttcccgttacgggtaccggtacccgtaccggacggtacggtacgggaaacgggtacggtacggttaaccttagtttaaacgtttaaccgttacgtccgttaccgtcgtacttactaacgttagtacgggtaacggttaagggtttacgtttaacggttttacgggtttcgggttaccggggaacgggttaaccggggaaggtaaccccaggttacccgtacccgggttaccgttacggttacgacccgaaacccggacccggttacgtcccccggtaacccgttccccccggttagtccccgttaaccccg

SEQ ID NO: 35501 - DNA, 729 bp, Homo sapiens
  misc_feature: GYAE6OF01DZZFN.45.79.H02.1.454.CMB.1.raw
  modified_base (558)..(558): a, c, t, g, unknown or other
  misc_feature (558)..(558): n is a, c, g, or t
  modified_base (718)..(718): a, c, t, g, unknown or other
  misc_feature (718)..(718): n is a, c, g, or t
tcagacgcgatcgacacgaccggtgctcgatttagtgtcacacgaagggaaagggggggtcacaagaggcagcgctctcgggacgtctccaccatggcctgggctctgctgcctcctcactctcctcactcaggaccacgagggtcctgggcccagtctgccctgactcagcctgcctcgtgtctgggtctccgtggactaggtcactcacctatcctcctgaccacgtaggaaccagctagtgatgttacggattactaacgttcgtctccgtaggtaccaacacgaccaccacggacaaaccgaccccctaaactccaagtacgtaatttacgtaggaacgggtcgtaacggtaacgaccggtccccttacgggtagggttttaccttaaacgtcggttctttacctccgtaggtcctacgtaacgtcgtaccggaactaaccgacccggtccctcccgtaacggactaacttcgtaccgtacggtacctaccgtcggtacgttacggacgggaacgacggtaccttagttaatttaccgttactcggtccggttntcccttaaggtacttaaggaccgttacggtaagtttacgggttaaccgttttgggtttaccggttcggttacgggtaacgggaaccgggttaccgacggtacgtccgggtaccgtacggttccggactccgacccgtacggcccgtaccttacccccggngtaccgtcccg

SEQ ID NO: 35502 - DNA, 729 bp, Homo sapiens
  misc_feature: GYAE6OF01CZMAA.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcgaggaccacgacgggtcctgggcccagtctgccctgactcagcctgccctcgtgtctgggtcctccgtggacagttcgatccacctatcctcctgcacgtcggaacccaggcaggtcgagttgggtaggtaattacttaccgttcgtcctaccgtacggtaacccaacacgtaccgacccgaacggaaccaacccgaccccccaaatctaacgttagtactttacgaggacgggactaacggtaacggcccggtacccgttagggttacgggtttacctaacgttccgttccttacgttcgtccgggtaccttaccgtaacgttccgtacggacctaaaccgcccggttaccctccgtaagtacctacgttccgtccgtacggcctaaccggtggacgtaggacgggaacggtacgcgttacggtaactttaacgttcgtacggtccttgtacctagtagttacgtggtaacgttagggttacgttacggtttacggttggtcggtacggcgggtaacggacctagggtcctaccggtacggtccgttaggcctaaccgtccggtaccgtcctaccccggcccctggtcccttacccg

SEQ ID NO: 35503 - DNA, 827 bp, Homo sapiens
  misc_feature: GYAE6OF01C8FKX.45.79.H02.1.454.CMB.1.raw
  modified_base (321)..(321): a, c, t, g, unknown or other
  misc_feature (321)..(321): n is a, c, g, or t
  modified_base (536)..(536): a, c, t, g, unknown or other
  misc_feature (536)..(536): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctctactctcctcactcaggacacgtagggtcctcgggacccagtctcgccctgactcgacgcctcgcctcgtgtcgtcgggtctcgtcgacgtgtacgactccaactctcctaccgtcgactacgtacggaaccagcgtaggtagtaggttggttagggtaacttaaccgtttaccggttgtcccgttcggtaaacgtaacccanaccggccaaacccggaggaaacccaaccccgaaccccctaaagtccgtaagttgttaactttaggacgggtacggacgtaaccggtaaccggtccggacccgttaggggtttaacgttaccgtaaccttccgtctttcctaccggtcgtaccttaccgtaacgggtcgtaccgggtaaccctaaaccccgggtaccgtccccttaaccggttaanaaacccggtctttacccggttacggtcccgggtacgtaaccggagtacgttagggaaaccgtcggtaggtaacttacggttacttaacgttcgcggtactcgtactagttaacgtcggttaacgggtacgttaacgggttaggtttaacggtttcgggttacggtacgggtttaaccggggcggtaaccggtaccgggtactaccgggtaacccggttaccgtacggttcccgaccggaccggtaccgtaacccggcccgttacccggtcccgttcgtcccggttaccccg

SEQ ID NO: 35504 - DNA, 561 bp, Homo sapiens
  misc_feature: GYAE6OF01EXOD5.45.79.H02.1.454.CMB.1.raw
  modified_base (245)..(245): a, c, t, g, unknown or other
  misc_feature (245)..(245): n is a, c, g, or t
  modified_base (537)..(561): a, c, t, g, unknown or other
  misc_feature (537)..(561): n is a, c, g, or t
tcagacgcgatcgacacgaccggtgctcgatttagtgtcacacgaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcctaatacgtattactttgataggtaggggttnttttgatattcgtggggaccgaaggacaattggtccaccggttctcgttacacgccctacccgaccgaacgggcccctagtccggttcccttcccccgtcggcccctaccccgtcccgtaccaaacggaccgccctaccgtccggtcgggggaccaaccgtaggccccggtcccgtcggggctccggcccgttagggaccgaaacggtacctttaacccgttccgtacggtactccggtccggtacgtcggacggggtcggaccggtggacggtacggcgagtaacgtagcnnnnnnnnnnnnnnnnnnnnnnnnn

SEQ ID NO: 35505 - DNA, 634 bp, Homo sapiens
  misc_feature: GYAE6OF01EJC0R.45.79.H02.1.454.CMB.1.raw
  modified_base (227)..(227): a, c, t, g, unknown or other
  misc_feature (227)..(227): n is a, c, g, or t
  modified_base (265)..(266): a, c, t, g, unknown or other
  misc_feature (265)..(266): n is a, c, g, or t
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccatcctcctgcatggaaccngcagtgattggtggattactacttgtctcgtgtacacnncaccagacaacgccccaaatcatgtattacgnggaggacagtacgccgtcctagtaggttactagtcncttctcgtcggctccgaagtcgtacggaccaaccgaccggtcccttaccgtcgaactaacgttccgtacggtcgggtccctaccggacggtacgttagggaacggaacgtacggtcttagttaactttaccgtacgtcgtcgtcgtacctataacgtatacggtagttacgggtttaaggttacggtttacgggttttcgggttaccgggttcgggaccgggaacggtaccgtaacgtccggtacgtaccgttacggtacggtcacgacccgcgtacccgtcccgcccgttcgcctcccg

SEQ ID NO: 35506 - DNA, 633 bp, Homo sapiens
  misc_feature: GYAE6OF01AS1JG.45.79.H02.1.454.CMB.1.raw
  modified_base (211)..(211): a, c, t, g, unknown or other
  misc_feature (211)..(211): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
  modified_base (429)..(429): a, c, t, g, unknown or other
  misc_feature (429)..(429): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatccaaccngtcctccgtgcctacgtcggaaccaggcagtgacgttggttgggaattactaaccttcgtcttccgtcggtaccaacncgaccacccaggacaaccgacccccaaactcatgtatttanggacggnagtacgccgtcctacgtcgggttntaatctacttctcgcgctcagtcncgacacgaccgcctcctcgtaactacgtctacgtcggctaccgnggcctaggacggacggactgtacggtattattactcgtactagtactacgtattacgtcgacggttaaggttagttagtttacggttttaggggttcgtacggggacgggtacgaacgaccggttcctcggttacccgttacggtacggccgtaccggaacccgtaccgtcccgtacccgttccccgtaccgttccgttacccg

SEQ ID NO: 35507 - DNA, 806 bp, Homo sapiens
  misc_feature: GYAE6OF01CHLPW.45.79.H02.1.454.CMB.1.raw
  modified_base (166)..(166): a, c, t, g, unknown or other
  misc_feature (166)..(166): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacaggtcctgggcccagtctgccctgactcngcctgcctcgtgtctggtctccgtggacaggtcgatcacctatcctccgtgccactcggaaccagcagtgtagtggtggattactaacgttgtactcctagtaccgaacacggaccacccaggaccaaaccgacccccaaactacgactacgtagtttagtcggaacggcgtaaggtaacggaccggtcccgttacgtacggggtttactaaacgtccgttaccttcgtccgtgtacccgttaccgaacgttcgtacggaccgtaaaccgtaccggtcccgttacccgtaaggaaccttaaccggttacccgttcggttacccgggtacccgttaccccggtaaacgggtcccggttaacggaacggggaaccggtaacgggttacccgtttaggtaacgtttttaacgttttccgtttacggtttacgtacccgttaacgttaagttacgttacggaacggttaaccgggaacccttaacggtaccgttaacgggtttcggggttaccgggttaccggggtaacgggttaccggggacccggttagggttacccggttacccggttccggttaacggttccgtaaccgtacccggtacgtccggtaacccgtccccgtcgttaccctacgtttccccgg

SEQ ID NO: 35508 - DNA, 865 bp, Homo sapiens
  misc_feature: GYAE6OF01ARAUZ.45.79.H02.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (521)..(521): a, c, t, g, unknown or other
  misc_feature (521)..(521): n is a, c, g, or t
  modified_base (558)..(558): a, c, t, g, unknown or other
  misc_feature (558)..(558): n is a, c, g, or t
tcagacgcgatcgacacgaccggtgctcgatttagtgtcacacgaagggaaaggggggggtcacaagaggcagcgctctcgggacgtctccaccagtggcctgggctctgctgctcctcactctcctcactcaggtacacgagggtcctgggcccagtctgccctgactcacgcctgcctcgtgtctgggtctcggnggacagtcgatcacctgtcctccgngcgtactcgggaaccngcgtaggtgagttgggttaggggtaactttactaaccgttcgtaccttccgtacggtaaccaacgtacggccaacccgagggaccctaaaacccggaccccctaaaagtccaagttacgtaagtttacgacgggtaacggggtactaaacgggtaaccggtcccgggtcccgttacggggttaacggggtttacctaaccgttccggtacctttacgtcggtacgtaccgttaccgtaacggtcgtacggaaccgaaccgtcccgggtacccctaccggttanaaaccgttactccgttaccggtaccggcgttacccgnggttaccggtacggaaacggggtacgtacggtacgttaggttaaaccgtttagttaccgtcggtaccttcgtaccgtaacgtaggttacgtacggttacccggtaaggtttacggtttacggtttaacgggttttacggggttcgggttaaccggggtaaccggggtaacggtaaccccggtaacgggttccggtttaaaccccgggtaccccgtttaccgggttacggtaccccggtaccgggaaaccccgtttacgggtccccggttaaccccgtcccccggtttccgtaacccggttacccccg

SEQ ID NO: 35509 - DNA, 749 bp, Homo sapiens
  misc_feature: GYAE6OF01BDC6N.45.79.H02.1.454.CMB.1.raw
  modified_base (137)..(137): a, c, t, g, unknown or other
  misc_feature (137)..(137): n is a, c, g, or t
  modified_base (170)..(170): a, c, t, g, unknown or other
  misc_feature (170)..(170): n is a, c, g, or t
  modified_base (438)..(438): a, c, t, g, unknown or other
  misc_feature (438)..(438): n is a, c, g, or t
  modified_base (536)..(536): a, c, t, g, unknown or other
  misc_feature (536)..(536): n is a, c, g, or t
tcagacgcgatcgacacgaccggtgctcgatttagtgtcacacgaagggaagggggggtcacaagaggcagcgctctcgggacgtctccaccatggcctgggctctgctgctcctcactctcctcacttcgaggacncgagggtcctgggcccagtctgaccctgactcngcctgcctccgtagtctggtctccgaggacagtcgatccacctattcctccgtgaccgtaacgtcggaaaacctgactaaggtggtaatttgggttccggggtaatttaactaaccgtttcgttacgttccgtacgtaaccgaacgaacgaccgtaaccgaacggaacaaacccgtaccccgaaactaccaagtagttactttaggaggacgggtacaacggtacgccgtaccgtacgttacggggttaactaacggtcctcgttacncgttagggtcctaacgtacgtccgtaggaccaaccgtaccgtacctccagtaccctaatcctacggtcgccgtacgtacggtacgaggtacgggtaanacgggtacttaacgttagttacgttaacggtcgtcgttacgacctttacgagttacgtggtaaccggtaacggtttaacggttaagttttcgtttccgggggtatttacggggacggttacggtaccgtacgggtacgtaccgggttaccgtacgtaccgttaccggaacgttccggaacgtcccggtacccgacccggttgtcccgtacccg

SEQ ID NO: 35510 - DNA, 863 bp, Homo sapiens
  misc_feature: GYAE6OF01BT9GR.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgccctccgtgtctgggtctccgtggacagtcgatcaccatcctcctgcacgtggaaccagctagtgtaagtggttagggtattacgtaaccttcgtccttaccgtacggtaacccaacacgtaccaccccgaacggtaccaaacccggtacccccctaaactaccgtaagttacgttaacgtttaacgtacgggtaacggggtaacctaacgggtaaaccggccccgggttaccccgttaccgggtttaacggggttttacccttaaacggttccggtacctttccgttccggttacgggtacccgttaacccgtaaacggtttccggttaccgggaaccctaacccgggtaccccggtaccctttaccccggtaacgtaacccgttaacgttcccgttaccggtacccggggtacccgttaccccgggtacggttaccgggtaacgggaacgggtaaccgggtacggtacgttaacggttaacgttttaccgtacggttccggtacttcggttactaccgtaagttcgacgggttacgtaacgggttaggttacgtttcggttgggttacgggtcggggtacccggaacgggtaaccgtaggtaccggtaccggtcccggttacgtacgggtaccgacccggacccgtacgggtaccctaccccggttccccgtcggtaaccttccccgg

SEQ ID NO: 35511 - DNA, 726 bp, Homo sapiens
  misc_feature: GYAE6OF01CFFRN.45.79.H02.1.454.CMB.1.raw
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (702)..(702): a, c, t, g, unknown or other
  misc_feature (702)..(702): n is a, c, g, or t
tcagacgcgatcgacacgaccggtgctcgatttagtgtcacacgaagggaaaggggggggtcacaagaggcagcgctcgtcgggacgtctccaccatggcctgggctctgctgctcctcactctcctcactcaggacacgaggtcctgggcccagtctgccctgactcagcctgcctccgtgtccgtgggtcctacgtcgactgtcgatccaacctntcctctagctaacgtacggaacctagcagttgagttaggttgggtaattactacgttntccgtcgtcgtaacacgngaccaccgacgaaccaacccgtcccccaaaatctagtaccgttagtttacaggggtaacgtcgtaaaggtccgaccccggttaccctggggttaaacggtttctaaccgttccggtcctttaccggtcgtccgtaacgacccttaaggtccgggttacgaccgaccggtacgttccctaaccggtgtaaaccttcgttcctaccggtcgtaccgtaccgtacggtagtacgggaaggtaccggccgttagtacgttaaactttacggacgtcggtacctacgtcgtaactgttacgaggtctttaccgggtagtttaaccgttttgttacggggtccggtaaggccgggtaacgacggtacgacgtccggtacctacggtccggtaaccccgggtaccctacggtaccnccccgttaccggccttgtaccccg

SEQ ID NO: 35512 - DNA, 740 bp, Homo sapiens
  misc_feature: GYAE6OF01BN67N.45.79.H02.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctcgccctgactcagcctgcccttcgtgtcgtggtctcgnggacngtcgntcacntcctctgctacgtacgaacngcgagtgtagttaggtggtaatttactaccttcgttccttccgtacgtaaccaacgacgaccaacccgaggaccaaacccgaccccctaaatcgtaagttgttagtttagagggtaacggactaacgggtaacgcccggtccgttagggttacggtttacctacgttccgtaccgtttctcggtcggtaccctacgtaacggtcgaccgtaaccgtaacccgtccgtccctaccgtacgtaactaccgttcgtccggtcgggtccctacggacggtaccgtacggaacgggtacggtacgttacgttagtttactttacgtttcttaggtctacgttacgtagttacgcgacggaccgtacgtacgttcggttacgggttcgggtacgggtacgggcgggtaaccggttccggtaacgggttccggtaccggttaccggacggccgtaacccggaccggtaccggttcccgtacccggtccccggttacgtcccgttccggttcccccg

SEQ ID NO: 35513 - DNA, 755 bp, Homo sapiens
  misc_feature: GYAE6OF01DBBZW.45.79.H02.1.454.CMB.1.raw
  modified_base (119)..(119): a, c, t, g, unknown or other
  misc_feature (119)..(119): n is a, c, g, or t
  modified_base (184)..(184): a, c, t, g, unknown or other
  misc_feature (184)..(184): n is a, c, g, or t
  modified_base (339)..(339): a, c, t, g, unknown or other
  misc_feature (339)..(339): n is a, c, g, or t
tcagacgcgatcgacacgaccggtgctcgatttagtgtcacacgaagggaaaggggggggtcacaagaggcagcgctcgtcgggacgtctccaccatggcctgggctctgctgctcctnactctcctcactcaggacacgaggtcctcgggccagtctcgccctgactcagcctcgcctccgtntctgggtctctaggacagtcatcactatcgtcctgcactaggaaccagcagttgagtgttagggactttagtaaccttgtctcgtacggtaaccaacgacgaccaccgaaggaccgaaaccgaaccccctaaaactcaagttacgtacttttaanacgtagtacgtaccgtaagttaaccgtccgggtaccttacggttaacggggtttctaacggtacgttccggttccttacgttcgtaccggtaccttaaccgaaacgttcgtacggtaaccaaaccgtcccggtacccctacccgtaacgtaccccgtaagttcctacggtaccgggccttaaccggaccgggtaacgtttacgggtaacgggaacccggttaaggtccgttaaaggttaaactttaacgtttacgtacggttacaccgtaacgttaccgaacgttaacgtcgggacctaacggacctaagctaacggtccgtaactacggtaccggttagtacccggaacgggaccgaccgtaaggacccgttacgtaacccggttaactacggtacctaccggcccgtaaaccgg

SEQ ID NO: 35514 - DNA, 802 bp, Homo sapiens
  misc_feature: GYAE6OF01D7I7L.45.79.H02.1.454.CMB.1.raw
  modified_base (129)..(129): a, c, t, g, unknown or other
  misc_feature (129)..(129): n is a, c, g, or t
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
tcagacgcgatcgacacgaccggtgctcgatttagtgtcacacgaagggaaaggggggggtcacaagaggcagcgctctcgggacgtctccaccatggcctgggcttctgctgctcctcactctccctnactcaggacacgagggtcctgggcccagtctagccctgactcgacgtcctcgccgtcgtgtcgtcggtctcgtgacgacgtnactacacctactcctcctgcctacggtacgaaccgngcgtagtagtacgttggttagggtacttaacgttaccgttcgtccgtaccgtacgtaaccaacgtaccgacccgaaccgaacggaaccaaaccccgtacccccaaactctagtagtttaagtttacggaggtacgggaacgtaaggtaaccggtccccggtaccggttaacgggttacgggttttacaacggtccgttacgttactcggttacgaccttaccgtacgtaccgtacgaaccctaaaccggtccctaccgtacccgtagtaaccgtaacttccgtcggtcggtcctaacggtcggacggtacggaaggaccgtaggaccttacgttaaatttcgtaccgttctaccgtagtcctaagtacgttaacggtacggagtttaaacggttgggtttaaaccgttcggtttagggttaccgggtaccgggtaggtaacccgggtgaaccggtttacgtaaacccggttggtaacccggttcggaaccggtaccccgggtaaacccgtcggttaccccgcccccggttcccccgtagttacccgttaccccgg

SEQ ID NO: 35515 - DNA, 822 bp, Homo sapiens
  misc_feature: GYAE6OF01CIQLL.45.79.H02.1.454.CMB.1.raw
  modified_base (241)..(241): a, c, t, g, unknown or other
  misc_feature (241)..(241): n is a, c, g, or t
tcagacgcgatcgacacgaccggtgctcgatttagtgtcacacgaagggaaaggggggggtcacaagaggcagcgctctcgggacgtctccaccatggcctggctctgctgctcctcactctcctcactcgaggacacgaggtccgtgggcccagtctcgccctgactcagcctcgcctcgtgtcgtgggtcctccgtggactagtcgactccacctatcctcctgccacgtacggaaccngctagtgagtggttacggtattactaccgttgtcctcgtacggtaaccaagcgccaccgacggaaccaacccgaccccaatcatgtattgtggacgactaggacgccgtaccgtggtacggttactacgtcgtcttacgtcgtcgtctaccgagttcgacggacctacgcccgtcctaccgtaagtaacctgttccgtacggtccgtaccgtaccgtaggtaccgtaaggaccgggtacggtacggtacgtttacgttaacgtttaacgttccggtacgtcgtttaccgccgtttaacgtaaggttaccgtacggggttaacggtttaaacgggtttaacgggttttaaggttttaccggggttttacgggggttccgggttaaacccggggttaaccggggggtaacccgggtaaaaacccggtttccgggttaccccgggttaaaccccgggttaccccggggtttaacccgggtttaacccgggccggtaaaccccccggttcccgggtaaacccgggttccccccgttaccccccgggttaaccccgtttcccgggtaaccccttttaccccccggg

SEQ ID NO: 35516 - DNA, 858 bp, Homo sapiens
  misc_feature: GYAE6OF01CQZP9.45.79.H02.1.454.CMB.1.raw
  modified_base (229)..(229): a, c, t, g, unknown or other
  misc_feature (229)..(229): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctcgggcccagtctcgtccgtgactcacgcctcgtccttccggtgtccgtgggttcctaccgtggacaggtccgactaccaccnttcctaccgtcgactacgtacggaaccagcgtagtgtagtgggtaggtactttacgttaccttcgtccttccgtacgtaccaacgacgaccaccgaacggaccgaacccaaccccaaactcactagtactttacgacggtacggacgtaacggtacgccggtacccgttacggtacgggttactaaccgtcgttccgttacgtcgtcggtaccgttacgtaacgtccgtacggaaccgtaccgtacccggtaccctaccgttagaaacccgtaccttaccgttaccggtcccgggtacctacccgggtacggtccgtaacggggaacggtacggacgttcggtttaattacctttaactttaccggtcgttcccgttactaccttaaccgttaaggttacgttagggaaccgggttttaggtttaaacggttttaccggtttacggggttttacggggtttacgggggaacccggggttaacggggtaacccggtaaacgggtcccgttaaccgggtacccggttcccccggttaaagggttaaccccggaccggttaccccgggacccgttaacggggtcccccgttacccccgggttcccggttaacccgttcccggtttaaccccg

SEQ ID NO: 35517 - DNA, 694 bp, Homo sapiens
  misc_feature: GYAE6OF01APU7T.45.79.H02.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (434)..(434): a, c, t, g, unknown or other
  misc_feature (434)..(434): n is a, c, g, or t
  modified_base (501)..(501): a, c, t, g, unknown or other
  misc_feature (501)..(501): n is a, c, g, or t
  modified_base (516)..(516): a, c, t, g, unknown or other
  misc_feature (516)..(516): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcagacacgagggtcctgggcccagtctcgccctgactcacgtcctcgcccttcgttcgtcgtcgggtcctccgnggacngttacgactccacctactccgtcctcgaccacgtacgaaccagtcctagtgttaggttcgggttaggggtaactttacttaacctttgcccgtttcgtacgtaaccaacgtgtacccaccgtaagaacccaaaccccgacccctaaaacgtcacgttacgtattaccgaggtacggactagtaacggcccgtaccgtaggtacggtttactacgtctacctttcngttaacgtcctagtcacgtacgccacgtacccgccttaccgatacctactcgtcgtcgcctacgcgngtacgacgggtacgngtatacgtattacgtactcgtcctagtcnttanacgtagtacggtagttacgttacgtttcgtacgggttcggtacgggaccggtacgtacgtaccgtgtaccggtacctacggttaccggaccaaccgggtaccgttaaccggcccgtaccccgtacccggttccgcgtttacccgg

SEQ ID NO: 35518 - DNA, 880 bp, Homo sapiens
  misc_feature: GYAE6OF01E3169.45.79.H02.1.454.CMB.1.raw
  modified_base (163)..(163): a, c, t, g, unknown or other
  misc_feature (163)..(163): n is a, c, g, or t
  modified_base (239)..(239): a, c, t, g, unknown or other
  misc_feature (239)..(239): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactcctcctcactcaggacacaggatcggtcgggtcccttttcncgccccttgactcacgccttcgcccttcggtgtccgtcgggttcctcgtacggactacggtcacttccgaacccgngttccggcctggaccaccgtaacggaaaacccaacgtaggtgttaggttcgggttttagggttttaaggtttttttagttttccgttccttacccgttaacggaaacccctaaacccggaaaccccgtaacccccgggacgtaaacccgaacccctaaaagttactcgttaaacgttaaggacggactaaccggtaacggtccccggttaccgggtttcggggtttaacacggtccgttcgttaccgtcgtacgttacctacgaggttccggtaacgacccgaaccgtccgccctacctacgactacgttcgtccggtacggtctaccgtcggtacgtacggacggtaccggtacggttctacggttttagttttacgtttcggttgtttccgtacgttacgttacgttacgtaccgggacggaaaccgtcccgtacggttccgttaacggggtttggggtaccggggtacggggtacgggtaacccggttaccgggttagggttacccgacccgggttcgggtaccgtccggaacccggtcccgtaccgggtccccgtcccggccccggtttaccggtcccttaccccgtttccggttcccccgttcccccgttacccggttccccttcgccttcccggg

SEQ ID NO: 35519 - DNA, 641 bp, Homo sapiens
  misc_feature: GYAE6OF01E0N3O.45.79.H02.1.454.CMB.1.raw
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
  modified_base (429)..(429): a, c, t, g, unknown or other
  misc_feature (429)..(429): n is a, c, g, or t
  modified_base (488)..(488): a, c, t, g, unknown or other
  misc_feature (488)..(488): n is a, c, g, or t
tcagacgcgatcgacacgaccggtgctcgatttagtgtcacacgaaagggaaaggggggggtcacaagaggcagcgctctcgggacgtctccaccatggcctgggctctgctgctcctcactctcctcactcaggacacagggtcctgggcccagtctgccctgactcagcctgccttcgtgtcctgggtctctggacagtcgatcacgatcctcngcactgaaccngcagtgatggttaggattataccttgtctctaggtaccaancnccaccaggacctaaacgcccccaaatcatagtatttagnggacggacgagtaagccgtccctagtacgggtttactagtccgtctttctcgtgccttaccgaagttcgtacgggccaaaccgtaccggcctaacccggtgaaacctaacttcgtaccgnggtacctccgaggacctggaacggacgtacgtctagtattacgttactgacctgcctanattcgcgacgttaggttaattacggttacgtttgggtacggttcgggaggtacgggtaaaccaggttccgtacgggttacccgtacggtccggttacgaaacccggtacgtaaaccggttcccgacccgtcccccggtttgtccttaccccgg

SEQ ID NO: 35520 - DNA, 680 bp, Homo sapiens
  misc_feature: GYAE6OF01B9OAM.45.79.H02.1.454.CMB.1.raw
  modified_base (232)..(232): a, c, t, g, unknown or other
  misc_feature (232)..(232): n is a, c, g, or t
  modified_base (499)..(499): a, c, t, g, unknown or other
  misc_feature (499)..(499): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
tcagacgcgatcgacacgaccggtgctcgatttagtgtcacacgaagggaaagggggggtcacaagaggcagcgctctcgggacgtctccaccatggcctgggctctgctattcctcacttcctcctcactcaggacacgacgggtccgtcggcccaggttctcgccctagacctcacgcctcgcccgttccgtgtcgtcgggtcctccgtggactagtcgactccaacctntcctcctgtccacgtacggaaccagacagtgtagttgggttaggtacttactaccgtttcgtccgtcgtacgtaacaacgacgcccgaaccgaggaaccaaacccgtaccccaaaagtccattacgttagtttacgcggacggactacggtaaccggccggttaccgttcggttaacggttactaacgttccttacgttcgtacgtcgtacctacgtagtcgacgaccacgaccgtcctacgatactacgtcgtacgtccgctccgngtgacggacggacgtgtacttagtacttagtcgtatccgtntactnaagttcaggactaggttgtcgttagtttcgggtacggtacggcggtaacgtaccgtcgtagtcccggtcgtacgtacggtcccaccgtaccggtcgtacccggtcccttccccggttacttccgtccgttccccg

SEQ ID NO: 35521 - DNA, 785 bp, Homo sapiens
  misc_feature: GYAE6OF01CD95X.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctccgtgtctgggtctcgtggacagtcgatccaccatcctcctgccaacgtggaaccagctagtcgattggttgggaagtttaacttaaccttcgtaccgttccgtaggtaaccaacgtacgaccacccgaggaccaaacgacccccaaactcagtagtacttagaggacggactaggtaacgccggtccgtacggtacgggtttactaacgtccgtcgttactcgtcgtaccgtaccgtaacggtccgtacggaaccgtaaccgacccgggtacccctttacccgtacgtaaaccgtaacgttccgtccggttaccgggccttacccggaagggtcccggtaagggaacgggtaaccgggtaggtacccgtttaagtaaacgttttaacgttaccgttaccggtaccgttacggtacctttaacgtaacgttaacgttacgggaccctacccggtacgtaacgtacttacgtaacgttaccgtttacgttaacgggttacgtttaccggggaaccgggaaccggtaaccgaacggttccggtacccggtaacccggttaccgtaacgggtacccaacccggacccgtaaccggtcccgtaacccccggg

SEQ ID NO: 35522 - DNA, 780 bp, Homo sapiens
  misc_feature: GYAE6OF01BH1SQ.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcaccatctcctgccacgtaggaaccagcaggtgagttggttagggattaactaaccttgtcctccgtacggtaaccaacacgccaacccgaggaccaaaaccgaccccccaaactcatagtaatttagaggtaggacaaggtaacgccggtaccctcggtacgggtttctcactccgtcttacgtcgtagcccttacgtaacggtcgtacggtacgtaaaccgtccgggccccttaccccgtacgtacctacttccgttacccggtccggtccgtaccgtacggtacgttaacggaacggtacggaacggttcgtaggttaactttaacgttacgtacggtacgtacaccttaagaactttaacgttacgtttacggtttacccgttttaaccgacccggtttacggggtttaccgttaccggggggtaaccggggttaaacgggaacccggtttaaacggttcccgggtaaaccccggtttacgggtaaaccggtcccggtaacccggaaccccggtaaacggttcccgttccccgggaccccccgtttagggtccctacccgtttacccccgg

SEQ ID NO: 35523 - DNA, 688 bp, Homo sapiens
  misc_feature: GYAE6OF01ESOQZ.45.79.H02.1.454.CMB.1.raw
  modified_base (160)..(160): a, c, t, g, unknown or other
  misc_feature (160)..(160): n is a, c, g, or t
  modified_base (444)..(444): a, c, t, g, unknown or other
  misc_feature (444)..(444): n is a, c, g, or t
  modified_base (492)..(492): a, c, t, g, unknown or other
  misc_feature (492)..(492): n is a, c, g, or t
  modified_base (511)..(511): a, c, t, g, unknown or other
  misc_feature (511)..(511): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaaggacacgagggttcctgggcccagtcngccctgactcagcctgcctcgtcgtcgtgggtcctccgtggacagttcgaactccaacctactccgtccgtcgcctaacgtaccgggaaacctggtacgtaagttgaagttgggttaggggtaacgtttaactaaccgtttgtcctccgtacggtaaccaactcgaccacccgagaacccgtaaaccgaccccctaaaagtcctagtacgtacttaagtcggaacggacacggtaaccgcgtccgtggttacggttataacgtcgtcttacgcgtcgctaacgntcgtcggacaacgccggtaccctcacgtaactactcgtcgtcggtacncgtagctaggatacgggancgttactagttnttactggtntactcagtatacggtcgaggttaacgtaagtttaccggttacgttggggttacggtacgggacgggtacgaacggtacgtacggtccgtaccgttcggtacgacccgacggtaccctacggtacccgtcccggttaccccgtgtcccgttacccgg

SEQ ID NO: 35524 - DNA, 732 bp, Homo sapiens
  misc_feature: GYAE6OF01CR4WK.45.79.H02.1.454.CMB.1.raw
  modified_base (179)..(179): a, c, t, g, unknown or other
  misc_feature (179)..(179): n is a, c, g, or t
  modified_base (519)..(519): a, c, t, g, unknown or other
  misc_feature (519)..(519): n is a, c, g, or t
  modified_base (585)..(585): a, c, t, g, unknown or other
  misc_feature (585)..(585): n is a, c, g, or t
  modified_base (594)..(594): a, c, t, g, unknown or other
  misc_feature (594)..(594): n is a, c, g, or t
tcagacgcgatcgacacgaccggtgctcgatttagtgtcacacgaagggaaaggggggggtcacgaagaggcagcgctcgtcgggacgtctccaccatggcctgggctctgctgctcctcactctcctcactcaggacacgacggtcctcgggcccagtcctcgccctagacctcgacncctcgccctcgtgtcgtggttcctccgcggacacgtacgactccaacctcgttccgtccctagtacctaaccggtacggaaaccgacggtacgtaaggtacggtagttgggttacgggttaactttaacgttaccgtttcgtccgttaccgtacggaaaccctaacgtaccgaccgaaccgaacgggaaccctaaaccccggaccccctaaagtcgtaacgttagtagttacggacggtaacggacgtaacggtaacgtaccggtacccgttaggttacggttacacgttctcgtacgtcacgtctacgtacgtcgacgacctacgccgttcctaccganactactcgtcgtacggctacgacgtacgtagacggcgtaatcgtattaacgtcttacgcgagtacncttatacgngtacgtagtacgttacttacgttggtttacggtgggtaccgggtacggaccggaaactcgggtaaccgtacggtccgtacggttcgaaccgtaccggacccgtaccgtccgttccccggtacgtccgtccctaccggg

SEQ ID NO: 35525 - DNA, 799 bp, Homo sapiens
  misc_feature: GYAE6OF01EX3I1.45.79.H02.1.454.CMB.1.raw
  modified_base (231)..(231): a, c, t, g, unknown or other
  misc_feature (231)..(231): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctcgcctcgtgtctggtctccgtgacagtcgactcaccatcctctgcacgtacggaaccngcagtgtacgttgggttagggtacttacttaccttcgttccttccgtacggtaaccaacgacgtaccgaacccgacggaaccaaaccgaacccccctaaactctacgtacgttaatttacggtacgggacgggacgtacggtaacggccggtacccggttacggttacggggtttactaacgttccgtcctttcgtccgttagtactaccgtaacgttcgtacgggacctaaccggtacccggtccttacccggtacaaccgtaacttcgtacggccgggttcctaccggtacggcggtaggaacgggtacgggacggtacgtacgggtttaactttacgttacgttcgtacggtcgtaccgtattacgtaagttacggttacggtaacgggtttaagtttacggttttacgggttttcgggttacgggttaccggggtacgggtaacccgggtaacggtaaccgttacggtacccggttaccggttaccggttaccggtaaccgtacccgggacccgtaaaccgggtcccgttacccccggtccccgttaccggtcccttaccccgg

SEQ ID NO: 35526 - DNA, 902 bp, Homo sapiens
  misc_feature: GYAE6OF01D5VX2.45.79.H02.1.454.CMB.1.raw
  modified_base (475)..(475): a, c, t, g, unknown or other
  misc_feature (475)..(475): n is a, c, g, or t
tcagacgcgatcgacacgaccggtgctcgatttagtgtcacacgaagggaaaggggggggtcacaagaggcagcgctctcgggtacgtctccaccagtggcctgggctctgctcgctcctcacttctcctcacgtcgacgacacgacgggttccgtcgggcctagtctccgcctgacctctacgcctcgtccttccgtcggtcggtcggtcctcgtacggactcgtactaccacctacgtccttacgtccgacgtaccaacggtaaccgaaccggagtacgtaggtaggtacggttaggggttaacgttaacgttacgtttaccgtcgttaccgtccgtaaccgaccgtaacgaccgtacccgaaacggacccaaaccggtaccccaaacctacgtacgttaagttcgttaaggtacggtaagggtcaacgggtaacgggtccggtacgttacccggttaaggttacccggtttntaaccggtcttcctcgggttaccctcgggtaacctaccggtacggtccgaacctacggaccccgtcgttccccgtataacccgttaaagtcccgtgggtacccggtaccgtacgtacgtacgggtaccggtaacggacgggttaccgtacgggttaacttaacggtttaaccgttaaggttcccgttcgtaccgtttccgtacggttagtaaccgttacggtaggttaaccgggtttaagtttccgggggttttaacggtttacggggtcgggtttaaccgggggaacgggtaaccggttaacccgggtaccgggtttactaccgggttaccgggttaccgtaaccgttcccgggtaaaccgaccgttacccggggtccggttaccccccttggggttacccccgttaacggttccccgttaacccg

SEQ ID NO: 35527 - DNA, 713 bp, Homo sapiens
  misc_feature: GYAE6OF01AZP56.45.79.H02.1.454.CMB.1.raw
  modified_base (337)..(337): a, c, t, g, unknown or other
  misc_feature (337)..(337): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacaggtcctgggcccagtctcgccctgactcagcctgccctcgtgtctgggtctccgtggaccaggtcgatcaccattcctctcgctacgtcgaaacctgcagtgagtggttgggaatttactaaccgttgttcctccgtacggtaaccaactaccgcaacccgaggaccaaaccgccccctaaatccattagtacttagnggtacggactaggtacgccggccctacggtacggtttacaagtccgtacttctacgtcggtactacgtagtccgtacggaccctaaccgacccggtcccttcccgtaacgtaccgtaaccttcgttacccggtcgggtaacccctacggtaacgggtccttaaacgggacgggtaaccgtaacgggttcttaagggttaacctttagtaccgtttacggactttccgacctttagaagtccgttagacggttaagggtttacgtagtttacggttcgggtacggttcgggacggtaacgaccgtaaggtccgtacggtccgttaggccggtacgacgaaccggtccggccttacccggccccttggtaccctaccg

SEQ ID NO: 35528 - DNA, 810 bp, Homo sapiens
  misc_feature: GYAE6OF01E2DEA.45.79.H02.1.454.CMB.1.raw
  modified_base (204)..(204): a, c, t, g, unknown or other
  misc_feature (204)..(204): n is a, c, g, or t
  modified_base (622)..(622): a, c, t, g, unknown or other
  misc_feature (622)..(622): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactcctcctcactcaggacacgacgggtcctcgggccctaggtctcgaccctgactcgagcctcgccctcgtgtcgtggtctaccgnggactagtcactcacctacgttcctcccgtagacctaacgtcggaaacccaggacctaggtgtagttgggttaggtaacgtttaacttaccgttcgtcctaccggtacggtaaccaactccgacccgaaccgaacggtaacccaaaaccccggtaaccccccaaagttaccgagtttacgttaacgttttacggacggggtaaccgggtaactaacgggtacccgtaccccgggtttcccgttaaacgggtttacgggtttaacctaacgtttccgggtttccttaaccggtccgtaaccgggtcccttaacggtacgttcccgggtaccggaaccctaaccgggtacccccgtcccgtaaccgtaccggtaaactccgttcgtacggtccgtaccgtaacgcggtagacgtaacggnggtacctacgttagttctttaacgtcgtcgacttcgatacgtacgtagccggacggtaacgcgtacgtccggttaggttggaccgggttcgggcgtaacccggtaggttcggtaacccgttccgggtaattccgggcccaccggtacccgacggttccccgaccgttcccggtccgtccgttacccgg

SEQ ID NO: 35529 - DNA, 860 bp, Homo sapiens
  misc_feature: GYAE6OF01ER6TZ.45.79.H02.1.454.CMB.1.raw
tcagacgcgatcgacacgaccggtgctcgatttagtgtcacacgaaggggaaaggggggggtcacaagaggcagcgctcgtcgggacgtctccaccatggcctgggctctgctgctcctcactctcctcactcgagacacgagggtccgtcgggcctagtctcgccctagactcgacgccgtcgtcccgtcgtcgtcgtcgggtcctccgtggacgacgtacgactccacctactccgtacctgacctaccgtacggaaccgcggtacgtagtacggtaggttaggtttaggggtaacttaacgttaaccgttcgtcccgtaccgtacgtaaccaacgtacgacccgtaacgaacggtaacccgaaaccctaccccctaatactagttacgtaagtttacgggaccggtagggtaacctacgggttacccggcccgttacccggttacgggtttacggtttaactaccgttccgttaccgttcggtaccgtacgcccgttaacgtaacgtcgtaacccggaacgtaaccgtcccggtaccccttaccgtaagtaaccctttacgtccggttccggtcccggtacgtacccggtagacggtaacgggtacggtaaccggtcggttaacttacggttactttaaccggttctaaccggtcttacggtaccttaacgtacggtagttaaccgggacggtttaacgggttacggtttacgggtttactttaccgggggtaccgggtacgggtaccgggaaacggttaccggtaccgggttaccgtaccggtaccgtaccgggtacgcccggtaaccgacccggtcccggtccctaccccgggccctaccggtcccgttaacccg

SEQ ID NO: 35530 - DNA, 851 bp, Homo sapiens
  misc_feature: GYAE6OF01CN4X0.45.79.H02.1.454.CMB.1.raw
  modified_base (249)..(249): a, c, t, g, unknown or other
  misc_feature (249)..(249): n is a, c, g, or t
  modified_base (580)..(580): a, c, t, g, unknown or other
  misc_feature (580)..(580): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacgacgggtcctgggcccagtcctcgcctcgactcacgcctcgcctccgtgtcgtggtcctcgtgacacgtcgactcacctacttcctccgtcgactaccgtacgggaaccngtacgtagtacgtagttagggttacgggtaacttttaaccgttaacctttcggtaccttaccggtaccggtaaacccgacgaccgacccgtaaccggaacggaaacccaaaccccgtaaccccctaaactctaagtttacgtaacgtttacggacgggtaaccggacgtaacgggtacccggtaccggttcccggttacggttaacgggtttacctaacgttccgttaccgttctcgggtaccgtccgtaaccgttaacggtccgtacgacccgtaaacccgccggttacccctacgtacgtacctacgttcgtacccgggtcggtaaccncggtaacggtaccggtaacgggtacgtaacggtccggtaacttacgtttaaccgtttcgaccgttcggtacctggttacctagtacgtttcggacgtaacgtttagggttacgtttacgggtttacggtttacccggggtgggtaaccggggtaccggaacggtaacccgtcgttacccgggttacctaaccggggttaccgtacggtacccgacccggttaccaccccggggtttcccaccccggtttccccacggtttccgttaccccg

SEQ ID NO: 35531 - DNA, 582 bp, Homo sapiens
  misc_feature: GYAE6OF01B5E4Z.45.79.H02.1.454.CMB.1.raw
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (527)..(528): a, c, t, g, unknown or other
  misc_feature (527)..(528): n is a, c, g, or t
  modified_base (534)..(534): a, c, t, g, unknown or other
  misc_feature (534)..(534): n is a, c, g, or t
  modified_base (544)..(544): a, c, t, g, unknown or other
  misc_feature (544)..(544): n is a, c, g, or t
  modified_base (557)..(557): a, c, t, g, unknown or other
  misc_feature (557)..(557): n is a, c, g, or t
  modified_base (571)..(571): a, c, t, g, unknown or other
  misc_feature (571)..(571): n is a, c, g, or t
tcagacgcgatcgacacgaccggtgctcgatttagtgtcacacgaagggactggagtggattgggtatatctattacagtgggagcaccaactacaacccctcctcaagagtcgagtcaccatatcagtagacacgtccaagaaccagttctccctgaagctgagctctgtgaccgctggccgacacggccgtgtattactgtgcgagagactacctaagtacgtaatttactttgagtaggtaggggtagtttttagattagtcgtggggaccaagggacaagtggtacacgtctctcagcctaccacgacggccatcggtcctccccgtgccaccctcctacagacgcaccgtcggcgggctacgacgtccggtacgtcgggtctcgccgttaggaccaacggtacttaccgttcccgtagtaaccgtccggtcgtcgtacgggacggtccggggtacgtcgggaccgtaacgggccgtaacgtaggtaccgnacgatgagngtacgnactgaacgntacgngcnnctcgcntatcgtacgngacgcacgactcncgcgacgtcgatcncgtacgcgtcg

SEQ ID NO: 35532 - DNA, 751 bp, Homo sapiens
  misc_feature: GYAE6OF01CHRYN.45.79.H02.1.454.CMB.1.raw
  modified_base (291)..(291): a, c, t, g, unknown or other
  misc_feature (291)..(291): n is a, c, g, or t
tcagacgcgatcgacacgaccggtgctcgatttagtgtcacacgaaggggaaagggggggggtcacaagaggcagcgctctcgggacgtctccaccatggcctgggctctgctgctcctcactctcctcactcgaggacacgagggtcctgggcccagtcctcgccctgactcagcctgccctcgtgtcgtgggtcctcgtggacagtcgatccacctatctctgcctacgacggaaccagcgagtgagttggtggtaattacttaccttgtcctaccgtacgaaccaacncgaccaaccgacggaccaaacccgaccccaaactcattagtactttaggacggagggacgtaaggtaccggcccgggtacccgttaggttacgggttactaacgttccgttactttccgtacgtcggtacctacgacggttcgtacgaccaaccgtaccgtccctaccgtataacctacgtcgttacggtccggactcggacggtcgtaagggaccgggtacgaggtagttacgttaatttacgttcgtcgtccgttacgtcgtaactagtaggtacgaacggtttagggttaacgtttacgggttttacggtttcgggggttacgggttcccgggggaacgggtaaccgggaaccggtaacggtacccggttacccggtaccggttaccggtacggacccggaacccggtacccggacgggtccccgttaccccgtccccggtccgttcccgtccccgg

SEQ ID NO: 35533 - DNA, 660 bp, Homo sapiens
  misc_feature: GYAE6OF01A8Q5E.45.79.H02.1.454.CMB.1.raw
  modified_base (167)..(167): a, c, t, g, unknown or other
  misc_feature (167)..(167): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (573)..(573): a, c, t, g, unknown or other
  misc_feature (573)..(573): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctgccctgactnagcctgcctcgtgtctggtctctggacngtcatcacntcnctgcatgacancngngatgtggnttatacttgtctcgtacgtacacgagcacccgtagaccaaacctacccccgtaaatccgaattcgtactttagtggacgggactaaggtaccgccggtacctacggttacgggttactagtccgttcttcgtctcggcctaccagtttcgcgacctaacgtccgtcctacctagacacgtctacgtcggtcctaccgacggttcgacggtaggtaacgtcgtacgtaacgtatttacgtacgtcgtacgtcgtacttacgtataggttactacggttacgggtttaacgttcggtttacgggtttaacggtttcggtaaccggggtcggtaaccgggtaaccnggttaccgtaccggttaccgtaccggtcgtacccggacgtacccggtaacgtccccggtaccgtccccgttacggtcccttacccgg

SEQ ID NO: 35534 - DNA, 745 bp, Homo sapiens
  misc_feature: GYAE6OF01E0RB8.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctcgcctacgtgtcgtgggtccttccgtggacagtcgatccaacccagttcctcctgccagtacggaccagcagtgagttggtaggtattacgttaaccgttcgtccgtacctacggtaaccaacgtacgaccacccgtaaggacctaaacccgaaccccctaatccagttactaactttaggaggaacgggactaacggttaacggccccgtacccgttaggttacgggtttacctaacgtcccggtcttacgtccggtcgtaccgtaccgtacgtccgtacggaaccgtaaccgtacccgtcccgttccgtaacgaaccttaactccggttacccggccgggtacccttacggacgggttacgaggtaaccgggacgttacggtacggttactaagttacgttacgcgttactcgtactacgtgtacgtcggtaagtacgggttacttaacgggtttcgttggggaccggttacggacgggtacgaacccggagtacccgtcggttacgtcggttacgacgacccggtaccctacggggtcccctacccggcccccgttagttcccgtacccg

SEQ ID NO: 35535 - DNA, 921 bp, Homo sapiens
  misc_feature: GYAE6OF01EAUBD.45.79.H02.1.454.CMB.1.raw
  modified_base (165)..(165): a, c, t, g, unknown or other
  misc_feature (165)..(165): n is a, c, g, or t
  modified_base (212)..(212): a, c, t, g, unknown or other
  misc_feature (212)..(212): n is a, c, g, or t
tcagacgcgatcgacacgaccggtgctcgatttagtgtcacacgaagggaaaggggggggtcacgaagaggcagcgctctcgggacgtctccgaccatggcctgggctctgctgctcctcactcgtcctcactcgaggacacgagggtcctgggccctaggtccngtccctgactcgagcctcgcctccgtagtcgtggtcctccgtggacngtcgactccgacctactcctaccgtgactacgtcgaaaccagtccgagtcgtagttaggtggtaatttaccgtaacgttctacgttccgtacggtaaccaacgtacgaccacccgtaagtaacccaaacccgacccccttaaatcgtaacgtacgttaatttcggtaggaccggtacgtaacggtaccggtccggtacccgttaggttaccgggttttactaacggttccttaccgttcgttccggtaaccggtacccttaacggaacgtttccggacgtaaccgaacccggtcccgttacccgtacgtaagtacccgtttaacgtccgttacggtaacggtcccgtaaccggtagggtacccgttaaacgggaacgggaccggtacgtaccgttaacgtttaacgtttaacggttaccgtggttcccgaacgttacgttaccgtaacgtaccggttaacggtacggtttaaaggggtttaacggtttaacggttttggtttttaccggggggtacggttaaaccggggtaccgggtaaaaccccgggttacgggttaaacccgggtccgggttaaaaccccgggttcccggtttaaacccggtaaccccggggtaaacccgtccccgggtaaacccggttaaccccggggttcccgttacccccccgggtaccccgggttttcccgaaaccccggtttttcccccggg

SEQ ID NO: 35536 - DNA, 1034 bp, Homo sapiens
  misc_feature: GYAE6OF01AP5BP.45.79.H02.1.454.CMB.1.raw
  modified_base (114)..(114): a, c, t, g, unknown or other
  misc_feature (114)..(114): n is a, c, g, or t
tcagacgcgatcgacacgaccggtgctcgatttagtgtcacacgaaggggaaaggggggggtcacgaagaggcagcgctctcgggacgtctccaccatggcctgggctctgctnctcctcactctcctcactcgaggtacacgagggtcctcgggccaggttctcgccctgactcacggtcctcgcctcgtcggtcggtcgggttccctccggtcggaccgtaacggtccggtaactcccgaaccgtacttccgtaccccgtgaccgtaacggttaccgggaaacctacggagaacggttggtacggtttcgggggtttaaggggtactttttaaaccgttaacccgttttcggttacccgtttacccgggttttaaccggtaaaccccgaaaccgaacgggttaccccaaacccgggaacggggtaaaccccctaaaccccccggaaaaccccccctaaacacccgtttaaccgaaggtttaactttaacggttaacgggtaacggggaaccggtaaccgggtaaaacggtcccccggggtacccggtttaacggggttaacgggtttttacccgttaaacggttcccgttttccgttaaccgttccggtacggttaccccgtaagtaccggttaacgtacgtaccgtaacccggccgggttacccctaccgtacgacccttaagtccgtacgtaccgggtccgtacggttacggtacgttacgggaaggtaccggtacggtacggttacgtaaacggtttacgtacggtaacggtactaccggttaactaacgtttaacgtttaaccgttaaagttttacggttaccgttttaacccggttacgggttttaacgggttacccggggttaacggggttaaacccgggtacggtttaaaccgggttaccggttaaacgggtacccggtttaacccgggtaccggttaacggaccccggggtaacccgtacgggtttacccgggtacccgtacccccgggttggtaccccgttaccgttaacccctttccccggg

SEQ ID NO: 35537 - DNA, 755 bp, Homo sapiens
  misc_feature: GYAE6OF01ASCP5.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctcgggcccagtctgcccctgactcagtccctgcctccgtgtcgtgggtctccgtggacagtcgatccaccatcctcctgctacgtacggaacccagctaggtgaagttggttaggagttactacttgtcctcgtacggtaaccaacgacgcctacccgaggacaaaccgaccccccaaatccgatacgtattacaggacggtcgaaggtaacgccggtacccttagggtaacgggtttacttaacgtcgtaccttcgttacgtcgtaccgtaccgtaagtcccgtacggaacctaaccggtacccgacccccttccgtaacgaacccgttaacgtcccgttacggtaccggggccttaacccggaggttacggtacgggaaccgggtacggtaacggtccgttaagtaactttacggttacctaggtccttacgggtccctaacgtaagttggtaaccgtaacggttaagggtttagttaacgttttcgggttttgggtaccgggtccggtacggggaaccggtacgaggttccgtaacgggtcccttacgggacggtactacccggaccgttacgacccgttccgtaccccgtcgggtccttaccccgg

SEQ ID NO: 35538 - DNA, 497 bp, Homo sapiens
  misc_feature: GYAE6OF02I9FB0.45.79.H02.1.454.CMB.1.raw
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttangagggcagtaagcgccctnagggttctaatcgcttctctggctccaagtctggcaacncgcctcctgacatctctggctcaggctgagcgagctgattatactgctgctcatatgctaggtatagtacttttgggngttcggnggtaggacaagcgtgaccgtctaggcagcccgaggctcgcccctggtctacg

SEQ ID NO: 35539 - DNA, 460 bp, Homo sapiens
  misc_feature: GYAE6OF02IL2QO.45.79.H02.1.454.CMB.1.raw
  modified_base (454)..(460): a, c, t, g, unknown or other
  misc_feature (454)..(460): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcctaatacgtattactttgatagtaggggagttttgatatctggggccaagggacaatggtcaccgtctcttcagcctccaccaagggcccatcggtcttccccctggcaccctcctccaagagcacctctggggcacagcggccctgggctgcctggtcaaggctacttcctcgatcgcgtctgagcggctggcaaggcgcatagnnnnnnn

SEQ ID NO: 35540 - DNA, 523 bp, Homo sapiens
  misc_feature: GYAE6OF02GA54O.45.79.H02.1.454.CMB.1.raw
  modified_base (426)..(426): a, c, t, g, unknown or other
  misc_feature (426)..(426): n is a, c, g, or t
tcagacgcgatcgacacgaccggtgctcgatttagtgtcacacgaagggaaagggggggtcacaagaggcagcgctctcgggacgtctccaccatggactgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaaactcatgatttatgagggcagtaagcggccctcaggggtttcaatcgcttctctggctcaagtctggcaacacggcctccctgacaatctctgggctccaggctgaggacgaggctgattattactgctgctcatntgcgaggtagttagttacgtttggtggttcgggcgagggaccaagccgtgaccgttccgtaggtcaggcccaaggtcctcgcccccttggtctaccg

SEQ ID NO: 35541 - DNA, 514 bp, Homo sapiens
  misc_feature: GYAE6OF02GQD7K.45.79.H02.1.454.CMB.1.raw
  modified_base (322)..(322): a, c, t, g, unknown or other
  misc_feature (322)..(322): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaactcatgatttatgagggcagtaagcggccctnaggggtttctaatcgcttctctggctccaagtctggcaacacggcctccctgacaatctctgggctccgaggctgaggacgaggctgattatactgctgctcattatgcaggtagtagttactttggtggttcggcggagggaccaagcgtgaccgtctaggtcagccaaggcctcgccccttggtctaccg

SEQ ID NO: 35542 - DNA, 556 bp, Homo sapiens
  misc_feature: GYAE6OF02JI371.45.79.H02.1.454.CMB.1.raw
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
  modified_base (460)..(460): a, c, t, g, unknown or other
  misc_feature (460)..(460): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataccttgtctctggtaccaacagcaccaggcaaacgcccccaaatcatgattangaggcagtaagcgcctgtagggtttcaatcgtcttctctggctaccaagtctgcaacacggcctccngacatctcgtggctcaggctagaggacgaggctagattactactgctgctcatagtcgcgtaggttagttacgttacgtttgggtacgttcgggngggtaacgggacctaaggtccgtcggtaacccgttcgtaacgggtcgaacggaccccgtaagggtccttacccggtcccccgttaggtcctacccg

SEQ ID NO: 35543 - DNA, 537 bp, Homo sapiens
  misc_feature: GYAE6OF02IOQB8.45.79.H02.1.454.CMB.1.raw
  modified_base (226)..(226): a, c, t, g, unknown or other
  misc_feature (226)..(226): n is a, c, g, or t
  modified_base (377)..(377): a, c, t, g, unknown or other
  misc_feature (377)..(377): n is a, c, g, or t
  modified_base (418)..(418): a, c, t, g, unknown or other
  misc_feature (418)..(418): n is a, c, g, or t
tcagacgcgatcgacacgaccggtgctcgatttagtgtcacacgaagggaaaggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccacagcacccaggcaaacgccccaaactcatgatttatgaggcagtaagcggcctgagggtttctaatcgtcttctctggctcaagtctggcaacacgccctcctgactaatcncgtcggctcgagctgagacgagctgattatttctgttgctnatatgctagggaccagtcgtacgttgggtgttcgggtaggacgggtacctgggttacgaccggttccgtacggtacacgacccgaagggtcctaccgtcccccgtaggtccacttcccg

SEQ ID NO: 35544 - DNA, 515 bp, Homo sapiens
  misc_feature: GYAE6OF02GG253.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttcaatcgcttctctggctccaagtctggcaacacggcctcctgacaatctctggctcaggctgaggacgaggctgattatactgctgctcatatgcaggtagtagttactttggtgttcggcggagggaccaaggctcggaccgttcgtaggtcagcccaaggcctcgcccccgtcggtctaccg

SEQ ID NO: 35545 - DNA, 529 bp, Homo sapiens
  misc_feature: GYAE6OF02I2RCS.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggcagtaagcggccctgaggggtttctaatcgcttctctggctccaagtctggcaacacgcctccctgacaatctctggcctcaggctgaggacgaggctgattattactgctgctcatatgctaggttagttagttacttttgggtgttcgggcggtaggaccaagcgtggacccgttccgtaggtcacggcccgaaggtcctcgcccccgttggtcctaccg

SEQ ID NO: 35546 - DNA, 525 bp, Homo sapiens
  misc_feature: GYAE6OF02JOJUL.45.79.H02.1.454.CMB.1.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
tcagacgcgatcgacacgaccggtgctcgatttagtgtcacacgaagggaaagggggtcacaagagacagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaaatcaatgatttangagggcagtaagcggccctnaggggtttcaatcgcttctctggctccaagtctggcaacncggcctcctgacaatctctggctccaggctgagacgaggctgattattactgctgctcatatgtctggtagttatcgttttggcgttacgggcgggaggacccaaggtcgtcggaaccgttctagggtccagcccaagggtcctcggccccctgggtccctacg

SEQ ID NO: 35547 - DNA, 566 bp, Homo sapiens
  misc_feature: GYAE6OF02F6FIR.45.79.H02.1.454.CMB.1.raw
  modified_base (431)..(431): a, c, t, g, unknown or other
  misc_feature (431)..(431): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtcctccgtggacagtcgatcaccatctcctgcacgtggaaccagcagtgatggttggagttactaaccttgtctctggtaccaacagccaccagacaacgaccccaaactcatgatttatgaggcagtaagccgcctcgtagggtttctaatcgtcttctcgtggctccaagtctggacaacgacgccctcctgacaatctcgtggctcgaggctggagacgagctagtattattactgctgcctanattagtgacgtagggttagtagtttacgttttgggtcggttcgggacgggtacgggacaacggtcgtcggaacccgttacgtacggttccgacgacccgaacggtccgtcccgtcccccgttcggtacctacccg

SEQ ID NO: 35548 - DNA, 523 bp, Homo sapiens
  misc_feature: GYAE6OF02HS5TH.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaaactcatgactttatgagggcagtaagcggccctcaggggtttctaatcgcttctctggctccaagtctggcacacggcctcctgacaatctctgggctccaggctgaggacgaggctgattattactgctgctcatatgcaggtagttagttacttttgggtgttcgggcgggagggaccaagcgtgacccgtctaggcacgcccgaaggcctacggcccctggtcctaccg

SEQ ID NO: 35549 - DNA, 510 bp, Homo sapiens
  misc_feature: GYAE6OF02FOJ4G.45.79.H02.1.454.CMB.1.raw
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagttactttggtgttcggcggagggaccaagctgaccgtcctaggtcagcccaaggcctcgccccctggtcac

SEQ ID NO: 35550 - DNA, 516 bp, Homo sapiens
  misc_feature: GYAE6OF02H56OU.45.79.H02.1.454.CMB.1.raw
  modified_base (302)..(302): a, c, t, g, unknown or other
  misc_feature (302)..(302): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagccccaaatcatgatttangaggcagtaagcgcctgagggtttcaatcgcttctctggctcaagtctggcaacacgcctcctgacaatctctgggcctcgaggctgaggacgaggctgattattactgctgctcatatgcaggttagtacgttacgtttggcgttcgggaggacggaccaagcgtgacccggttctaggtcaggcccaaggcctccggcccctcgggtctccg

SEQ ID NO: 35551 - DNA, 556 bp, Homo sapiens
  misc_feature: GYAE6OF02F1RDE.45.79.H02.1.454.CMB.1.raw
  modified_base (323)..(323): a, c, t, g, unknown or other
  misc_feature (323)..(323): n is a, c, g, or t
  modified_base (332)..(332): a, c, t, g, unknown or other
  misc_feature (332)..(332): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcccctgcactggatccagcggtgacgttactgtttttaagatgtctcctggtatcagcaacacccaggcaaagcccccaaaatcatcatttatgatgtcaataatcgccctnagggtttcncatcgcttctctggctcaagtctggcaatccggcctcccgtcgaccacttcctcgtgggcctccgaggctgaggacgaggctgattattactgctgcttcatatgacgtaggttagtagttactttgggttcgttcgggcgggtagggacctaacggtcgtacggacccgttccgtaaggtccacggtacccgaaggtcccgtcccggtcccccgtcggtaccc

SEQ ID NO: 35552 - DNA, 518 bp, Homo sapiens
  misc_feature: GYAE6OF02G318L.45.79.H02.1.454.CMB.1.raw
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattataaccttgtctcctggtaccaacagcacccaggcaaagccccaaactcatgatttatgaggcagtaagcggcctcagggtttcaatcgcttctctggctcaagtctggcaacacggcctcctgacaatctctgggctccaggctgagacgaggctgattattactgctgctcatatgcagggaccagctacgttgggtgttcggcggagggaccgtagggttcgaccgttcgtacggtcacggcccaagggcctcggcccccgttcggtcctaccg

SEQ ID NO: 35553 - DNA, 512 bp, Homo sapiens
  misc_feature: GYAE6OF02IO0N9.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctctgtgtctgggtctcctggacagtcgatcaccatctcctgcactggaaccagcagtgatgttgggagttataaccttgtctcctggtaccaacagcacccaggcaaagcccccaaactcatgatttatgaggcagtaagcggcctcaggggtttcaatcgcttctctggctcaagtctggcaacacggcctcctgacaatctctgggctccaggctgaggacgaggctgatttatactgctgctcatatgctaggtagttagttacgtttggtgttcggcggagggtaccaggctcgaccgtctaggtcacgcccgaaggcctcgcccccgtgtcc

SEQ ID NO: 35554 - DNA, 524 bp, Homo sapiens
  misc_feature: GYAE6OF02G6ZQ8.45.79.H02.1.454.CMB.1.raw
  modified_base (320)..(320): a, c, t, g, unknown or other
  misc_feature (320)..(320): n is a, c, g, or t
  modified_base (352)..(352): a, c, t, g, unknown or other
  misc_feature (352)..(352): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaactcatgatttatgaggcagtaagcgccctnagggtttcaatcgcttctctggctccaagtcnggcaacacggcctcctgacaatctctgggctccaggctggaggacgaggctgattattactgctgctcatatgctaggttagtagttactttggtgttcggcggagggaccaaggcgtggaccgttccgtaggtccagcccgaaggtcctaccggcccccgtggtcctaccg

SEQ ID NO: 35555 - DNA, 537 bp, Homo sapiens
  misc_feature: GYAE6OF02IGJUM.45.79.H02.1.454.CMB.1.raw
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacagcaccaggcaacgccccaaatcatgatttatgagggcagtaagcggcctcaggggtttctaatcgcttctctggctccaagtctgcaacacggcctcctgacaactctctgggcctcaggctgaggacgaggctgattattactgctgctacatagtgcgtaggtagttagtacgtttttgggngttcgggnggtacgggacaagtcgtacgacccgtacgtacggtacacgaccgaacggtcctaccggccccttcggtctaccg

SEQ ID NO: 35556 - DNA, 530 bp, Homo sapiens
  misc_feature: GYAE6OF02HQJVP.45.79.H02.1.454.CMB.1.raw
  modified_base (226)..(226): a, c, t, g, unknown or other
  misc_feature (226)..(226): n is a, c, g, or t
  modified_base (421)..(421): a, c, t, g, unknown or other
  misc_feature (421)..(421): n is a, c, g, or t
  modified_base (431)..(431): a, c, t, g, unknown or other
  misc_feature (431)..(431): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggagttataaccttgtctcctggtaccaacagcacccaggcaaacgcccccaaactcatgatttatgagggcagtaagcggccctcgaggggtttctaagtcgcttctctggctccaagtctggcaacgacgcctcctgacaactctctgggctccgaggctgaggacgagctgattattacngctgctcatntgcaggtagtagttactttgggtgttcgggcggagggccgaagtcgtcgaccgtccgtaggtcgacgacccgaaggcctccgcccccgtggtcctaccg

SEQ ID NO: 35557 - DNA, 524 bp, Homo sapiens
  misc_feature: GYAE6OF02I7QVK.45.79.H02.1.454.CMB.1.raw
  modified_base (303)..(303): a, c, t, g, unknown or other
  misc_feature (303)..(303): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaactcatgatttangaggcagtaagcggccctgagggtttcaatcgcttctctggctccaagtctggcaacacgcctcctgacaatctctggctcaggctgagacgaggctgattattactgctgctcatatgcgtaggttagtagttacgtttggtgttcgggcggagggaccaaggtcgtcggtaccgtcgtaggtcgacgcccgaaggtcctcgcccccgttggtcctaccg

SEQ ID NO: 35558 - DNA, 573 bp, Homo sapiens
  misc_feature: GYAE6OF02GQNKE.45.79.H02.1.454.CMB.1.raw
  modified_base (305)..(305): a, c, t, g, unknown or other
  misc_feature (305)..(305): n is a, c, g, or t
  modified_base (468)..(468): a, c, t, g, unknown or other
  misc_feature (468)..(468): n is a, c, g, or t
tcagacgcgatcgacacgaccggtgctcgatttagtgtcacacgaagggaaagggggggttcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggagttataaccttgtctcctggtaccaacagcacccaggcaaagcccccaaactcatgatttangagggcagtaagcggccctcaggggtttctaatcgcttctctggctccaagtctggcaacacgcctccctgacaatctcgtgggctcgggctggaggacgaggctgattattactgctgctcatatgactaggtagttacgttacgttttgggtggttcgggngggtacgggaccaggtcgtacggacccggttccgttacgggtccgaacgtaccccgaagggtcccgtaccggtccccccgttcgggttccctaccgtttccccgg

SEQ ID NO: 35559 - DNA, 627 bp, Homo sapiens
  misc_feature: GYAE6OF02HIQ0B.45.79.H02.1.454.CMB.1.raw
tcagacgcgatcgacacgaccggtgctcgatttagtgtcacacgaagggaaaggggggggtcacaagaggcagcgctctcggacgtctccaccactggccgtcgggcgtctgctgctcctcactctcctcactcaggacacagggtccgtgggcccgacgtctgccctcgactcagcctcgcctccgtgtctgggtctcctggacgagtcgatcaccatctcctgcactggaaccagcagtgatggttgggagttataaccttgtctcctggtaccaacagcacccaggacaaacgacccccaaactacatagtatttaatggagggccaaggtaagccggccctcgtaggggttctaatcgcttctctcggctccaagtcgtcgacaacaccggtccctccctacgactaactctcgtcgggctccgaggcgtggagggacgaggctagatttattactgctagtctactatagtcgacgaggttaaggttacgttacgttttgggtcgttcggggacgggtaaggggacccaagggtccgttacgggacccggtttccgtaacgggttccgaaccggtacccgtaacgggtccttacccgggccccccgtttgggtaccctaccg

SEQ ID NO: 35560 - DNA, 552 bp, Homo sapiens
  misc_feature: GYAE6OF02JBCDH.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaagcccccaaatcatgattatgagggcagtaagcggcctgagggtttctaatcgtcttctctggctcctaagtctggcaacacggcctccctgactaatctcgtcgggcctccgaggctagaggacgaggctagattattaacgtgctgctcattatgacaggttatagttacgtttggttcggttcggagggtacggaccaagtctacggaccgttccgtagggtaccacgacccgaaggcctaccggcccccgtcggtccacgttcccg

SEQ ID NO: 35561 - DNA, 530 bp, Homo sapiens
  misc_feature: GYAE6OF02IN459.45.79.H02.1.454.CMB.1.raw
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaacgcccccaaactcatgatttangagggcagtaagcggccctcgaggggtttctaatcgcttctctggctccaagtctggcaacncggcctcctgacatctctggctcaggctgaggacgaggctgatttatactgctgctcatatgcgaggtagtagttacgtttgggtgttcgggcggagggaccaaggtctggtacccgtccgtaggtcagcccgaaggcctccggcccccgttggtacctaccg

SEQ ID NO: 35562 - DNA, 511 bp, Homo sapiens
  misc_feature: GYAE6OF02IVFKK.45.79.H02.1.454.CMB.1.raw
  modified_base (303)..(303): a, c, t, g, unknown or other
  misc_feature (303)..(303): n is a, c, g, or t
  modified_base (427)..(427): a, c, t, g, unknown or other
  misc_feature (427)..(427): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaactcatgatttangaggcagtaagcggccctcaggggtttctaatcgcttctctggctccaagtctggcaacacggcctccctgacaatctctgggctccaggctgaggcgaggctgattattactgctgctcatangcagtagtagttctttggtgttcggcggagggaccaaggcgtgaccgtctaggtcagcccaaggcctcgcccctcggtctaccg

SEQ ID NO: 35563 - DNA, 515 bp, Homo sapiens
  misc_feature: GYAE6OF02ILB8B.45.79.H02.1.454.CMB.1.raw
  modified_base (302)..(302): a, c, t, g, unknown or other
  misc_feature (302)..(302): n is a, c, g, or t
  modified_base (372)..(372): a, c, t, g, unknown or other
  misc_feature (372)..(372): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggagttataaccttgtctcctggtacccaacagcacccaggcaaagccccaaatcatgatttangaggcagtaagcggccctgaggggtttcaagtcgcttctctggctccaagtctggacaacacggcctccngacaatctctggctcaggctgaggcgaggctgattacttacngctgctnatntgcgaggtagtagttacgtttgggtgttcggcggtaggaccaagtcgtggaccgtcgtaggtcagccgaaggcctccgcccctggcctccg

SEQ ID NO: 35564 - DNA, 524 bp, Homo sapiens
  misc_feature: GYAE6OF02HFK6N.45.79.H02.1.454.CMB.1.raw
  modified_base (301)..(301): a, c, t, g, unknown or other
  misc_feature (301)..(301): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtaccaacagcacccaggcaaagcccccaaactcatgatttangaggcagtaagcggcctcaggggtttctaatcgcttctctggctccaagtctggcaacacgcctcctgacatctctggctcaggctgaggacgaggctggattattactgcttgctcatagtgcgagggaccagcctaacgttgggtgttcggcgggaggaccgtagggttcgaccgtcgtaggtcgacggcccgtaaggcctacggcccccgtggtcctacg

SEQ ID NO: 35565 - DNA, 677 bp, Homo sapiens
  misc_feature: GYAE6OF02H5H8P.45.79.H02.1.454.CMB.1.raw
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
  modified_base (303)..(303): a, c, t, g, unknown or other
  misc_feature (303)..(303): n is a, c, g, or t
tcagacgcgatcgacacgaccggtgctcgatttagtgtcacacgaagggaaagggggggtcgacgaagaggcagcgctctcgggacgtctccaccatggcctgggctctgctgctcctcactctcctcactcaggacacagggtcctcgggcccagtctgccctagactcagcctgcctccgtgtctgggtcctcctggacagtcgatcacatctctgcactggaaccagcagtnatgttgggattatacttgtctctgtacaanacgcaccgagcaaacgcccccaaaatcatagactttancggaggcaagtaagcgtaccctagtaggggtttactaagtcgtacttctgtcggtactaccgtaagttccgtaggacctaaccgaacgggttccctaccccgtagaaacctaacttcccgtagttccggggaccttcccggaaacggtccgtaggaaccggggacgaacgggccgttaggtaacttttaaacgttttacgcgtaaccgtttcgcttaccaattaacgttcggaacttaaagggtagtttaacgtttaaccgtttgggtacggtttaccgggacggtagggaaccctaaggcgtacggtaacccgttcgtaacgggtcaacggtcccgaagggtcctaccggtcccccgttacggccttaacccg

SEQ ID NO: 35566 - DNA, 548 bp, Homo sapiens
  misc_feature: GYAE6OF02IPSDU.45.79.H02.1.454.CMB.1.raw
  modified_base (530)..(530): a, c, t, g, unknown or other
  misc_feature (530)..(530): n is a, c, g, or t
tcagacgcgatcgacacgaccggtgctcgatttagtgtcacacgaagggaaagggggttcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccaacagtgatgttgggattttagtttgtctcctggtaccaacaacaccccggcgaaagacccccaaactaatcatttatagggacactaagcggaccctggggtttcaagtcgcttctctggctcaagtctggcaacacggcctacctgacaatctctgggctccaggctcaggacgaggctgattatttctgttgctcatatgacagggacctagctaacgttgggtattcggcggacggaccaggttcgaccgtctaggtcacgccaaggctcgccccgtacgtctaactcgttcgttaccccncccgtcttaccgcgtacg

SEQ ID NO: 35567 - DNA, 603 bp, Homo sapiens
  misc_feature: GYAE6OF02IS0NU.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaacccagcagtgatggttgggattataaccttgtctcctggtaccaacagcacccaggacaaacgcccccaaactcatgtattatgaggcagtaagcgccctgtagggtttctaatcgcttctcgtggtcctccaagtctggacaaaccgaccggtcccttacccgtagaacctaacttcctacgtcggggtcctacccgaaggtctaggacgggacgaagggtctagtaatttattacgtgacttgctcatagtgacgtaggttagttagttacgttttgggtcggttcgggcgggtaacgggaccaaggtccgtcgtacccgttacgtacggtccacggacccaaggtcccgtaccggcccccgttcggtacctacccg

SEQ ID NO: 35568 - DNA, 613 bp, Homo sapiens
  misc_feature: GYAE6OF02JLCVE.45.79.H02.1.454.CMB.1.raw
  modified_base (301)..(301): a, c, t, g, unknown or other
  misc_feature (301)..(301): n is a, c, g, or t
  modified_base (364)..(364): a, c, t, g, unknown or other
  misc_feature (364)..(364): n is a, c, g, or t
  modified_base (406)..(406): a, c, t, g, unknown or other
  misc_feature (406)..(406): n is a, c, g, or t
tcagacgcgatcgacacgaccggtgctcgatttagtgtcacacgaagggaaagggggggtcgacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagtttgtctcctggtaccaacacaccccggcaacgcccccaaactatcatttanaggaccactaagcggcccgtcggggtttcaaggtcgcttctctcggctccaagtctggcaacncggcctcctgacaatctcgtcggctccaggctcgacggacgnggctgactttatttcgtgttgtctctattatcgacacgggaccagctacggttggggtcgttcgggacggggacgggtaccgtagggtttcgacccgttcgtagggtacctacgacccgaacgggtccttccggccccccgttgggtacccttaaccgttccgttacccggtttcccccacccgtttccccgtccttacccgggtcc

SEQ ID NO: 35569 - DNA, 698 bp, Homo sapiens
  misc_feature: GYAE6OF02HWAKI.45.79.H02.1.454.CMB.1.raw
  modified_base (264)..(264): a, c, t, g, unknown or other
  misc_feature (264)..(264): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattatacttgtctctgtacacngcaccagacaacgccccaactcatgtattagtggaggcagtaacggccgcccgtacgtagggtttactaagtccgtcttctcgtcggtcctactaagtcgtacggaccaaccgaccggtccctaccgtacgaactaacttccgtacgtcgggtcctaccggacggtcgtagggaacgggtaacggacgggtccgttagtaactttaacgtttaccgtggtccttacgtacctaccgtaattacgtacgtacgtaacgggttaagtttacgtttacggttttcggggttacggttaccgggggacggggtaaccgggtaaccgtacggttcccggtaacggttacccggttacgttaaccgggttaccgaaccgggtaccccggtacgggtccccgttacccgggtccccccgttaccggttacccgttacccgg

SEQ ID NO: 35570 - DNA, 578 bp, Homo sapiens
  misc_feature: GYAE6OF02GHBT4.45.79.H02.1.454.CMB.1.raw
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatggcctgcactggaaccaacagtgatggttgggtagttttagtttgtctcctggtaccaacaacaccccggcgaacgcccccaaactatcattanaggacactaagcggccgtcggggtttcaagtcgcttctctggctccaagtctggcaacncggcctcccngacaatctctgggctccgaggctcgaggacgaggctgtattatttctgttgctcatatgcgaggccagctacgttgggtcgttcgggcggacgggtaccgtagggttcgaccggttccgtaggtcgacggacccgaaggccttccggccccccgttcggtcctaccgttccgttccgttccccgccccttcccgtccgtcccgg

SEQ ID NO: 35571 - DNA, 515 bp, Homo sapiens
  misc_feature: GYAE6OF02GITLV.45.79.H02.1.454.CMB.1.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctggctccaggctgaggacgaggctgattatactgctgctcatatgcaggtagtagttactttggtgttcggcggaggaccaagcgtgaccgtcgtaggtcagcccgaaggcctcggccccctggtcctaccg

SEQ ID NO: 35572 - DNA, 454 bp, Homo sapiens
  misc_feature: GYAE6OF02HQ9BL.45.79.H02.1.454.CMB.1.raw
  modified_base (233)..(233): a, c, t, g, unknown or other
  misc_feature (233)..(233): n is a, c, g, or t
  modified_base (448)..(454): a, c, t, g, unknown or other
  misc_feature (448)..(454): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaacccctccctcaagagtcgagtcaccatatcagtagacacgtccaaagaaccagttctccctgaagctgagctctgtgaccgctgcggacacggccaaaatnttactgtgcaagagagggcctggaattatcctttgaccactggggcctgggaaccctggtcaccgtctcctcagcctccaccaagggccccatccggtcttccccctggccaccctcctccaagacgcacctcgtcggggcacagcggccctgggctgcctggtcaagggactacttcctcgatcgcgtctgagcggctggcaaggcgcagtagnnnnnnn

SEQ ID NO: 35573 - DNA, 545 bp, Homo sapiens
  misc_feature: GYAE6OF02J164H.45.79.H02.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (308)..(308): a, c, t, g, unknown or other
  misc_feature (308)..(308): n is a, c, g, or t
  modified_base (393)..(393): a, c, t, g, unknown or other
  misc_feature (393)..(393): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
  modified_base (471)..(471): a, c, t, g, unknown or other
  misc_feature (471)..(471): n is a, c, g, or t
tcagacgcgatcgacacgaccggtgctcgatttagtgtcacacgaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatccaccatctcctgcactggaaccngcagtgatggttgggatttataaccttgtctcctggtaccaacagcacccaggcaaacgcccccaaactcatgactttangaggcagtaagcggcctcgtaggggtttctaatcgtcttctctggctcctaagtctggactaacgccgcctccctgactatctcncggcctccgagctagacggacgagcctagattattacngctgctcatagtncgtagtagtagttactttggtgtcggngggacgtaccaggtcctaggtacccgtcgtaggtaccacggcccgtaaggccttccgcccccgttggcctaccg

SEQ ID NO: 35574 - DNA, 531 bp, Homo sapiens
  misc_feature: GYAE6OF02IWNIX.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaacgcccccaaactcatgatttatgaggcagtaacgcggcctgaggggtttctaatcgcttctctgctcaagtctggcaacacggcctcctgacatctcgtcggctccgaggctgaggacgaggctgtattattacgtgctgctcatactgacaggtagtagttacgtttggtcgttcggcgggacgggacaaggtcgtcggaccgtcgtacggtcgaccgaccgaaggcctaccggccccgtgtcctacg

SEQ ID NO: 35575 - DNA, 561 bp, Homo sapiens
  misc_feature: GYAE6OF02GP51H.45.79.H02.1.454.CMB.1.raw
  modified_base (303)..(303): a, c, t, g, unknown or other
  misc_feature (303)..(303): n is a, c, g, or t
  modified_base (426)..(426): a, c, t, g, unknown or other
  misc_feature (426)..(426): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatggcctgcactggaaccaacagtgatgttgggagttttagtttgtctcctggtaccaacaacaccccggcgaacgcccccaaactaatcatttanagggacactaagcggccctcggggtttcaagtcgcttctctggctccaagtctggcaacacggcctccctgacaatctctgggctccaggctcgaggacgaggctgatttatttctgttgctnattatgcagggaccaggcctaacgttggggtgttcgggcggtagggacctagggttcgaccgttccgtaggtcacgcccgaaggcctccgccccctcggtccaccgtctcgttccccacccttcctcctcgtacg

SEQ ID NO: 35576 - DNA, 607 bp, Homo sapiens
  misc_feature: GYAE6OF02I3ZO4.45.79.H02.1.454.CMB.1.raw
  modified_base (324)..(324): a, c, t, g, unknown or other
  misc_feature (324)..(324): n is a, c, g, or t
  modified_base (434)..(434): a, c, t, g, unknown or other
  misc_feature (434)..(434): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaacccagcagtgatgtgggattataaccttgtctcctggtaccaacagcaccccaggcaaagccccccaaatcatgattatgagggcagtaagcggccctnagggtttcaatcgcttctctggctccaagtctggacaacacggcctcctgacaatctctggctccaggctgaggtacgaggctgattattactgtctcgctactatagtntacgtagggttaagttagttaaccgttttgggttaggtttccgggtcggggtaacgggtaccgtaacggtccggtaccgtacccggttaccgttaacgggttaccgtacggtacccccggtaaacgggtcccgtaccccggtccccccgttcccgggttacccttacccccgg

SEQ ID NO: 35577 - DNA, 599 bp, Homo sapiens
  misc_feature: GYAE6OF02HQ1PM.45.79.H02.1.454.CMB.1.raw
  modified_base (304)..(304): a, c, t, g, unknown or other
  misc_feature (304)..(304): n is a, c, g, or t
tcagacgcgatcgacacgaccggtgctcgatttagtgtcacacgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatcctcctgcactggaaccagcagtgacgttggttattataactatgtctcctgtaccaacaacaccagacaaacgcccccaaatcatgatttangtatgtacagtaactccggcctcgtaggggtttctgatcgtcttctcgtggctaccaagtcgtggacaaaccgaccggtccctcccgtagaaccaattcctcgtcgggcctccgaggctaggaggacgaggtctagtattaattacgtgcttgctctatatgactagggttattacgttacgtttgggttacggttcggacgggtaggacctaaggtcgtacggtaaccgttccgtaggtaccgacggacccgtaaggtcccgtaccgtcccccgtacggttcccaccgttcccg

SEQ ID NO: 35578 - DNA, 576 bp, Homo sapiens
  misc_feature: GYAE6OF02I7T41.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaacgcccccaaatcatgatttatggaggcaaggtaacgcggccctgacggggtttctaacgtcgtcttctctggcctccaagtctggcaacgacgcctccctgacaatctcgtcggctccgaggcctaggacggacgaggtcctagtacttaattacgtgtcctgcctctaatatgacgtagggttagttagttacgttttgggtcgttcgggacgggacggaccaaggtccgtacggtaccgttccgtaagggtctacggacccgaggccgtccggtccccctggtccctaccg

SEQ ID NO: 35579 - DNA, 566 bp, Homo sapiens
  misc_feature: GYAE6OF02FNRJW.45.79.H02.1.454.CMB.1.raw
  modified_base (441)..(441): a, c, t, g, unknown or other
  misc_feature (441)..(441): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacagcacccaggcaaacgcccccaaactcatgatttatgaggcagtaagcggcctcgagggtttcaatcgtcttctctggctaccaagtctggcaacgacgtccctcctgacaactctcgtgggcctccgaggctgaggacgaggctgtaattattacgtgtctgctcattancgacgtaggttagtagttacgtttgggttcggttcgggcgggtaaggacctaaggcgttacgacccggttaccgtaacggtccaacggcccgtaagggcctaccggcccccgttggtccctaccg

SEQ ID NO: 35580 - DNA, 538 bp, Homo sapiens
  misc_feature: GYAE6OF02IMKYE.45.79.H02.1.454.CMB.1.raw
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
tcagacgcgatcgacacgaccggtgctcgatttagtgtcacacgaagggaaaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccagcagtgatggttgggattataaccttgtctcctggtaccaacagcacccaggcaaacgcccccaaactcatgatttanggaggcagtaagcggccctcgaggggtttcctaagtcgcttctctggctccaagtctgcaacacgcctcccgtnacaatctcgnggcctccgaggctggaggacgaggctagtattattactgctgtctntatntgcgtagtagttagtacttttggtcgttcggcggagggacaaggtccgtggacccgtcgtacggtcacgccgaggtcctccggccccttcggctaccg

SEQ ID NO: 35581 - DNA, 594 bp, Homo sapiens
  misc_feature: GYAE6OF02H6TIN.45.79.H02.1.454.CMB.1.raw
  modified_base (224)..(224): a, c, t, g, unknown or other
  misc_feature (224)..(224): n is a, c, g, or t
  modified_base (266)..(266): a, c, t, g, unknown or other
  misc_feature (266)..(266): n is a, c, g, or t
  modified_base (453)..(453): a, c, t, g, unknown or other
  misc_feature (453)..(453): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctctgcactggaaccngctagtgatgttgggattactaaccttgtctctggtaccaangccacccaggacaaacgccccctaaactcagtatattatgaggcaagtaagccggccctggtagggtttcaagtcgtcttctcgtgtctacctaagtctggacaaccgaccgtccctcctagaactactcgtctcgggctccgagtcaggacgagacgctagtattacttactgctgctacattagntcgtaggtacgtagtttacgtttggtcggttacggacggtaacgggacctaggtccgtaaggtacccggttacgtaacggttccgaaccggtacccgtaacggtcccgttaccccggcccccgttcggtacccttacccgg

SEQ ID NO: 35582 - DNA, 546 bp, Homo sapiens
  misc_feature: GYAE6OF02FGP4Q.45.79.H02.1.454.CMB.1.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattataacctgctctgtacaacagcaccaggcaagccccaactcatgatttatgaggcagtaacgcggcctcgagggtttctaatcgcttctctggctccaagtctggcaacgacggccctccgtgacaatctcgtgggcctccgaggctaggagacgagctgtattatactgctgctcatactgacaggtagttacgtttacgtttggtacggttcgggacggacggtaccaaggccgtacggacccggtccgtaaggttccaacggtcccgaacggtccgtaccggcccccgttgtccctacccg

SEQ ID NO: 35583 - DNA, 807 bp, Homo sapiens
  misc_feature: GYAE6OF02I1JQZ.45.79.H02.1.454.CMB.1.raw
  modified_base (117)..(117): a, c, t, g, unknown or other
  misc_feature (117)..(117): n is a, c, g, or t
  modified_base (170)..(170): a, c, t, g, unknown or other
  misc_feature (170)..(170): n is a, c, g, or t
  modified_base (220)..(220): a, c, t, g, unknown or other
  misc_feature (220)..(220): n is a, c, g, or t
  modified_base (250)..(250): a, c, t, g, unknown or other
  misc_feature (250)..(250): n is a, c, g, or t
tcagacgcgatcgacacgaccggtgctcgatttagtgtcacacgaagggaaagggggggtcacaagaggcagcgctctcgggacgtctccaccatggcctgggctctgctgctcctnactctcctcactcaggacacagggtcctgggcccagtcctcgccctagactcncgtcctcgcctcgtgtcgtcggtcctccgtaggactagtcactccacctntccgtcagctacgtacggaaccagctagtnagttggtggtattacttacgttcgtctacgtcgtaacaagcgaccacgacgaccaaccgacccctaaatctagtagttattaagagggacggtacgtaaaggtaccgggcccgtcccttaacgggttacgggttttactaacgtccgttccttaaccgtcgtacggtcctacgaaggtttcgacggaaccaaccggtccgtacccttccgaagtaactacgttccgttcggtccggtccgtacccgtaggtaccggtaacggaccggaagggtaccgtaccgttaaggtttaatttaaaccgtttccggtcgttaccggtcttacccgtaagttacgttaaccggtaccgtaggttaaaccggggtttaagtttaaaccggttttttcgggttacggggtttccggttaacccggggggaacgggttaaaccgggaccgttaaccggtccggttaaaccggttaccccggttaaccggtacggtaccccggttaaacggccccggaacggttccccccgttacccgggtaccccccgtttcggtaaccctttcccgg

SEQ ID NO: 35584 - DNA, 553 bp, Homo sapiens
  misc_feature: GYAE6OF02JRFZF.45.79.H02.1.454.CMB.1.raw
  modified_base (136)..(136): a, c, t, g, unknown or other
  misc_feature (136)..(136): n is a, c, g, or t
  modified_base (180)..(180): a, c, t, g, unknown or other
  misc_feature (180)..(180): n is a, c, g, or t
  modified_base (215)..(215): a, c, t, g, unknown or other
  misc_feature (215)..(215): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (450)..(450): a, c, t, g, unknown or other
  misc_feature (450)..(450): n is a, c, g, or t
tcagacgcgatcgacacgaccggtgctcgatttagtgtcacacgaagggaagggggggttcacaagaggcagcgctctcggacgtctccaccatggcctgggctctgctgctcctcactctcctcactcaggcacngggtcctgggcccagtctgccctgactcagccctgccctccgtntctgggttcctcctggaccagtcgatccaccatcnccctgccactacgggaccagcagttgattggtttgggatttaataaccttgtctcctggtaccaacagccacccaggccaaacgcccccaaactcatgatttatgagggcagtaagccggccctcaggggttttctaatcgcttctcttggctccaagtctggcaacaccggtccctccctgacaanctctgggctccagctgaggacgnggcngtnttatctgctgctcattangcgagtagttagtttacgttggttgttcggacgggaggggaccaaaggcttcggacccggtacctagggtcagcccaaggtcctcgcccccgttcggcctacc

SEQ ID NO: 35585 - DNA, 563 bp, Homo sapiens
  misc_feature: GYAE6OF02HOEMB.45.79.H02.1.454.CMB.1.raw
  modified_base (305)..(305): a, c, t, g, unknown or other
  misc_feature (305)..(305): n is a, c, g, or t
  modified_base (426)..(426): a, c, t, g, unknown or other
  misc_feature (426)..(426): n is a, c, g, or t
tcagacgcgatcgacacgaccggtgctcgatttagtgtcacacgaagggaaagggggggttcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggatttttagtttgtctcctggtaccaacaacaccccggcgaacgacccccaaataactcatttanaggacactaagccggccgtcggggtttcaagtcgcttctctggctcaagtctggcaacgacggcctcctgacaatctctgggctccaggctcgaggacgaggctagtatttattcttgttnctcattatgcgtaggaccagctacgttgggtgttcgggcggaggacgtaggttcgaccgtcgtaggtcacgacccgaaggcctccgccccgtcggtcctacgttcgtccgttccccgtcccctccgtcctccgtacg

SEQ ID NO: 35586 - DNA, 550 bp, Homo sapiens
  misc_feature: GYAE6OF02GUQY3.45.79.H02.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatggcctgcactggaaccngcagtgatgttgggattataaccttgtctctggtaccaacagcacccaggcaaacgccccaaactcatgatttangagggcagtaagcggccctcgagggtttctaatcgcttctctggcctcaagtctggcaacgcggtcctccgtgacaatctcgtcggctccgaggctggaggacgaggctgtattattactgctgctcatatgacgtaggttagttagttacgtttggtgttcgggcgggacggacgacggtcgtcggtaccgtcggtaggtaccgacggtacccgacggtccgtccggcccccgttggtccctaccg

SEQ ID NO: 35587 - DNA, 650 bp, Homo sapiens
  misc_feature: GYAE6OF02G2PZ0.45.79.H02.1.454.CMB.1.raw
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatggcctgcactggaaccaacagtgatggttgggtattttagtttgtctcctggtaccaacaacaccccggcgaacgccccaaataatcatttanagggacactaagcgccgtcggggttcaagtcgcttctctggctccaagtctgcaacncggcctcctgacaatctcgtgggctccgacggctcgaagggacgaggctgtatttagtttcgtgttgctctatagtcgacgtagggaccctagaccgtacggtttggggttacggtttccgggggacggggtaacggggtaaccgtacgggggttttacgggaaacccgtttacccggttaagggttcccgacgggtacccgaaacgggtcccgttaccggtccccccgttcgggtccctaacgttcccgtccgtttaccccgaccccttcccgttccgtcccgtaccg

SEQ ID NO: 35588 - DNA, 588 bp, Homo sapiens
  misc_feature: GYAE6OF02HBJOZ.45.79.H02.1.454.CMB.1.raw
  modified_base (302)..(302): a, c, t, g, unknown or other
  misc_feature (302)..(302): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattataaccttgtctctggtaccaacagcacccaggcaaacgcccccaaactcatgatttangaggcagtaagccggccctcgtaggggtttactaatcgcttctcgtggctaccaagtctgcaacaccggccctcccgtgactaatcctcgtcgggcctcgaggtctaggacggacgaggtcctaggactttagttactgacagacactatagttaactttagtcgttttaccacgttcgggttacttccgggacggacgggtaacctaggttcgacccgttcgtaggttccaacgtacccgtaaggccttcccggacccccgttggtacctaccttccgttacccg

SEQ ID NO: 35589 - DNA, 734 bp, Homo sapiens
  misc_feature: GYAE6OF02IYQ0H.45.79.H02.1.454.CMB.1.raw
  modified_base (230)..(230): a, c, t, g, unknown or other
  misc_feature (230)..(230): n is a, c, g, or t
tcagacgcgatcgacacgaccggtgctcgatttagtgtcacacgaagggaaaggggggggtcgacaagaggcagcgctctcgggacgtctccaccatggcctgggctctgctgctcctcactctcctcactcaggacacagggtcctgggcccagtctgccctgacctcagcctgcctccgtgtctgggtctcctggacagtcgatcaccatcctcctgcactggaaccngcagtgatgttgggattataaccttgtctcctggtaccaacagcaccaggcaaacgccccaaactcatgattatgaggcagtaacgcgccctgagggtttactagtcgtcttacgtcgtcggtcctccgtaagtcgttacggaccaacgtaccgggtcccctcccgtagaaccaacttcctccgtacgggtcctacccgaagggtccgtagggaacggtaaccgggaacggtccgttacgtaagtttacgtttaaccgttcgccgttagtcccttacgtaacttagttacggtacgtaacgggtttacggttaacggttttaacgtttttcggggttacggtttaccgggggacggggttaacggggtaacccgtaagggttaccccgtacggggttaaccccggttcccggtttaacggggttacccaacggggtaccccgtaaaccggggtccctttaccccggggaccccccccggtttagggtaccccttaacccccggg

SEQ ID NO: 35590 - DNA, 592 bp, Homo sapiens
  misc_feature: GYAE6OF02G3BGH.45.79.H02.1.454.CMB.1.raw
  modified_base (227)..(227): a, c, t, g, unknown or other
  misc_feature (227)..(227): n is a, c, g, or t
  modified_base (458)..(458): a, c, t, g, unknown or other
  misc_feature (458)..(458): n is a, c, g, or t
  modified_base (486)..(486): a, c, t, g, unknown or other
  misc_feature (486)..(486): n is a, c, g, or t
tcagacgcgatcgacacgaccggtgctcgatttagtgtcacacgaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattataaccttgtctctggtaccaacagcaccaggacaaacgccccaaaactcatgactttaatgaggcaagtacgcgcctcgtagggtttacaatcgcttcgtctggctccaagtctggcaacgcgcctcctagactaatcctctacgggcttccagggtctaggacggacgaggtctggtaactttaagttacgtgccgtatccgtatacgttntacgctaaggttagttagtacttttggngtttcgggcggtaacggacctaaggtcgtacgtacccggtccggttaaggtcccaaggtacccccgtagggtacccgttcccgccccccggttggtaccctacccg

SEQ ID NO: 35591 - DNA, 590 bp, Homo sapiens
  misc_feature: GYAE6OF02GYH1V.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattataaccttgtctctgtaccaacagcaccaggcaaagccccaaactcatgattatgaggcagtaagcgcctgagggtttctaatcgtcttctcgtggctccaagtctggacaacaccggccctcctagacaacttctcgtggtcctccgagtcgtgacggacgaggctggtaattagttactgtctagtctctaattatcgacgtaagggttagtagttacgttttgggtcgtttccggggacgggacgggtaccgaacggtccgttacggaacccggttccgtaacggtccgtaacggaccccgaagggtcccgtacccggtccccccgttaggtcccttacccgg

SEQ ID NO: 35592 - DNA, 547 bp, Homo sapiens
  misc_feature: GYAE6OF02FX9F6.45.79.H02.1.454.CMB.1.raw
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggattataaccttgtctcctggtaccaacagcacccaggcaaacgcccccaaatcatgatttatgagggcagtaagcggccctgagggtttcaatcgcttctctggctccaagtctggcaacgacggcctccctgaccatctcgtcgggctccgaggctggaggacgaggctgtattatactgctgctnattangcgtaggtagttagttacgtttggtggttcgggcggagggtaccaggtcgtacggacccgttacgtacggtccacgacccgtaggcccgtcgcccccgttggtaccttacccg

SEQ ID NO: 35593 - DNA, 539 bp, Homo sapiens
  misc_feature: GYAE6OF02GTB7C.45.79.H02.1.454.CMB.1.raw
  modified_base (306)..(306): a, c, t, g, unknown or other
  misc_feature (306)..(306): n is a, c, g, or t
  modified_base (508)..(508): a, c, t, g, unknown or other
  misc_feature (508)..(508): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttttagtttgtctcctggtaccaacaacaccccggcgaagcccccaaaactaactcatttanagggacaactaagcggccctcaggggtttctaatcgcttctctggctccaagtctggcaacacggcctcctgacaatctctgggctccaggctgaggacgaggctgattattactgctgctcatatgctaggtagtagtacttttgggtgtttcggcgggaagggtaccaaaggcgtgaccgtcttaggcagcccaaggccncgcccctgtcactctcgttcccgcccttccg

SEQ ID NO: 35594 - DNA, 572 bp, Homo sapiens
  misc_feature: GYAE6OF02IX8GB.45.79.H02.1.454.CMB.1.raw
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
  modified_base (406)..(406): a, c, t, g, unknown or other
  misc_feature (406)..(406): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaataatcatttanagggacactaagcggccctcggggttcaagtcgcttctctggctccaagtctggcaacncggcctcctgactaatctctgggcctccgaggcctcgaggacgnggctgactttatttctgttcgcttcatatgcgtaggaccagctacgttgggtcgttcgggcggacgggaccgtagggttccgaccggttccgtagggtccgacggtacccgaaggccgttccggcccccgttggtccctaccgttccgttccggttcccctacccg

SEQ ID NO: 35595 - DNA, 626 bp, Homo sapiens
  misc_feature: GYAE6OF02GLJ03.45.79.H02.1.454.CMB.1.raw
  modified_base (228)..(228): a, c, t, g, unknown or other
  misc_feature (228)..(228): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggtggattataaccttgtctcctggtaccaacagcacccaggcaaacgccccaaactcatgatttatggaggcagtaacgcggccctcgtaggggtttctaatcgcttctctgctccaagtctggcaacaccggccctcctagacctaatctcgtcgggctcgaggtctaggacggacggaggcgtagtatttacttacgtgtaccttgtccttacgacttagtacggtacgtagggttaaggttacgtttacgttttgggtcggtttacgggacggggtaacgggtacccgtaaggtccgtacggtacccggttaccggtacggttaccgaaccggtacccgtaacgggtcccgtaccccggtcccccggttacggtacccttacccgg

SEQ ID NO: 35596 - DNA, 545 bp, Homo sapiens
  misc_feature: GYAE6OF02GLMTU.45.79.H02.1.454.CMB.1.raw
  modified_base (409)..(409): a, c, t, g, unknown or other
  misc_feature (409)..(409): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattataaccttgtctcctggtaccaacagcacccaggcaaacgccccaaactcatgtatttagtgagggcagtaagcggccctgagggtttctaagtcgtcttctctggctactagtctggcacgacgccctcctgacactctcgtcggctccgaggctggaggacgngctgatttatacgtgactgctcaatagtcgacgaggttagttacgttacgtttggtggttcgggacggagggtaccaggtcgtcgaccgttcgtaggtccacgtaccgaggcctccggccccgttcggtcctaccg

SEQ ID NO: 35597 - DNA, 547 bp, Homo sapiens
  misc_feature: GYAE6OF02GBH3S.45.79.H02.1.454.CMB.1.raw
  modified_base (300)..(300): a, c, t, g, unknown or other
  misc_feature (300)..(300): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtaccaacagaaccagacaacgccccaactcatgatttanggaggcagtaacgcggccctcgaggggtttctaagtcgtcttcctctcggctaccaagtcgtggcaacaccgcctccctgactaactctcgtcggactccgaggctggaggcgaggctgattattacngtctgctanattgngacgtaggtagtagttacgtttgggttcgtcgggaggacggtacgagctacggaccgtcgtaggtccgacgccgacggtctccgtccccgtcgtaccacgtcccg

SEQ ID NO: 35598 - DNA, 653 bp, Homo sapiens
  misc_feature: GYAE6OF02IRDBV.45.79.H02.1.454.CMB.1.raw
tcagacgcgatcgacacgaccggtgctcgatttagtgtcacacgaagggaaaggggggggtcacgaagaggcagcgctctcgggacgtctccaccatggcctgggctctcgctgctccctcactctcctcactcaggacacagggtcctgggcccagtctgccctgactcagcctgccctcgtgtctgggtctcctggacagtcgatcaccatctcctgcacgtggaaccagccagtgatcgttagggattactaacttgtctcgtcggtacaacagcaccaggacaaacgccccaaactcatgtattatagaggtcaagtacgcggcctacgtacgggttactaagtcgtcttcgtcgtcggcctcgaacgtcgtcgactaacgacgtccgtacctacgactaactctacgtcggtactaccgacggcgtacgacggacggacggtctagtactttactttccgttagtcgtacctcgtaattacgttcggaccgtaccggggtaactacggaccgtttaacgggttcggttacgggtacgggtaccggggacggggtaccggtaacgggttcggtaacccgttccggtaacggttccgaccggtaccgacggtaccgtcccggtccccgtaccgtccgtaccgttccccgg

SEQ ID NO: 35599 - DNA, 548 bp, Homo sapiens
  misc_feature: GYAE6OF02GAWA2.45.79.H02.1.454.CMB.1.raw
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcaccccaggaccaaacgcccccaaatcatgatttangaggcagtagcggccctgagggtttcaatcgcttctctgctcagtcnggcacacgcctcctgacatctcngggctcgagctgaggacgnggctagtattatactgctgctnatangcgtagtagtagttacgtttggtagttccgggacggtagggtaccaaggtccgttacggacccggttccgttaagggtaccaccggtaccccgaaggtcccgtcggtccccccgttggtcctacccg

SEQ ID NO: 35600 - DNA, 513 bp, Homo sapiens
  misc_feature: GYAE6OF02GGNAS.45.79.H02.1.454.CMB.1.raw
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattataccttgtctctggtacacngcaccaggacaaagccccaaatcatgattangagggcagtaagcgcctgagggtttcaatcgcttctctggctcaagtctggcaacgcgcctcctgacatctctggctccaggctgaggacgagtctagattatactgctgctnatangctaggtagttacgttgtttggtgttcggacgggaggacctagtcgtcggaccgttcgaggtccacgacccgtaggcctccggccccgttggtctacccg

SEQ ID NO: 35601 - DNA, 636 bp, Homo sapiens
  misc_feature: GYAE6OF02GPND3.45.79.H02.1.454.CMB.1.raw
  modified_base (228)..(228): a, c, t, g, unknown or other
  misc_feature (228)..(228): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggagttataaccttgtctcctggtaccaacagcacccaggcaaacgacccccaaactcatgatttatggagggcaaggtaacgccggccctcgtaggggtttactaagtcgtccttcgtctcggtctccgtaagtccgtggaccaacgccggtccctccctagactaatcctcgtcgggcctccgaggtccgtggacgggacgaggtcctaggtaatttattacgtcgtctcgcttacgagttagtcggaccgtagggttacgttaaggtttacgttttgggttacggtttcggggacgggtacgggacctaaggtcgtaccggtaccgttccggtaacggttccgaaccggtcccgaagggtccctacccggtcccccgtcggttacctacccgg

SEQ ID NO: 35602 - DNA, 569 bp, Homo sapiens
  misc_feature: GYAE6OF02HXVF7.45.79.H02.1.454.CMB.1.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcacgtgaacngcagtnatgtggattatactgtctctgtacacngcaccagcaacgccccaaatcatntattangaggnagtacgcgcctgtaggttctacgtcgtcttctcgtgactcgaagtctaggacctaaacgcggtacctccgtagaactactctacgtcggtctaccgacgtctaggacggacggacggtctagtattacgttacncgtacngtactcgaattcgtanaccgtaggttacgttagtttacggtttggtcggttaccgggcggtaggaccgtagtcgtacgtaccggtcgtaaggtccacggaccgtacggccgtaccggtccccgtcggtacctaccg

SEQ ID NO: 35603 - DNA, 879 bp, Homo sapiens
  misc_feature: GYAE6OF02F10JO.45.79.H02.1.454.CMB.1.raw
  modified_base (230)..(230): a, c, t, g, unknown or other
  misc_feature (230)..(230): n is a, c, g, or t
tcagacgcgatcgacacgaccggtgctcgatttagtgtcacacgaagggaaagggggggggtcacgaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatcaccatctcctgcactggaaccngcagtgagtggttggattataaccttgtctcgtgtaccaacacgacaccaggaccaaaccgaccccaaactcaatgtatttatggaggacaaggtaacgccggtacccgttcggtacggggtttactaacgtccgtactttcgtcgtcggtaccttaccgtaacggttccgtacggtaccgaaaccgtacccgggtacccccttaccccgtacgtaacccgtaacgttcccgttccgttccgggtaccttacccggacgggtccgttacgggaacgggtaaccgggtacgggttaccgttaacggttaacgttttaacgttttaaccgttacggtacccgtttacgtaccctttaaccgtaacgtttaacggtaaccgggttacggttaacggggtttaaacgggttttaaccgggttttaccgggttttttacgggggttacccggggttttaaccggggtaccgggggttaaacccgggggtaacccgttaaaccggggtacccgggtttaacccggtaaccccggggtttacccggtttaaccgggggtacccgttaaaccccgggtacccccggttaaccggggttccccggtttacccccgggtacccccccggtttaccgggttacccctttaaccccccggg

SEQ ID NO: 35604 - DNA, 806 bp, Homo sapiens
  misc_feature: GYAE6OF02H8KL4.45.79.H02.1.454.CMB.1.raw
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattataaccttgtctctggtaccacngcacccaggacaacgcccccaaactcatgtatttagngagggcagtaacgccggtccctgtagggttctaatcgtcttctcgtcggtcctaccgtaagtcgtcggtaccaaaccgccggtcccttcccgtacggtaacctaaacttcccgttacggtcggggtacccttacccggaacgggtcgttacgggaacgggtacggacggtccgttaggtaacttttaacgtttaccgtcgtaccgttcgtaccgttaccgtaagttacgtacgggtacccgtaaaggggtttaacggtttaacgggtttttaaccgtttttacggggggttaccgggttttacccggggggaacccgggggttaaacggggtaccccgtaaacggggtcccggtttaacccggggttaacccccggtttacccgggttaaccggggttaccccgaaacccggggttaccccccggtaaaccggggttcccccggttaacccccgggttccccccccccggtttaccgggggttacccctttaaccccccggg

SEQ ID NO: 35605 - DNA, 690 bp, Homo sapiens
  misc_feature: GYAE6OF02JP1HU.45.79.H02.1.454.CMB.1.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaccngcagtgagtggttgggattactaaccttgtctcctggtaccaacagcaccaggacaaacgacccccaaactcatcgtattagtggaggcaaggtaacgccggccctgtacggggtttactaacgtcgtcgttaccttcgtcggtcctaccgtagtctacggacaaccgccggtccctacccgtagaactaactccgtcgtcggtaccctacgacgggtccgttaggacgggtaccggtagtcgttaacggttaatttaacgttacgttcggacttcggtccttacgtacttagtccggtacgtaacgggtttaagttacggtttacgtttaggggttacggttaccggggacgggtaccgggaccgtaaggtcccggtacggttacccgttcggtaacggtaccgtaacggtacccggtaaggtcccgttaccccgggtcccctttacgggtaccttacccgg

SEQ ID NO: 35606 - DNA, 577 bp, Homo sapiens
  misc_feature: GYAE6OF02FX5C2.45.79.H02.1.454.CMB.1.raw
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (443)..(443): a, c, t, g, unknown or other
  misc_feature (443)..(443): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatcctcctgcactggaaccagcagtgatgttgggattactaacttgtctctggtaccaacagccaccaggacaaacgccccaaactcatgattangaggcaagtacgcgcctagacgggtttactatcgnttctcgtgctcagtctggacaacgcgtcctcccgagacctaactctcgtcggcctccgaggtcgtgacggaacgacggccgtagtacttagttactgtctgtctnatagtgcgtaggttacgtagttacgtttggtgttccgggacgggtacggtaccaggccgtcggaacccgttacgtaacgggtacaaccggtacccgaacggtcccgtacccggtcccccgtaggtccttacccg

SEQ ID NO: 35607 - DNA, 606 bp, Homo sapiens
  misc_feature: GYAE6OF02IRH0M.45.79.H02.1.454.CMB.1.raw
  modified_base (307)..(307): a, c, t, g, unknown or other
  misc_feature (307)..(307): n is a, c, g, or t
tcagacgcgatcgacacgaccggtgctcgatttagtgtcacacgaagggaaaggggggggggtcacaagaggcagcgctctcgggacgtctccaccatggcctgggctctgctgctccctcactctcctcactcaggacacagggtcctgggcccagtctgccctgactcagcctgcctccgtgtctgggtctcctggacagtcgatcaccatctcctgcactggaaccagcagtgatggtggattataaccttgtctcctgtaccaacagccacccaggacaaacgcccccaaactcatgtattanaggaggcagtaagcggccctgtagggtttctaatcgcttctcgtgctccaagtctggcaacgcgcctcctgacatctcgtcggctccgaggtctggacggacgtaggctagtatttaacttcgtcgcttcgtcctactatagtgacgtagggttagttacgttacgttttgggtcggttacgggacgggtaacggtaccgtaacggtcgtccggtacccggttacccgtaggttacccgaccggtacccggtaacggtcccttaccccgggaccccccttacgggttcccctaacccgg

SEQ ID NO: 35608 - DNA, 735 bp, Homo sapiens
  misc_feature: GYAE6OF02I088G.45.79.H02.1.454.CMB.1.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacagtcgatcaccatctcctgcactggaaccngcagtgatgtggattataaccttgtctctgtaccacagcacccagacaacgccccaaactcatgatttatggacgggacaggtaacgccgggtccccttacggtacggggtttacttaagtccgtcctttactcgtcggtaccttccgaacgttcgtacggaccaaacgtacccggtccctacccttagaacctaacgtccttccgtccgggtacctacccgagggtcctacgggaaggaccggtaaggtccgtagttaacgtttaacgtttaaccgttcgtcgttcgtaccttacgtactttaacgtacgtaccggttaaggggtttaacggttaagggttttaccgtttttaggggttacggtttacggggaccgggaacggggttaacccgaaaggttcccggttaacgggtaccccggttaccgtaccggggtttaaccgaccggtaccccgtaacggggaccccgttacccggtcccccccggttacgggtacccttaaccccg

SEQ ID NO: 35609 - DNA, 439 bp, Homo sapiens
  misc_feature: GYAE6OF02F3ZJ0.45.79.H02.1.454.CMB.1.raw
  modified_base (431)..(439): a, c, t, g, unknown or other
  misc_feature (431)..(439): n is a, c, g, or t
tcagacgcgatcgacacgaccggtgctcgatttagtgtcacacgaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcctaatacgtattactttgatagtaggggagtttttgatatctggggccaagggacaatggtcaccgtctcttcagcctccaccaaggcccatcggtcttccccctggccaccctcctccaagacgccacctcgtcgggggcacgagcggccctgggctcgcctggtcaaggactacttcctcgactcgcgtctgacggcgggctggcaggcgcatagnnnnnnnnn

SEQ ID NO: 35610 - DNA, 625 bp, Homo sapiens
  misc_feature: GYAE6OF02H66CJ.45.79.H02.1.454.CMB.1.raw
  modified_base (542)..(542): a, c, t, g, unknown or other
  misc_feature (542)..(542): n is a, c, g, or t
  modified_base (590)..(590): a, c, t, g, unknown or other
  misc_feature (590)..(590): n is a, c, g, or t
  modified_base (622)..(622): a, c, t, g, unknown or other
  misc_feature (622)..(622): n is a, c, g, or t
tcagacgcgatcgacacgaccggtgctcgatttagtgtcacacgaagggacgtggagtggattgggtatatctattacagtgggagcaccaactacaaccctccctcaacgagtcgagtcaccatatcagtagacacgtccaagaaccagttctccctgaagctgagctctgtgaccgctgcggacacggctagtgtattacgtgtgacgagagatcctaatacgtattacttgaatagtaggggatttttggatacgtcgtgggccaaggggtacaagtggtcaaccgtctcgttacgagtcccgtacaccgtaagggacccctagtccggttccttcccccgtaggtcctacccctccttacccgaaggtaccgacctaacccgtcgtcgggggacaccgacgtcccgggaccctcggggactcggacccgttcggacgaacgggacttacgtttcccgcggtaactccggtacgtcgtcggacggtccgggtcgtacggcgtaaacgggcggtaccaggttacgactgacgcgtaccgngtacgcgtcgacgcgacgcgcgcgtacgcgcgcgacgcgcgacgtcgntcgtcgcgactgacgtcgtacgtacgtcgtgngtg

SEQ ID NO: 35611 - DNA, 553 bp, Homo sapiens
  misc_feature: GYAE6OF02G8I3D.45.79.H02.1.454.CMB.1.raw
  modified_base (308)..(308): a, c, t, g, unknown or other
  misc_feature (308)..(308): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggagttataaccttgtctcctggtaccaacagcacccaggacaaacgcccccaaactcatgtatttanggaggcagtaagcggccctgtacgggtttactaacgtcgtcttctcgtcggctccaagtctgacaacgcgccctcctgactaactctcgcggcctccgaggctgaggacgaggctagtattattactgctgctnatangngtaggtagttagttcgtttggtcgttcggacggaggtaccagtcgtcggtaccgttacgtacggtccgacgcccgtaggcctcccgccccgtacggtcctacccg

SEQ ID NO: 35612 - DNA, 773 bp, Homo sapiens
  misc_feature: GYAE6OF02I6V63.45.79.H02.1.454.CMB.1.raw
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
tcagacgcgatcgacacgaccggtgctcgatttagtgtcacacgaagggaaagggggggtcgacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccagcagtgattggtgggaattataccttgtctcctggtaccaanacgcacccaggccaaacgcccccaaactcatgatttacngacggctagtacgcgtccctgtacgggtttactaactcgtcctttacgtctaggtaccttccgtaaggttcctaggccaaacgtaccggtccctcccgtgtaaaccgtaacttccgtccgtcgggtcccttaccggacggtacgtcgggtaacgggaccggtaacggttcccgttaagggttaacttttaacgtttaacccgtgggttaccgttcgtacccttttaaccgaacgtttaaggttcccgggtaaccgtttaaggggttaaacgtttacgtttttaaaccggggttttcggttaacggggttttacccggggaacggggttaaccgggggaaccttaaccggggtccgtttaaaccggggtaccccgtttacggtaccgggttaccgaaccggttacccccggtaaagggttccccttaccccgggtacccccccgtttacggggacccctttaaccgg

SEQ ID NO: 35613 - DNA, 908 bp, Homo sapiens
  misc_feature: GYAE6OF02F3TJY.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcacatggcctgcacgtggaaccaacagtgatggttagggtatttttagtttgtaccttccgtggtaaccaacgaacctacccccggacgaaaccgacccccctaaaacgttaacttcctaattttaacgtaacggggaacctaaccgttaaacggcccggtaccccggtttacggggggttttaccaaacggttcccgtccgtttacgttaccgtcgggtaccttacccgaaaggttccgttaggaccctaaaccgaccgggtccccttaccccttaggaaccctaaacgttccttaccggtcggggtaccctacccggtacgggacccttacgaacggggaaccggtacgggtcgttacggttaacgttttacgtttttccgtttggtttacgtcccgtttaacgtaacgtttaacgtcggacccggtaaacggggtaaccccgtaaggtcccgttaacgggttttcgggggttacgggttttacccgggggacgggggtaaccgggggttaaccccgttaagggggtttccgtaaaccccgggtttcccggttaacgggtacccgtaccgggtacccccgaaaggggttccccgttaccccgggtacccccccgtttcgggtaccccttaacccggtttcccgttacccggggtttcccccccgtacccccgtttaccccgttaccggttaccccgttaccgg

SEQ ID NO: 35614 - DNA, 636 bp, Homo sapiens
  misc_feature: GYAE6OF02JDC81.45.79.H02.1.454.CMB.1.raw
  modified_base (271)..(271): a, c, t, g, unknown or other
  misc_feature (271)..(271): n is a, c, g, or t
  modified_base (420)..(420): a, c, t, g, unknown or other
  misc_feature (420)..(420): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtcctccgtggcagtcgatcaccatcctcctgcacgtggaaccagctagtgatggttggattactaacttgtctctgtaccacngcacccgagacaacgccccaaatcatgtattatggaggactagtaacgccggcctggtacgggtttctaagtcgtacttctcgtggtcctaccaagtcgtacggacaaccgccgtccctaccgagaacctatcgtacgtggtcctacgngtctaggacggacgtaggtctaggtatttacgtacgtcgactgtacctcgtaacttagtcgtaacggtaggttaagttacgtttacggttttacgggtcggttacggggacgggtaacggtacctaggtccggttaacggtaccccggttacgtcggtaaccgtacccggaccgtaccggtcccgtacccgtccccccggttagtacccgtacccg

SEQ ID NO: 35615 - DNA, 620 bp, Homo sapiens
  misc_feature: GYAE6OF02IOB95.45.79.H02.1.454.CMB.1.raw
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccagcagtgatggtggattataacttgtctcctgtaccaacagcacccagcaaacgccccaactcatgatttangaggcagtaagcggccctgtagggtttactaatcgcttctcgnggtcctaccaagtctggacaacgacgccctcctgactaactctacgtcgggcctccgaggtccgtaggacgggacgacggctagtaactttagttactggtacttgcctacgtattacgtcgtacgtaaggttaagttacgtttaccgtttgggttacggttccggggacgggtaacgggtacccgaaggtccggttaacggtacccggttaccgttacggtccgaaccgcccggtaacggttcccgtcccgggtacccccgtcgggtacctaccccgg

SEQ ID NO: 35616 - DNA, 586 bp, Homo sapiens
  misc_feature: GYAE6OF02ISLDL.45.79.H02.1.454.CMB.1.raw
  modified_base (265)..(265): a, c, t, g, unknown or other
  misc_feature (265)..(265): n is a, c, g, or t
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
  modified_base (561)..(561): a, c, t, g, unknown or other
  misc_feature (561)..(561): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatcctctgcactggaaccagcagtgatgtgggattataccttgtctctggtacaangcaccagcaaacgccccaaatcaatgatttatcgaggacagtaacgcgccctntacgggttctaatcgcttntctcggactcgaagttcaggacaaacgacggtccctaccgtcaactaacttctcgttcgggcctccgaggctagacggacgaggcctagacttattacgtcgtactcgtctacgtatagtacgcgtaaggtcgttaacgttaccgtttgggttcggttacgggcgggacggtaccgtaaggcgtacggacccgttacgtacggtaccacggacccgaaggtccncggtacccccgttgtaccgtacccg

SEQ ID NO: 35617 - DNA, 742 bp, Homo sapiens
  misc_feature: GYAE6OF02JL88H.45.79.H02.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (361)..(361): a, c, t, g, unknown or other
  misc_feature (361)..(361): n is a, c, g, or t
tcagacgcgatcgacacgaccggtgctcgatttagtgtcacacgaagggaaaggggggggtcgacaagaggcagcgctctcgggacgtctccaccatggcctgggctctgctgctcctcactctcctcactcaggacacagggtcctgggcccagtctgccctgactcagcctgcctccgtgtctgggtcncctggacagtcgactcactatctccgtncacgtacggaaccagtcagtgagtggttggtacttactacttacgttctccgtacggtaccaacgacgaccaccgacgaccaaaccgaccccaaacctactacgattttacagtaaggccggtaaagtacgaccggtacccnggtaccgggtttaactaacggtcctacgttcctcgtacgtcctacggtacttcgtacggacaacggaccgtaccctccgtacaaccgactcctacggtcgtaccctcggacgtcgacggacgtaacggacggtcgtagtactttactacgttctacgtcgtctacgattacgacgtacgtacgggttaacgttaacggtttacggtttaggttacgggtttaccgggaccggggttaaccgggtaaccggtacggttacccggtaaccgggttacccgttaccggttaccggtaccggttaaccggtaaccccggtaaccggttttcccggaaccccggttccccccggttaccgttacccggttacccgtttacccccgg

SEQ ID NO: 35618 - DNA, 710 bp, Homo sapiens
  misc_feature: GYAE6OF02JYKZ4.45.79.H02.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (293)..(293): a, c, t, g, unknown or other
  misc_feature (293)..(293): n is a, c, g, or t
tcagacgcgatcgacacgaccggtgctcgatttagtgtcacacgaagggaagggggggtcacaagaggcagcgctctcgggacgtctccaccatggcctgggctctgctgctcctcactctcctcactcaggacacagggtcctggcccagtctgccctgactcagcctgcctccgtgtctgggtctcctggacngtcgatccacntcnctgcatggaacngcagtnatgttggattatacttgtactctggtaccacagcaccgagcaaacgccccaaatccatcgatttanggaggtcaggtaacgccggacccttacggtacggggtttcaaacgtccggtcttaccttcgtacggtcctaccgtaagttcctacgggaccaacgtaaccggcccttaccctagtacctaacgtcccgttcgtacgggtaccttacccgacgggtaccgttcggaacggtaccggtacgggtaccttacgggttaatttaaccgtttacgtaggttaccgttacggtcccttaacgttacgttaacgttacgaccggttaaacggtaacggtttacgggtttaaccgttttccgggttaggttaccgggtacgggtaccggtaccggtacgtaccgttacggtaacccggttcgaaccggtttcgaccggtaccgttacggtccgtacccggtccccgttaccggtcttaaccccgg

SEQ ID NO: 35619 - DNA, 605 bp, Homo sapiens
  misc_feature: GYAE6OF02F0YTZ.45.79.H02.1.454.CMB.1.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggagttataaccttgtctctggtaccaacagccacccaggacaacgacccccaaactcatgactttangaggcagtagccggcctcgagggtttcaatcgcttctctcggctcagtctcggcaacgacgcctcctgacatctcgtagggcctccgaggctggaggacggaggtctaggtattacttacgtgtccgtgtcctatacttagtcgtacgtaggttagttacgtttagttttacgggtggtttaccggggacggaacgggtaaccagggtccgttacgggtaccccgttacgtaacgggtaccgtaaccggacccggtaacggccgttacccgccccccggtttcggtacctaccccg

SEQ ID NO: 35620 - DNA, 617 bp, Homo sapiens
  misc_feature: GYAE6OF02F379O.45.79.H02.1.454.CMB.1.raw
  modified_base (228)..(228): a, c, t, g, unknown or other
  misc_feature (228)..(228): n is a, c, g, or t
  modified_base (269)..(269): a, c, t, g, unknown or other
  misc_feature (269)..(269): n is a, c, g, or t
  modified_base (309)..(309): a, c, t, g, unknown or other
  misc_feature (309)..(309): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattataccttgtctcctgtaccaacngcacccgaggacaaacgcccccaaactcatagtatttagnggaggacaagtaacgcggccccttagtacgggttttactaattcgtcttctacgtcggtctccaagtcgtcggacaaccgcgtccctccgtagaacctaattccgtacgtcgggcctcccgaggcgtacggaggacggagtctagtatttactactgtctcgtactactatagtgtaccgtaagggttacgttagtttcgtttggttcggttcgggacgggtaacggaccgagtccggtcggtaacccggttcgtacggtaccgacgtacccgaggtacccgtccgtacccccgttggtccctacccg

SEQ ID NO: 35621 - DNA, 591 bp, Homo sapiens
  misc_feature: GYAE6OF02G179I.45.79.H02.1.454.CMB.1.raw
  modified_base (302)..(302): a, c, t, g, unknown or other
  misc_feature (302)..(302): n is a, c, g, or t
tcagacgcgatcgacacgaccggtgctcgatttagtgtcacacgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttgtattataactatgtctctggtaccaacaacacccaggcaaagcccccaaactcatcatttangatgtacaataatcggccctgtagggtttctcatcgcttctctggctcagtctggcaagtacgcctcctgaccatctcgtcggcctccgaggtctagaacgacgaggctagtattattactgacagacactatattatttagttcgtttacccacgttcgggtattcgggacggtaacgggacctaaggttcgaaccgttaccgtagggtaccctacggtacccgtaacggtccttacccggtacccccgttcggttaccctacctttcccgttcccgtttaccccccg

SEQ ID NO: 35622 - DNA, 539 bp, Homo sapiens
  misc_feature: GYAE6OF02FVQWN.45.79.H02.1.454.CMB.1.raw
  modified_base (442)..(442): a, c, t, g, unknown or other
  misc_feature (442)..(442): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacagcacccaggcaaacgcccccaaactcatgatttatgaggcagtaagcggccctcgtagggtttctaatcgtcttctctggcctcaagtctggcaacgccggcctccctgaacaatctcgtcgggctccgaggctggacggacgaggctaggtatttatacgtgctgctcatntgcaggtagttacgttagttggtcgttcgggcggtaacggaccagtcgtcgaccgttccgtaggtcacggaccaggtcctcgccccgttggctaccg

SEQ ID NO: 35623 - DNA, 778 bp, Homo sapiens
  misc_feature: GYAE6OF02GD38N.45.79.H02.1.454.CMB.1.raw
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
  modified_base (330)..(330): a, c, t, g, unknown or other
  misc_feature (330)..(330): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcgaggacacgagggtcctgggcccagtctcgccctgactcagcctgccctcgtgtctggtctcnggacagtcatccactatcctcctgctacgtggaacccngctagtcgattggtaggaatttactaaccgttgtactcttcggtaacaactagccaccgacgacaaaccgacccccaaatacacgtagtacttttaagnggacggacgtaacggtaacgccgggtacccttacggtaacggggttttactaagttccgtcgttcttcgtcggtacgttaccgtaacgttcgtacggtaccaaccgtaacccggtcccgttaccctacggaacctaacgttccgttaccgtacgggtaccctaaccgtcgggtacttacgggacggtaaccgtcggtacgtacgttagttaaacgtttcgtacgttaccgtcgtaccggtttactaagttacgttacggacccgttaaggggtttaacggtttacgtttaacggttttccgggttcgggttttacccggggaagggttaccgggggtaacctaacggttccggttaaccggtaccccggttaggttaacccggttacgacccgggtaacccgtacggttacccgtcccggttcccccggttacggttcctaaccccgg

SEQ ID NO: 35624 - DNA, 584 bp, Homo sapiens
  misc_feature: GYAE6OF02IRGVS.45.79.H02.1.454.CMB.1.raw
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (410)..(410): a, c, t, g, unknown or other
  misc_feature (410)..(410): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcatcaccatcctcctgcactggaaccngcagtgatgtgggattatacttgctctgtacacngcaccngcaacgccccaactcatgtattangaggcagtagcgcctgtaggttntaatcgnttctntcgctcagtctgcaacgacgtcctacctgacctaatcgtcgtgggtcctaccgagcgtgacgggacgagtctagtattacttacngtctgcctctagtagtacgtcgtacggttagttacgtttacgtttgggttacggttaccgggtacgggtaccgggtaccgaacggtccgtaccgggtacccgttaccggtacggtaccgaccggtacccgtaagggtccccgtcccggttacccccgtcggttaccctacccgg

SEQ ID NO: 35625 - DNA, 607 bp, Homo sapiens
  misc_feature: GYAE6OF02F0VC0.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctctgtacaacagcacccaggacaacgccccaaactcactagtatttagagagggacagtagccggccctacgtagggtttctaagtcgtcttctctgctaccgaagtcgtaggacaacgacgtccctccctagactaactcgtcgtcgggtcctcgacggcgtggaacggacggaggactgtaattacttacgtcgtctcgtctactatacgtacgaccgacgacgacgtacacgtacgtacttacgttacgttacggtaccgggtacgggaacgggtaacctaaggtcccgtacggtaacccgttaccggtacggtaccgaccggtacccgtacggcccgttaccccgg

SEQ ID NO: 35626 - DNA, 573 bp, Homo sapiens
  misc_feature: GYAE6OF02FYJ49.45.79.H02.1.454.CMB.1.raw
  modified_base (228)..(228): a, c, t, g, unknown or other
  misc_feature (228)..(228): n is a, c, g, or t
  modified_base (299)..(299): a, c, t, g, unknown or other
  misc_feature (299)..(299): n is a, c, g, or t
  modified_base (398)..(398): a, c, t, g, unknown or other
  misc_feature (398)..(398): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggtggattataacttgtctcgtgtaccaacagcaccgagcaaacgccccaactcatgatttangaggcagtaacgcggcctcgtagggttctaagtctcttctcgtcgctcagtctggacacgcgtcctcctgacatctcgtgctccgagtcgtgaggacgngcgtagtattactacgtgtcgtcgcctactatacgtacgacgtagttagttacgttacgttttcggtggttaccgggtacgggaacggtacgaacggtccggtaacgtaccggtaccgtacggtccacggacccggtaacggcccgtacccggccccgttcggtacccttacccg

SEQ ID NO: 35627 - DNA, 659 bp, Homo sapiens
  misc_feature: GYAE6OF02FWV6T.45.79.H02.1.454.CMB.1.raw
  modified_base (213)..(213): a, c, t, g, unknown or other
  misc_feature (213)..(213): n is a, c, g, or t
  modified_base (305)..(305): a, c, t, g, unknown or other
  misc_feature (305)..(305): n is a, c, g, or t
  modified_base (480)..(480): a, c, t, g, unknown or other
  misc_feature (480)..(480): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcncctgcactggaacccagcagtgatggttggattataaccttgtctctcggtaccacagccaccaggcaaacgccccaaatcactgatttagngaggcagtaacgccggccctgagggtttctaatcgtcttcctctcggtcctaccaagtctggacaacgtacggccctcccgtagacctaatcctacgtcgggccttccggaggacgtaggacggaacggtaggtctagtaactttagtacttcgctacgtccttacgattaacgngtaccgtagggttaacgttagttaccggttttaggtacgggtttccggacggggtaaccgggtacccgtaagtacccggttacggaaccccggtttaccggtaacggtacccgtaccggtaaccccgtaagggtccccttacccgggtaccccccgtttccgggtacccttaaccccgg

SEQ ID NO: 35628 - DNA, 607 bp, Homo sapiens
  misc_feature: GYAE6OF02HQHME.45.79.H02.1.454.CMB.1.raw
  modified_base (271)..(271): a, c, t, g, unknown or other
  misc_feature (271)..(271): n is a, c, g, or t
  modified_base (314)..(314): a, c, t, g, unknown or other
  misc_feature (314)..(314): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctcgccctgactcagcctgcctccgtgtctgggtctccgtggacagtcgatcaccatcctcctgacactggaacagcagtgatgttcgggattataacttgtctccgtggtaccaanacgccaacccgaggacaaacgacccccaaaactcatgtattanggaggcagtaacgcgccctgtacgggttacaagtcgtcttctcgtacggcctacgaacgtctcggacaaccgacggccctccgtagaactaacttcctacgtcgggtactaccgagggtctgggaacggacgacggtctagatttacgttactgcttgactcattagttcgacgtaggttagtaagtttcgttttgggtagttccggggagtacgggaacgacgtacgtcggtacccgtcgtaggttaccacgtacccgaggtccgtaccccgtcccgttcggaccttacccg

SEQ ID NO: 35629 - DNA, 786 bp, Homo sapiens
  misc_feature: GYAE6OF02IN8AB.45.79.H02.1.454.CMB.1.raw
  modified_base (266)..(266): a, c, t, g, unknown or other
  misc_feature (266)..(266): n is a, c, g, or t
tcagacgcgatcgacacgaccggtgctcgatttagtgtcacacgaagggaaaggggggggggtcacaagaggcagcgctctcgggacgtctccaccatggcctgggctctgctattcctcaccctcctcactcagggcacagggtcctgggcccagtctgccctgactcagcctgcctccctgtctgggtctcctggacagtcatcaccactcccctgcactggactccagcggtgacgttacttgttttaagatgtctctgtatnagcacaccaggaccaaacgacccccaatcatgtatttagaggacgggacaggtaacgccggtacctacggtagggtttctaacgttcgtcttcgtcgtcggtcctaccgtaacgttcgtacggactaaccgtaccggtacccttaccgtacaactaacttccgtcggtcgggtcccttaccggaggtccgttagggaacgggtaacgggtaggtaccgtacggttaactttaacgttacgttacgtcgttacgtacccttacgtaacgttacgacggttaaccggttaaggggtttaacgtttaacgggttttaccgggttttacggggtttacgggtttaccgggggtaaccgggaaaccgggttaacccgtaaacgggttcccgttaccgggaacccggtttcccgggtaacggttacccggaaccggttacccggtaaacgggtccccttacccgggtacccccgtttaccgggtaccccttacccgtttccccggttaccccgttttccccccccg

SEQ ID NO: 35630 - DNA, 597 bp, Homo sapiens
  misc_feature: GYAE6OF02H3THN.45.79.H02.1.454.CMB.1.raw
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctctgcactggaaccagcagtgatgagtggtagttataaccttgtctcctggtaccaacagcaccagacaaacgccccaactcatgattatgaggacagtaacgcggcctcgtaggggttctaagtcgtcttctcgtgctccaagtctcgcaacgacgtccctccctcgactaactccgtcgtcgggcctccgacggcgngaggacgnggtctagtatttacttacgtcgtctgtctatattatgtacgtaggttagttacgtttacgtttggttcggttacgggacgggtacgggaccgtaacggtccgtaacggtaccggttccgttaacggtcgaccggtacccgaacggtcccgtacccggttcccccgtacggttacccg

SEQ ID NO: 35631 - DNA, 628 bp, Homo sapiens
  misc_feature: GYAE6OF02GGOY8.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtaccaacagcaccaggccaaacgcccccaaactcatgatttatggaggcagtacgccggccctgtagggtttctaagtcgtcttctctggctccaagtcgtacggaccaacgccggtccctcccgtagaacctaactcctcgtcgggcctccgacggtctaggacggacggaggtctagtaatttacttacgtcgtcgttcgccttacagttactcggtacgtaagggttaagttacgtttacgttttgggttccggttacggggaccgggtaacggaccgtaacggtccgtacggtacccgttaccgtacggttccgacggtacccgaggtcccgtcccggtacccccgttcggtaccctacccgg

SEQ ID NO: 35632 - DNA, 657 bp, Homo sapiens
  misc_feature: GYAE6OF02I3WLA.45.79.H02.1.454.CMB.1.raw
  modified_base (312)..(312): a, c, t, g, unknown or other
  misc_feature (312)..(312): n is a, c, g, or t
  modified_base (483)..(483): a, c, t, g, unknown or other
  misc_feature (483)..(483): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcacgtggaacccagcagtgattggttgggagttataaccttgtctcctggtaccaacagccacccaggacaacgaccccaactcatgtattagngtaggacaggtacgccggccctgtacggggtttctaatcgtcttctcgtgtactctagtctcgacaacgaccggtccctcctcgacctatccgtcgtcggtctaccgacggtcgttaggaacggtacggaggttacccgtaggttaactttacgttacgttcgtaccgttntccgtaactagttacgtacgtacggtaagttaaggtacgtttacggttttgggttacgggttcgggacgggtaacgggacccgtaaggtcgtccgggtaccgttaccgtacggtacccgaggtaccccgaagggtccccggtacccggtcccccgttacggtaccgtaaccccg

SEQ ID NO: 35633 - DNA, 627 bp, Homo sapiens
  misc_feature: GYAE6OF02FN46X.45.79.H02.1.454.CMB.1.raw
  modified_base (228)..(228): a, c, t, g, unknown or other
  misc_feature (228)..(228): n is a, c, g, or t
  modified_base (270)..(270): a, c, t, g, unknown or other
  misc_feature (270)..(270): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattataaccttgtctctggtacaacancacccagacaacgccccaaactcatcgtatttagtggagggcaggtaacgcggcctcgtagggtttctaagtcgtcttctcgtgctcctaagtcgtcgacaaccgaccggtccctacccgtgacctaactccgtcgtcgggcctaccgacggcgtaggacggacggaggtcgtagtagtttactacgtcgtccgttgtcttacgtattagtcgtacgtaggttaacggttacgtttacgttttgggttccggttacgggacgggtacgggtaccgtaggtccgtacggtacccggtacgtacggtaccgtacggaccgtacggcccgtcccgtacccccgttcggtaccctacccgg

SEQ ID NO: 35634 - DNA, 680 bp, Homo sapiens
  misc_feature: GYAE6OF02H9XU1.45.79.H02.1.454.CMB.1.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaagcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggagttataaccttgtctctgtaccacagcaccagacaaacgaccccaaactcactgatttataggaggcaaggtaacgccggtcccttacgtacggggtttctaaagttcgtacctttccgttcgtcgggtccttaccgtaacgtctaggccctaaaccgtaccggtccccttacctccggtaacctaacttccgtcgtcgggtccctccgaacggtcgtaggacgggaaccggaggtccgttagtaagttttaacttacgttacgtcttcgtacttctaacgttatcgtacgtaagggttacgtttaaggtttaacgtttcgggttacggttaccggggtacggaaccgggtaccgtaaggtccgtaccggtacccgttaccggttaccggtacgtaccggtacccgtacggcccgtacccgtcccccggtgttaccccg

SEQ ID NO: 35635 - DNA, 535 bp, Homo sapiens
  misc_feature: GYAE6OF02FWOIR.45.79.H02.1.454.CMB.1.raw
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
  modified_base (429)..(429): a, c, t, g, unknown or other
  misc_feature (429)..(429): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccagcagtgatggttgggattataccttgtctctgtaccaanagcaccagcaaacgccccaaatcatgattangaggcagtacgcgcctgtagggtttactaatcgtcttctctcggctccagtctggcaacncgcctcctagacaatctcgtcgggcctcgaggtctggacggacgaggctgtaatttatactgtcgtgctnattatgataggtagtagttacgttggtggtcggacgggtaggaccgtaggtcgtaggtccgtacgtaggtcacgccgaacggcctccggccccgtcgtcctacccg

SEQ ID NO: 35636 - DNA, 611 bp, Homo sapiens
  misc_feature: GYAE6OF02GGJLB.45.79.H02.1.454.CMB.1.raw
  modified_base (366)..(366): a, c, t, g, unknown or other
  misc_feature (366)..(366): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacagcacccagcaaacgccccaaactcatgattatgaggacagtaacgcggccctagtacgggtttctaagtcgtcttctctggctccaagtctgcacncgcctcctagacatctcgtcggctcgaggcgtagcggacgagctgatttactactgtctgctactatcgtacgcgtaggttacgttacggttacgttttagggtcggttaccgggtaccggagggtacctaacggtacggtttaccggtaacccggttcccgggttacgggtacccgtaacggtaccccggtaacggtccccgttaacccgggttcccccggttaccgggttacccttaccccgg

SEQ ID NO: 35637 - DNA, 567 bp, Homo sapiens
  misc_feature: GYAE6OF02GUV3Z.45.79.H02.1.454.CMB.1.raw
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattataccttgtctctgtaccacagcaccagacaacgccccaaatcatnattangaggnagtaacgcgcctcgtagggttctaagtcgtcttctcgtgtctactagtctaggacaacgccggtcctaccgtagtaacctaactccgtcgtcgggtcctcgtacggcgtaggacggtacgacggtcgtagtaattacgttctgcttgctcatagtcgacgtagttagtaggttactttggtcgtacgggcggaacggtaccaaggtccgtcggtaccgttcgtacggtccgacgaccgaacggtcctacccgtcccgtcgtctacccg

SEQ ID NO: 35638 - DNA, 763 bp, Homo sapiens
  misc_feature: GYAE6OF02G2WYM.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatcaccatctcctgcactggaaccagcagtgatggtgggattataaccttgtctctggtaccaacagcacccaggcaaacgcccccaaactcatgattatggaggcagtaagcgccctgtagggtttactaatcgcttctctggctaccaagttcgtacggacctaacgaccggtccctacccgtagtaacctaacttcctaccgtcggggtcctacccggtaacgggtcgttacggaaacgggaccggtaacgggtacccgttaggttaaactttttaacgtttaaccgttcggtaccgttcggtaaccttacctaagtttaacggttacggtaccgttaaaggggtttaacgttttaaccgggttttaacggttttttaccggggtttacggttttacccgggggaccgggggttaaacggggtaccccgtaaaggggttaccccgttacgggttaaccccggtttacccggtaacgggttacccgtaccgggaacccgtaaacgggttcccgtaacccccggttccccccggttaccgggttacccttaaccccgg

SEQ ID NO: 35639 - DNA, 628 bp, Homo sapiens
  misc_feature: GYAE6OF02JBLS1.45.79.H02.1.454.CMB.1.raw
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccngcagtgatggtgggattactacttgtctcctgtacacagcaccaggacaaacgaccccaactcatgtattanggacggacacggtagccggacctcgtaggggttactaacgtcgtcttcgtgtcggtctacctaacggtcgtacggacgtaaccgacgtccctccctacgactaacgttactcgtcggtaccttccgacggcgtaggacggtaacggacggtacgtagtaacgtttaacgttacgttcgtcctacgtctactagttatggacgttaggtacgttacgtttaacgtttgggttacggttcgggacggtacgggacgtagtaccgtacggtacctcggtaacggtccgacgaccgtaacggtccgtacccggtccccgtacgtccgtacccg

SEQ ID NO: 35640 - DNA, 583 bp, Homo sapiens
  misc_feature: GYAE6OF02IS6SY.45.79.H02.1.454.CMB.1.raw
  modified_base (432)..(432): a, c, t, g, unknown or other
  misc_feature (432)..(432): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacagtcgatcaccatctcctgcactggaaccagcagtgatggtggattataaccttgtctcctgtaccaacagccacccaggacaaacgaccccaaactcatgtactttatggagggactagtaagccggccctgtagggtttcaatcgcttctcgtgtcctaccagtctcggacaacgcgcctccagaccaatctcgtcgtactccgaggtcgtggacgacgagctagtattaactntcgctgactcatcgtgtacgtaggttagttagttacgtttggtcggttacggcgggaacggtaccgaaggtccgtacggttacccggtaccgtacggtaccgaccggtacccgaacggtcctacccggtcccccgtacgggttcctacccg

SEQ ID NO: 35641 - DNA, 707 bp, Homo sapiens
  misc_feature: GYAE6OF02HNB3L.45.79.H02.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (658)..(658): a, c, t, g, unknown or other
  misc_feature (658)..(658): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctggtctcgtgacngtcatcacntctcngacacgtggaacngcagtnatggttaggattataccttgtctcgtgtacacngcaccgagaccaacgaccccaaactcattacgtatttagnggacggactaaggtaacggccgtcccttaggtaacgggttttactaacgtccgttctttcgtcgtggtcctaccgtaacgttcgtacggacctaaaccgccgtacccttccgtacggaacctaacgttccgttcggtccgggtacctacccgggtaacggtcgtaacggtaacggggaaccggtacggaccgttgttaaactttacgttaccgttcgcgtttacgctacgtaacgttcgtcgaacggttaacggttagtttaaccggttttcgttttcggggtcggttaaccggggtccgggtaacggtacccgtaaggttcccgttaccgggtaacccgttcgttaccggtaaccncgggaacccgtacgggtcccgtacccgtccccggttcgtaccctacccg

SEQ ID NO: 35642 - DNA, 755 bp, Homo sapiens
  misc_feature: GYAE6OF02ILKSN.45.79.H02.1.454.CMB.1.raw
  modified_base (233)..(233): a, c, t, g, unknown or other
  misc_feature (233)..(233): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctcgccctgactcagcctgcctcgtgtctgggtctccgtggacagtcgatcaccatcggcctgcactggaaccaagngtgatggttgggtatttttagtttcgtctccgtaggtaaccaacaaccgtacccggacggaaccacccctaaacgtaatctaatttacgacggaacacgtaagccggtaccggttcggggtttacaaggttccgtacttcgtcgtcggacctacgtaacgttcgtacggtccaaaccgtccggtccctcccgtaagactactccgttcgtcggtcctccgtagctcgaaggacgagtcctaggtacttttagttctcgttgtaccttataacgttactcggacgttaacgggacctacggtaccgttacgggtttcggggtacggttaccggggtacggggtaaccgggttaccgttacggggttacccggttacccgggtttcgtaaccgggttacccgaccgggttaacccccggaggggttccctaacccccgggttccccggttacgggtaaccctacccggtttcccggttccctccccccgggttacctttccccggttacgttcccggtacccgg

SEQ ID NO: 35643 - DNA, 754 bp, Homo sapiens
  misc_feature: GYAE6OF02GO9XE.45.79.H02.1.454.CMB.1.raw
  modified_base (252)..(252): a, c, t, g, unknown or other
  misc_feature (252)..(252): n is a, c, g, or t
tcagacgcgatcgacacgaccggtgctcgatttagtgtcacacgaaggggaaagggggggggtcacaagaggcagcgctcgtcgggacgtctccaccagtggcctgggctctgctgctcctcactctcctcactcgaggacacgagggtcctgggcccagtctcgccctgacctcacgcctcgcccttccgtgtcgtgggtcctcgtggactagtcgactccaaccattcctacctgccacgtacggaaccngctagtgattgggtaggtaatttaactaccgttcgtcctccgttacggtaaccaacgacgaccacccgaacggtaaccaaacccgacccctaaatcctaagtagttacgtttaagaggacggtacaaggtaaccggccgtacccgtaggttacgggtttactacgtcgtcttacgtcgtcgtcctacgagtctggacaacgtccgtaccctaccgacgtactactcgtacgtcggcctacgacggtcgtacggaaggacgtaggcttagtaattacgttacgcgtacgtcgtacttaacgtacgttcgacgttacggtaacggttttagttacgtttaacgggttttcgggtacgggttaccgggaacggggtaacgggtaccctaaggggtttacccgttaacccgggtaccgggttaccggtacccgggtaacgacccgggtaaccggttccgggttaccccgttcccgggtacccccgttcggtacccctttaacccgg

SEQ ID NO: 35644 - DNA, 546 bp, Homo sapiens
  misc_feature: GYAE6OF02H5PG9.45.79.H02.1.454.CMB.1.raw
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
  modified_base (382)..(382): a, c, t, g, unknown or other
  misc_feature (382)..(382): n is a, c, g, or t
tcagacgcgatcgacacgaccggtgctcgatttagtgtcacacgaagggaaaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggttattataactatgtctcctggtacccaanaacacccaggcaaagcccccaaaatcatgattttangatgtcagtaatcggcctcaggggtttcngatcgcttctctggctaccaagtcctggccaaacacggccctccngacccatctctgggcctccaggctgaggacgaggctggatttatactgacagtctcaattactgaccacgcaagccaagtgaactcttagtacgtttcgggcgggaacgggtacccaagtctagggacccttccgtaaggttcccagtacccccgaaggtcccg

SEQ ID NO: 35645 - DNA, 745 bp, Homo sapiens
  misc_feature: GYAE6OF02JI2D2.45.79.H02.1.454.CMB.1.raw
  modified_base (267)..(267): a, c, t, g, unknown or other
  misc_feature (267)..(267): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccagcagtgatggttggattactaccttgtctctggtaccaacngcaccgaggaccaacgccccaaatcatgtattanggaggcagtaacgcgtccctcgtacggggtttctaatccgtcttcctacgtcggtacctaccgtaacgtcgtacggtaccaaaccgtaccggtccccttacccgtacggaacctaacttcccgtacggtcgggtacccttccggacgggtacccgttagggaaccgggaaccggtacgggtaccgttagttaaaccgttttacgtttaaccgtcgtacgttactccgtttacccgtaagttacgtacggtaccggttaagggtttaacgttaacggttttaccggttttacgggttcggttaccggggtacgggtaaccgggtaccgtaggtacccggtccggttaacccggttaccggttaacgggttacccgtaacccgggtaccccgtaacgggtccccttaccccgggtaccccccgttacgggtaccctttaccccggg

SEQ ID NO: 35646 - DNA, 600 bp, Homo sapiens
  misc_feature: GYAE6OF02GVKQ1.45.79.H02.1.454.CMB.1.raw
tcagacgcgatcgacacgaccggtgctcgatttagtgtcacacgaagggaaagggggggggtcacaagaggcagcgctctcgggacgtctccaccatggcctaggctctgctgctcctcactctcctcactcaggacacagggtcctgggcccagtctgccctgactcagcctgcctccgtgtctgggtctcctggacagtcgatcaccatctcctgcactggaaccagcagtgattttgggattataaccttgtctcctggtaccaacagcacccaggcaaacgccccccaaaatcatgatttatggagggcagtaagccggcctcgtagggtttctaagtcgcttctctggctccaagtctcggacaacgccggccctcccgtgaccaatcctcgtcgggcctccgacggctggaggacgaggtctagtatttattacgtgctgctctatatgacgtaggttacgttagttacgtttggtggttccgggacggtaacgggacctaggtccgtacggtacccggttaccgtagggtcccgaacggtaccccgaagggtcccttacccggtccccccgttcgggtacctaccgttcccgg

SEQ ID NO: 35647 - DNA, 632 bp, Homo sapiens
  misc_feature: GYAE6OF02H14NU.45.79.H02.1.454.CMB.1.raw
  modified_base (227)..(227): a, c, t, g, unknown or other
  misc_feature (227)..(227): n is a, c, g, or t
  modified_base (311)..(311): a, c, t, g, unknown or other
  misc_feature (311)..(311): n is a, c, g, or t
tcagacgcgatcgacacgaccggtgctcgatttagtgtcacacgaagggaaaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaacngcagtgatggtggattataacttgtctcctaggtaccaacacgaccaccgaggacaaacgacccccaaactcatagtatttagnggaaggcagtaacgccgtcccgtacgtagggtttacaacgtcgtctttcgtctcggtctaccaagtcgtaggacaaccgtaccgtcctaccctagaactaacgtccttcgtggtcctaccggaggtcgtaggacggacgaggcttagtaattacttacgtgtctgtactactaatatacggacgtaggttaagtacgtttaggttttcgggtacggttcgggacggtacgggaccgtaacggtcgtacggtaccgtaccgtaacggtaccgaacgtacccggtaacggtccctccggtacccccgtcggtacccttacccg

SEQ ID NO: 35648 - DNA, 623 bp, Homo sapiens
  misc_feature: GYAE6OF02IU7Q3.45.79.H02.1.454.CMB.1.raw
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactggaaccngcagtnatgttggattatacttgtctctagtaccacacgacaccaggacaaccgccccaaactcatgtatttanaggtaggacaagtaacgcggtccctacgtacgggtttactaacgtcgtcttctcgtcgactacagtctgacacgacgtcctacctacgacacttctcgtcggcctaccgagcgtaggaggacgagtccgtataacgtttattacgtgtctcgttctctaagtcgtagacgtaggtagttacgttacgtttacgggttcggttaacgggacgggtacgggtaccgtacgtccgttaaccggtacccgttaccgggtacgtaccggaccggtaacccggaccggtacccgtccccggtcccccgttaccgggtaccttacccgg

SEQ ID NO: 35649 - DNA, 673 bp, Homo sapiens
  misc_feature: GYAE6OF02HRMEY.45.79.H02.1.454.CMB.1.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctggtctctggacagtcgatcaccatctcctgcactggaaccagcagtgagttggttgggattataccgttgtcctcgtgtaccaacagcacccaggcaaacgacccccaaatcatagtatttagaggaggtacaaggtaacgccggacccgttggtacgggtttactagtccgtctttctcgtcggtcctacgtagtcctggacctaacgaccggtccctccgtagaactactcgtacgtcgggcctaccgaggtcgtggacgacggagcgttagtattacgttcgcgtctcgactactaagttacgtagtacgtaaggtttaagttacgttttaacggtttcgggttaggtttccggggacggggaaccgggttaccgtacgggtacccgttacgggtaaccccggttccggtaacgggttacccgaccggtaaccccggtaacgggtcccgttaccccgggtacccccgtttcggtaccccttccccgg

SEQ ID NO: 35650 - DNA, 582 bp, Homo sapiens
  misc_feature: GYAE6OF02FOT18.45.79.H02.1.454.CMB.1.raw
  modified_base (267)..(267): a, c, t, g, unknown or other
  misc_feature (267)..(267): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggattataacctgtctctgtaccaacngcaccagcaacgccccaaactcatgatttatgaggcagtaagccggccctcgtacggggtttactaatcgtactttctactgctccgtaagtcgtggcaacgacggtccctccctgacaatctctggcctcgagctagacggacgacggctgtaattattacgtnacgtnctacgtattagngacgtaggttaagttacgttagtttgggtcggttcgggacgggacgggtaccaaggtcgtcggtaaccgttccgttaacggtccgacgtacccgaacggttcccgtaccggtccccgttaccgggtctacccg

SEQ ID NO: 35651 - DNA, 655 bp, Homo sapiens
  misc_feature: GYAE6OF02G720N.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacagtcgatcaccatctctgcacgtgaaccagcagtgatgtgggtattataaccttgtctcctggtaccaacagccacccaggacaaacgaccccaaactcatgtattatggaggacagtacgcgccgtagtagggtttctaacgtcgtcttctcgtcgtcctacctaacgtcgtaggacaacgaccggtccctcccgtacgactactccgtcgtcggtccctccggacggtcctaggaacgggacggtaacggtccgttagtaactttacgttacgtcggtacctcgtctactaattcgtacgtcgtaagggttagtttaacgtttcggttttgggttaggttaccgggacgggtaaccgggtacgtacggtaccggttcggaacccgtttacggtacgtaccggaccgtaaccggaccggttcccgtccccggtcccccggttacgtcccgttaacccg

SEQ ID NO: 35652 - DNA, 654 bp, Homo sapiens
  misc_feature: GYAE6OF02I8KIM.45.79.H02.1.454.CMB.1.raw
  modified_base (321)..(321): a, c, t, g, unknown or other
  misc_feature (321)..(321): n is a, c, g, or t
  modified_base (597)..(597): a, c, t, g, unknown or other
  misc_feature (597)..(597): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacaggtcctggcccagtctgccctgactcagcctgcctccgtgtctggtcctaccgtggactagtcgatccaccatccgtctgcctacgtggaaccagcagtagagtggttaggattactaaccgttgtacctcgtagtaaccaatcacgaccaggacaaccacccctaatcagtagtacttagnggacgctagaacgccgcctaggtacggttacacgtcgtcttctacgtcggtacctacgtacgtcgtacgtacaccgtaacggtccccttacgagtacctaacgtccgtccgtaaggtccctacggtacgtacgtaggtaacgggacgtacggtactacgttaagttacttacgtacgtacgtcgtactacgtacgtagtcgttaacggtaagttaacgtttagttacggttccggtttacggacgggtacggtaccgtacggtacgtcccggtaanccggttaacgtacgaccgacggtaccgcgtaccggccctaccggtagtacctacccg

SEQ ID NO: 35653 - DNA, 787 bp, Homo sapiens
  misc_feature: GYAE6OF02I60BS.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatccacatcctctgctactacggaaccagcagtgattcggtgggaattacttaaccgttgtctccgtgtaccaacagccacccgagacaaaccgacccccaaataccagttagtagtttagtacggtagggacgtaacggtacggccggtcccgttacgggttacggggtttacctaacgtacggtccttaccttcggtacgtccgtaccgaacggttcgtacggaaccgtaaaccgtacccgggtacccctttcccgaacggtaaccctaacgttcccgttaccggtaccggttccctaccggtacgggtccgtacgggtacggaacggtacgggtactaacgttacgtttaacgtttacgttacgtcgtaccgttaccgtactaagtacgtacgtacggtaacggttacggttacggtttacggttttcgggtaccggtttcggggtaccgggtaaccgggtacgtaaccggttccggtaaccggttaacccggttaccggttaaccggtaccggttaaccggtacccggtaaccgttcccggttacccccggaccccggtttcccggtacccgtttaacccgg

SEQ ID NO: 35654 - DNA, 650 bp, Homo sapiens
  misc_feature: GYAE6OF02HJ9UT.45.79.H02.1.454.CMB.1.raw
  modified_base (306)..(306): a, c, t, g, unknown or other
  misc_feature (306)..(306): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctctgcacgtggaaccagcagtgattggttggattactaacttgtctctgtacacagcaccgaggacaaacgccccaaactcatgtaatttagnggaggcaaggtaacgccggtacctggtacgggttactaacgtcgtcttctctcggctacagtcgtcgacaacgcgccctccgtacgacctacgttcctcggtcggtccctaccgtacgggctaacgggaacgacggacggtctacgttaatttacgtactcgacagtcaacgtaagttattaagtttacgttacgtttacccgtaggttaccgggttacgttccgggaacgggtacggtaccgtaacggttccggaacccggttcggtcggaccgtaccggacccgtaagggtcccttacccggtacccccggttaggtacctacccgttcccggttaccccgg

SEQ ID NO: 35655 - DNA, 708 bp, Homo sapiens
  misc_feature: GYAE6OF02IU3NM.45.79.H02.1.454.CMB.1.raw
  modified_base (236)..(236): a, c, t, g, unknown or other
  misc_feature (236)..(236): n is a, c, g, or t
tcagacgcgatcgacacgaccggtgctcgatttagtgtcacacgaagggaaagggggggggtcacaagaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctagcactggactccgagcggtntacgttacttagttttaagtatgtctcctggtactacagccaaccaccaggaccaaacgccccaaactcattcgtaatttatagtaagttcgtacgtaagtaacgtcccggtaccgttcggtacggggttttcaggtcttcggtcttctcgtggtacctacgtaacgtcgtacggactaaccgtaccggtccctacccgtacgtaccgtacttacggttccgtacgggtccctaccgtaacgggtacctacgggaacggaaccggtaacggtaccgtttacggtaacgtttaacgttaccgtacgtaccgtaacggttaccttacgtaagttacgtccggaccgtaccgacgaacgtccgtaacgtcgtaaccgttacgtaagttacgggttccggaacgggtacggtacctaacgtccgtaacgtaccgtaccgtgtaccgacgtacccggacgtcccgtccggtaccccg

SEQ ID NO: 35656 - DNA, 636 bp, Homo sapiens
  misc_feature: GYAE6OF02IOVBT.45.79.H02.1.454.CMB.1.raw
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctctgcactggaaccngcagtgatgtggattactacttgtctctgtaccaacngcaccaggacaacgacccctaactcatgtatttagnggaggacagtaagtcggtacccgtgtacgggtttctaacgttcgctttccgtcgtcggtcctaccgtaacggtctcggactaaaccgaccggtaccctacccgtacgaaccgtaacttccgtacggtcgggtcccacccgtagggtccgttaggacgggacggtacggaccgttagttaactttacgttacgtcgtacgttcgtactaccgtatacgtagtacgtaaggttacgttagttacgtttgggtagttccgggagggacggtacgacgtcggtacgtaccggttaccgtagtacgacgccgtaacgcccgtaccgccccgttcgactcccg

SEQ ID NO: 35657 - DNA, 652 bp, Homo sapiens
  misc_feature: GYAE6OF02IGT8N.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctcgggtctcctggacagtcgatcacctatcctcctgccacgtggaccagcagtgatggtggattatacttgtctcctaggtaccaacacgccaccgacggaccaacgaccccaaactcatagtattagtaggaggacagtaacgccgtacctcggtacgggttactaatccgtcgttctcgtgtacctacgtacgtctaggaccaacgacccgtccctccgtacactcttctacgtcggtcctaccgtaggccgtaggaccggaacggtacgtcgtagttaacgttactcgtagtccgtgactactagtacgtacgtacggtagtagtttacggttcgtttggggttacggtccggggtaggtaaccgggtaccgacggtccgttaacggtacccggttacgtacgggtacccacgggtaccccgacggtcccggttcccggtaccccccgttacggaccttccccgg

SEQ ID NO: 35658 - DNA, 558 bp, Homo sapiens
  misc_feature: GYAE6OF02JFTHO.45.79.H02.1.454.CMB.1.raw
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (511)..(511): a, c, t, g, unknown or other
  misc_feature (511)..(511): n is a, c, g, or t
tcagacgcgatcgacacgaccggtgctcgatttagtgtcacacgaagggaaagggggggggtcacaagaggcagcgctctcgggacgtctccaccatggcctgggttctgctgctcctcactctcctcactcaggacacagggtcctgggcccagtccgccctgactcagcctgcctccgtgtctgggtctcctggacagtcgatcaccatctcctgcactggaaccagcagtgatgttgggattataccttgtctcctggtaccaacagcaccaggcaaacgcccccaaactcatgatttatgaggcagtaagccggcctcgagggtttctaatcgtcttctcgtgcctcaagtctggcacacggcctccngaccatctcgtgggcctaccgnggctggacggacgaggcttgtattattacgngtcngctntatntcgacgtagtacgttagttacgttgggtgttcgggcggaacgggaccaggccgtcgacccggttcgtacggacnccggaccgtacgtccgtcccgccccgtggtacctcctccgttccccg

SEQ ID NO: 35659 - DNA, 661 bp, Homo sapiens
  misc_feature: GYAE6OF02JOM1U.45.79.H02.1.454.CMB.1.raw
  modified_base (231)..(231): a, c, t, g, unknown or other
  misc_feature (231)..(231): n is a, c, g, or t
  modified_base (426)..(426): a, c, t, g, unknown or other
  misc_feature (426)..(426): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcgatcaccatcctctgcactaggaaccngacgtagtgtagtggttaggtattactacttcgtcctacgtacgtaaccacgacgaccaccgacgaccaaaccgacccctaactcagtgtattagacggacggtacgtaacggtacgccgtaccgttaggtacggttctaacgttccgtcttcgtcgtacgtctacgtacgtcgtcgacacgccgtcctacgtanactacgtcgtcggtacgtcctacggacggtcgtaaggaacgggtacggacgtacgttactacgtttactacggtcgtcttcgtactactagtacgtacgtacggtagttacgttacggtttcggttaggtacgggtacggacgggtaacgaccgtacggtccgtacggttaccgtacgtacggtaccgtaccgtaccggtccggtccgttcccgtacccggtacgtacccgtccg

SEQ ID NO: 35660 - DNA, 676 bp, Homo sapiens
  misc_feature: GYAE6OF02FN3P2.45.79.H02.1.454.CMB.1.raw
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgcctccgtgtctgggtcctcctggacagtcgatcaccatctcctgcactggaaccngcagtgatggttggattataaccttgtcctctcggtaccaacagcacccaggcaaacgccccaaactcactgatttanggaggcaagtaagccggcctcgtaggggtttactaagtcgtcttactcgtcgtctaccaagttcgtacggacctaaccgaaccgggtcccttccccgttacgaaccgtaaaccttccgtccgttacggggccctttacccgacggggtccttagggaacgggtaccgggtacgggtacgttagtaacgttttaacgtttacctcggttcctacgtccgtactagtacgtgtaccgtagggttaaggttacggtttacgttttggttcggttacgggacgggtacgggtaaccagccggttacgacccgttacgttacggtccaccggtcccgaaggtcccgtaccgtcccccggttacgccttacccg

SEQ ID NO: 35661 - DNA, 734 bp, Homo sapiens
  misc_feature: GYAE6OF02G2ZOB.45.79.H02.1.454.CMB.1.raw
  modified_base (290)..(290): a, c, t, g, unknown or other
  misc_feature (290)..(290): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcacgtggaaccaacagtgatggttagggtagttttagtttgtcgttccgtggtaccaaacaaccgaccccggngaacgacccccaaaataactctatttataagggacaactaagccggcccgttcgggggtttacaacggtcgcttctctggtctaccgaagtctggaccaacgaccggcctaccctgaacaattcctcgtcgggcctccgaggccgtacacgggaccgaggtctagtactttagtttctagttcgtcctcgtacttaagtcgtacggtaacgggtaacccgaacggtcccgttaacggtttcgggggttaccgtttccggggaccggggtaaccgggtaacccggtaggggtttaccggtacccggttacccggttacgggttaccgaccggtaccccgtaaagggtcccgttacccggtacccccggttacgggtaccccttaccgttccccgtttaccgtttacccccgtaccccgtttcccttaccggtcccttaacccggg

SEQ ID NO: 35662 - DNA, 713 bp, Homo sapiens
  misc_feature: GYAE6OF02IO61I.45.79.H02.1.454.CMB.1.raw
  modified_base (331)..(331): a, c, t, g, unknown or other
  misc_feature (331)..(331): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcatcaccatcctctgctacgtggaaccagcagtcgagtggtaggacttataaccttgtactcctaggtaaccaacgacgaccaaccgaggaaccaaaccgaccccctaaactcaagttacgtaactttagnggtaacggtaccaaggttaaaccggccggtacccgttacggttacgggtttactaacgttccgtcgttcgtcgtcgtacctaccgtaagttcgtacgacaaccgtccgtcccttaccagaactactccgtcgtacggacccttacgacggtcgtaggtacggaaccgttacggcttaagttagttaacgttcgagtccgttagtcctacgtaactagttccgtaagtaacggttacgtttacggtttacgttcgggtacggttcgggtaaccgggtacgaccgttaggtacccgtacgggtaaccgttccgttaacggtaccgaaccggttaccccgaagggttcccctaccccgggttaccccgtcggttacccgtacccg

SEQ ID NO: 35663 - DNA, 698 bp, Homo sapiens
  misc_feature: GYAE6OF02I3PXU.45.79.H02.1.454.CMB.1.raw
  modified_base (243)..(243): a, c, t, g, unknown or other
  misc_feature (243)..(243): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgaggatcgtcgggccctttctgccctgactcagcctgtcctcgtgtccgtgggtctccgtggacagtcgatcaccatcggcctcgccactacggaacccaacgngtgacgttggttggggttaagttttttagtttcgttcttccgtacggtaaccaaacctaaccgacccccggacgaaccgaccccccaaactaatcctaatttagtacgggaacactaacggcccggtcccggttcggggtttacaaggttccgtacttcgtacgttcggccttaccgtagtacgtcggtaccaacgtcccggtcccttcccgtgtaacctagtcctcggtacggcgtaccgacggtccttacggacggtacggacggtcgtaggtactttagtacctgtctcgtcctagttactgtacgtcgtaggttacgtacggtttcgtttggtggttcggacggggtacggaccgtagtcgtaccggccgtacgtacggcgaccgacggtaacgtccgcccgtcccggtccgtccgtaccttcgtccctacccgtccttcccgtctaccgg

SEQ ID NO: 35664 - DNA, 658 bp, Homo sapiens
  misc_feature: GYAE6OF02GRVKZ.45.79.H02.1.454.CMB.1.raw
  modified_base (280)..(280): a, c, t, g, unknown or other
  misc_feature (280)..(280): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcacatctcctgcactggaaccagcagtgattggttagggtattaacttaaccgttgtcctccttcggtaaccaacncgaccaccccgaggaccaaaccgaccccctaaactcaatgtatttagtaggaggctaaggtacggccggtccctaggtacgggtttactaacgtcgtacctttctcgtcggtccttaccgtaagtcgtacggactaaccgaccggtccctacccgtagaacctaactccgtcgtcgggtcctaccgaggtccgtaggacgggtacgaggtcctagttactttacgttacgtcgtactcgtactactaagtgtacggacgtaggttagttacgttggttggttacggtcgggacggtaggtactacggtcggtacgaccggttaccgtcggtaccgaacgccgtacggtccctacccggtccccgttcgtacctcccgg

SEQ ID NO: 35665 - DNA, 655 bp, Homo sapiens
  misc_feature: GYAE6OF02GEK1N.45.79.H02.1.454.CMB.1.raw
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaaccatcggcctgcacgtggaaaccaacgagtgattggttgggtagttttagttttgtctcctggtaccaacaaccgaccccggacgaacgacccccaaataactctatttacgacgggacacgtaagccggccgttggggttcaagtcgcttcnctgctcagtcngcaacgcgcctccgagacatctcgnggcctcgacgctcgaggacgnggctggtaatttacgttctgttcnctnattgagcgaagggcccagtaccgtaacggtttgggtcgttaccggggacggtacggggtaccgtacggtttccggaacccggttacggttacggtccgtacggaccccgtaacgggtcctacccggtaccccccggttggttacccgaaccgtttccgttacccggtttacccccggtcccctttcccgtttaccgacccgttacccgg

SEQ ID NO: 35666 - DNA, 622 bp, Homo sapiens
  misc_feature: GYAE6OF02IRGHE.45.79.H02.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctctgtgtctgggtctcctggacagtcgatcacntctctgcactggaaaccngctagtgtagttggttaggaattactacttgtctcgtacgtaccaacacgaccaccgacgaccaaccgaccccaactacatacgtattagacgacggacaagtacgtccggtccggttcgggttacgtacgtcgtacttcgtcgtcgtctacgtacgtcgtacgacacgtaccgtcctaccgtacgactactcgtcgtcgtctacgacgctacgacgacgacgtctagtacttacttcgtcgttcgtctactatacgtcgacgacgacgtacgtcgtacgttcggtacggtcgggtacggtacggtacgtacggtaccggtaccggtaccgtacggtaccgtaaccggtacccgtaacggtccgtacccggtacccgtaccggtacctacccgtccg

SEQ ID NO: 35667 - DNA, 665 bp, Homo sapiens
  misc_feature: GYAE6OF02IHK2W.45.79.H02.1.454.CMB.1.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
  modified_base (472)..(472): a, c, t, g, unknown or other
  misc_feature (472)..(472): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcgtggacagtcgatccaccatctcngcacgtggaaccngcagtgagtggtggtattactacttgtcctcgtgaccaanagccaccgagacaaccgaccccaaatcatgtatttagnggagcagacgcgtccgtagtgggttactagtccgtcttcgtcgtcgtctaccgatcgtaggaccaccgaccgtcccttaccgtagaacctacgtctccggtacggtcctccggagtcgtagggaaggtaccggaaggtcgttaagtacttttaacgttacgtcgnttttcgaccttaacgtaacgtattacggaccgttaagggtttacggttaagttttacggtttggttcggttaccggacgggggtaaccgacgtagggtaccgtaccggtacccgttacggtaacggtaccgtacccggtaaccggaccgggttacccgttccccgggtacccgttacccgtcgttaaccccgg

SEQ ID NO: 35668 - DNA, 695 bp, Homo sapiens
  misc_feature: GYAE6OF02JYIDC.45.79.H02.1.454.CMB.1.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgacctcagcctgcctccgtgtctgggtctccgtggactagtcgatccaccatcctcngacacgtacggaacngcagtgtatggtggtacttactaccttgtcctcgtacggtaccaacagccaccgaggacaaaccgacccctaaatctatacgtaactttagacggacggacgtaaggtaacggccggtacccgttaggtagggtttactaacgtccgttactcgtacgtcgtacctacgtagtcgtacgacaaccgtaccgccctcgtacgaactacgtcgtacgtcggtacctacggacgacgtacgggaacggtaccggacggttacgtaacgttactttaacgtacttcgacgttacgtacttccgtaatcggtacgtaacgttaagggtacgtttacgtttaggttcgggttacggttacgggacggggtaaccgacgtacggtacggtccggtaaccgttcgtaacggtaccgaaccggaccgttaccgggccttaccccgggtcccttacggtaccgttaccg

SEQ ID NO: 35669 - DNA, 807 bp, Homo sapiens
  misc_feature: GYAE6OF02F0ZPH.45.79.H02.1.454.CMB.1.raw
  modified_base (230)..(230): a, c, t, g, unknown or other
  misc_feature (230)..(230): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatggttgggtattttagtttgtctctaggtaccaactaaccgaccccggacgaacgacccccaaactaactactaatttaagaacgggaacctaacgtaacggtccggcccgttacgggggtttactaacggtcgtcttctctggcctaccgtaagtctcggaccaaaccgtaccggtccctacccgtacgaacctaacgtccgttaccgtcggggtaccctcccggacgggtccgtagggtaacgggtaaccggacgggtcgttacggtaatttaacttaccgtggtaccttggacccttacgtaagttacttcggtacggttaacgggtttaacggttaggttttacggttttagggttaccggggtttacgggtaccgggggtaacggggtaacccgtaaggggtacccttacgggttaaccccgttaccggttaacggtcccgtaaccgggtaaccccggtaacggtcccggttaccccgggtaccccccgggttacgttacccgttacccgttcccggttaccccggttttccccccggaccccctttcccgttaccccgttacccgg

SEQ ID NO: 35670 - DNA, 677 bp, Homo sapiens
  misc_feature: GYAE6OF02FYCYQ.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcacgtacggaaccagcagtgatggttagggattactaaccttgtcctcgtcggtaaccaactagccaccgagacaaccgaccccaactacatacgtatttacgtggaggactacggtaacgccggtacccgtaggtacggggttttactaacgtctaccgttctcgtcgtctaccgtagtcgtcgacacgtccgtccctcgacgtactaactctcgcggtcctcgacggtcgtaggacggacggacgtctagttaattacgttactggtcctcgtccttacgattagtacgtacggttaagggtaacgtttacgtttaccgggttttaggttccggttacgggggacgttaacggggaccgtacggtccggttaacggtaacccggttaccgttaacggtacccgacgaccgtaaccggtccgttaccccggtcccccggttacggtccccttacccgg

SEQ ID NO: 35671 - DNA, 668 bp, Homo sapiens
  misc_feature: GYAE6OF02JWXR0.45.79.H02.1.454.CMB.1.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (371)..(371): a, c, t, g, unknown or other
  misc_feature (371)..(371): n is a, c, g, or t
  modified_base (625)..(625): a, c, t, g, unknown or other
  misc_feature (625)..(625): n is a, c, g, or t
  modified_base (661)..(661): a, c, t, g, unknown or other
  misc_feature (661)..(661): n is a, c, g, or t
tcagacgcgatcgacacgaccggtgctcgatttagtgtcacacgaagggaaagggggggtcgacaagaggcagcgctctcgggacgtctccaccagtggcctgggctctgctgctcctcactctcctcactcacggacacagggtcctgggcccagtctgccctagactcagcctgcctccgtgtcgtgggtcctccgtagacagtcgaatcaccntcgtcctagctacgcggaaaccngcagtgatgttacgggattaactaacttgtctcctacggtacactacgcaccaggacaacnccccaaactccatcgtactttanggaggtccgaagtaacgcggtccccagttagggttaccctaagttccncttacctcgtacgccgttacgtaacggtcgtcggacaccgtaacggccctttccgagaacctattcctcgtacgggtccctcgtaacgcggttacgacggaaaccgtcgggtacctacgggtacttaactttaacgtcgtagtacgtcccgtatacgtttacgtgaaccggtaggttaccgttaagtttccgttaacggtggttccgggtacgcggtaacgtaggtcccgtaggttacccgacgtaccggtacnccggtaaccgacgtcccgtacgtcccccggtacgtntaccccg

SEQ ID NO: 35672 - DNA, 726 bp, Homo sapiens
  misc_feature: GYAE6OF02F8MAW.45.79.H02.1.454.CMB.1.raw
  modified_base (228)..(228): a, c, t, g, unknown or other
  misc_feature (228)..(228): n is a, c, g, or t
  modified_base (292)..(292): a, c, t, g, unknown or other
  misc_feature (292)..(292): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctcgtgtctgggtctcctggacagtcgatcaccatctcctgcacgtggaaccngcagtgatggttcggattataaccttgtctctgtaccacagcacccagcaacgccccaatcatntattatgaggcagtacgccgcctgtcgggttataagtcgtcttctctggcctccgaagtcgtaggactaaccgaccggtccctcctacggaacctaacgttccgtcgtaccggggtccttaccggacggtcctacgggaacgggtacggtaacggctacggttacgttttaacgttaccttcgggtaaccttgggtaccttaaccgtattaacgttcggaaggttaacgggtttaacgggtttacgtttaacggttttgggttccgggtttaccgggggtaaccggggtacggggtaaccctaacgggtacccgtttaccgggtaaccccggtttaccggttaaccgggtttaccccgaaccgggttcccccggtaaacggggtcccccgtacccgggtttcccccccgtttacgggttaccccttaaccccgg

SEQ ID NO: 35673 - DNA, 610 bp, Homo sapiens
  misc_feature: GYAE6OF02IV2AH.45.79.H02.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcacatctccngcactggaaccngcagtgatggtgggattataacttgtctctgtaccaacagcaccagacaaacgaccccaactacatagtatttagtaggacgggactaaggtaagccgggcccttacggtacggggttactaagtcgtcttctcgtgcctacaacgttcgtaggacctaacgaccgccctacccgtagaacctaactccgtaccgtcgggtcctcccgagggcgtcggaacggacggaggcctagtactttaatacgtgtcgtcgtctactagtatgacgtaggtagttagttcgttttgggtggtcgggcgggtacggacgtagcgtcgacccgttacgtacggtcgtaacgcccgaacggtccgtacccggtccccgtccggcctacccg

SEQ ID NO: 35674 - DNA, 803 bp, Homo sapiens
  misc_feature: GYAE6OF02HZUZN.45.79.H02.1.454.CMB.1.raw
  modified_base (502)..(502): a, c, t, g, unknown or other
  misc_feature (502)..(502): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctcgggcccagtcctcgccctgactcagcctgcctcgtgtctgggtctctggacagtcgatcaccatctctgcacgtaggaaccagctagtgagttgggtttaggggtaatttaacttaaccgtttcgttccttccgtacggtaacccaacgacgaccaaccccgaaggaccgaaaaccgacccccctaaaacgtcctaagtacgttaatttagacggtaacgggacgtaaggttaacggccggtaccccgttacggttaacgggggttttactaacgttccggttcctttcgtccgttcggtaccttaccgtaagttccgtacggtaccaaacccgtacggtcccttaccccgtanaacctaacttccgtaccggtacgggtcctaccggaacggtaccgtacggaacgggtacggacgggtacttaggtaactttaacgttacgttagcgttacgtctaccgtaagttactggtaacgtagggttaacgttagtttaacggttttgggttacggttaccggggtaccgggtaacggtacccgtaacggtccgtaaccggggttcccgttaaccggtacggtaacccgtaaccggtacccggtaaaccgggtcccgttcccccgggtaacccccggttttaccggacccttaccccg

SEQ ID NO: 35675 - DNA, 684 bp, Homo sapiens
  misc_feature: GYAE6OF02JWYTG.45.79.H02.1.454.CMB.1.raw
  modified_base (235)..(235): a, c, t, g, unknown or other
  misc_feature (235)..(235): n is a, c, g, or t
tcagacgcgatcgacacgaccggtgctcgatttagtgtcacacgaagggaaagggggggggtcgacaagaggcagcgctctcgggacgtctccaccatggcctgggctctgctcgctcctcactcctcctcactcagacacgacggtccgtcggccacgtctcgtcctcgtactcgacgtccgtcgcccgttccggtgttcgtcgggtcctacctggggtccagttcgacctacncctactcgaccttaggcgaacctggacctaaggtgaacttgggtcggagtttacgtaaccgttgttacttcgttcggtacctaacgtacgaccaccgacgaccaaacggacccaaactaccaactgtactagtctaggtagcgggtactcgacggttcgtacgttctagtcgtctacgtcacgtctacggcacgtacggactaccgtcgtacacgtctactcgactctacgcgtgacgtacggaggctgagtactctagctacttgctcacgtacacggtctaaggttacttacggtacggttttacggcgggttacgggaccggtaacggtccgtaagggcccgttaggtccggaaacgtttccggaccgtaacgggtcccctaacggggtcccgtttaccccgtacggttccttaccgttaccctaccggtttccctacccgttccc

SEQ ID NO: 35676 - DNA, 762 bp, Homo sapiens
  misc_feature: GYAE6OF02GG2Q6.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcacgtggaaccaacagtgatggttgggtagtttttagtttcgtcttccgtggtaccaaacaaccgacccccggacgaaaccgacccccctaaaactaacttacctaattttaagtaacggggtaaccaacgtaacggccgggtcccgttccggggggtttaccaaaggttccgctttcctcgtcggtccttccgtaaacgtcgtacggaccaaccgaccgggtccctaccctacgaactaactcgtacgtcgggacctccgacggcctacgacggaaccggtacggtcgtagtaactttacgtttcgttacggttgaccttacgtattagttcggacgaacgggtaccaggtccgtaacggtttcggggttacggttaccggggaccgggtacgggaccgttacggggttccgtacccggttaacgtacggtaccgacggtacccgaccggtccgtcccggtacccccgttcggttacccgttaccgtttcccgttacccggtttccccctaaccccgtttcccgttacccgtacccgttaccgg

SEQ ID NO: 35677 - DNA, 770 bp, Homo sapiens
  misc_feature: GYAE6OF02HU1L9.45.79.H02.1.454.CMB.1.raw
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (269)..(269): a, c, t, g, unknown or other
  misc_feature (269)..(269): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctgccctgactcagcctgccctccgtgtcgtgggtctccgtggacagtcgatcaccatcctcctgcactggaaccngcagtnattggttggattatacttgtctctggtaccanagccaccgaggacaacgcccccaaatccatacgattttagaggagggcaacggtaacgccggtaccctgtaacggggttcctaagtccgtcgttactcgtcgggtacctacctaacggttcgttacggaacctaaacgtacccgggtaccccttcccgtacgaactaaaccgttcccttccggtacggggccgtttacccgaacgggtcttacggggaaaccggtaccgggtaacggaccgttaagtaacgttttaaacgtttaccgtacggttaccgtacggttccttaccgttaaagttaacgttcgggtaccgtaaggggtttaacgttaaccggtttagttttttcccggggtaaggtttccggggtaccggggtaacgggaccgtaaacgggtttcgtaacccggttaacccgggttccgttaacgggtacccgtaccggtaacccgtaacgggtacccgttaccccggtaccccgttcccggtaccgttaacccg

SEQ ID NO: 35678 - DNA, 628 bp, Homo sapiens
  misc_feature: GYAE6OF02JXC8E.45.79.H02.1.454.CMB.1.raw
  modified_base (209)..(209): a, c, t, g, unknown or other
  misc_feature (209)..(209): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccntctcctgcactgaaccagcagtgatggtggattataccttgtctctgaccangcaccagacaaccgccccaancgatgtattanggacgganacgtaacgccgtcctggtagggttactancgtcttacgtctcggtctacgtacgtctgaccaacgtccgtcccaccgtacgtaacacttccgtcggtcgtccgccgtacgcgtacgggagtacggtagtcgtagtacttagttacctggtccgtacgtcgtactacgttacgtcgtacggtaagggtttacgttcggtttaacgtttcgggtaaccgggttgggacgggtaccgaacgtacggtaccgtacggtaccgttacgtacggtaccgtaaccggacccgtacggtcccgtaccccggtaccccggttcgtccgtttacccg

SEQ ID NO: 35679 - DNA, 662 bp, Homo sapiens
  misc_feature: GYAE6OF02G4TH2.45.79.H02.1.454.CMB.1.raw
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcgatcaccatctctgcactggaaccagcagtgatggttagggtattactaaccttgtcctccgtggtaccaacacgccaccgacggaccaaacgaccccaaactcatntaatttanggtaggacagtaacggccggtcctacgtaggggtttctacgtagtccgtcgttccgtcgtcggtcctaccgtaagtcgtacgactaacgtacccggtccctccgtacgacctacgttcctcgtcgggtcctacgcggtactacggaacgtacggacgtcttacgtatttacttacgtcgactactacgataacgttaattagtttacgttcgtttaccgtagttcggttacgtacgggtacgggtaaccggtacgttaacgtacggtacccgtacggttacggtacgtaccggtacccgaacggttcccgtccggtaccccgtacggtaccctacttccccgg

SEQ ID NO: 35680 - DNA, 495 bp, Homo sapiens
  misc_feature: GYAE6OF02GSY34.45.79.H02.1.454.CMB.1.raw
  modified_base (429)..(429): a, c, t, g, unknown or other
  misc_feature (429)..(429): n is a, c, g, or t
  modified_base (462)..(462): a, c, t, g, unknown or other
  misc_feature (462)..(462): n is a, c, g, or t
  modified_base (470)..(472): a, c, t, g, unknown or other
  misc_feature (470)..(472): n is a, c, g, or t
  modified_base (474)..(495): a, c, t, g, unknown or other
  misc_feature (474)..(495): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaaccccctccctcaagagtcgagtcaccatatcagtagacacgtccaagaaccagttctccctgaagctgagctctgtgaccgctgcggacacgggccgtgtattactgtgcgagagatcctaaatacgtattactttgatagtaggggtagttttgatatctggggcaagggacaagtggtcaccgtctctcagcctccaccaaggcccatcggtccttcccccgtggccaccctcctccaagacgccacctcgtggggcacgacgccgccgtggctgccgtgacaaggactactccngtactcgcgtctggacggcggcgtggcaaggcncacgtagnnngnnnnnnnnnnnnnnnnnnnnnn

SEQ ID NO: 35681 - DNA, 752 bp, Homo sapiens
  misc_feature: GYAE6OF02IHMJ6.45.79.H02.1.454.CMB.1.raw
  modified_base (125)..(125): a, c, t, g, unknown or other
  misc_feature (125)..(125): n is a, c, g, or t
  modified_base (139)..(139): a, c, t, g, unknown or other
  misc_feature (139)..(139): n is a, c, g, or t
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (334)..(334): a, c, t, g, unknown or other
  misc_feature (334)..(334): n is a, c, g, or t
  modified_base (691)..(691): a, c, t, g, unknown or other
  misc_feature (691)..(691): n is a, c, g, or t
tcagacgcgatcgacacgaccggtgctcgatttagtgtcacacgaagggaaggggggggtcacaagaggcagcgctctcgggacgtctccaccatggcctgggctctgctgctctcactctcctnactcgaggacacgnggtcctgggcccagtctgccctgactcagcctgcctccgtgtcgtggtctcctggaccagtcgatccacntcctcgngccacgtgaaccngcctagtgtacttggtacgggacttactaccttcgtctccgtagacctagacgtccaccgaggaccaaaccgaccccgtaactacagttaccgtaacgtttaagnggacggtactaacggtaacggtcccggtaaccctagggttaccgggtttaactaaccgtcggttcctttacgtccggtaaccggtcgtaccgtaacggtttcgtaccgggacctaaaccgtcccgtccgttaccgtacggtaaactccttccgtcggtttcgggacccgtacccggtacggtacgttacgggaaaccggtcgggtagtacggttacgttaacgtttacgtttaaccgcggttacgtcggtctaacctaggtaccgttgaaccggttagttacggttaaggtttccgtttggggttcggttaaaccgggtaccgggaacgtacgttagggtcccgaaaccggtttccnccgggttagacccggtatacccgggactcccgttaaccggtcccgttaccggcttaacccg

SEQ ID NO: 35682 - DNA, 756 bp, Homo sapiens
  misc_feature: GYAE6OF02IZELZ.45.79.H02.1.454.CMB.1.raw
  modified_base (638)..(638): a, c, t, g, unknown or other
  misc_feature (638)..(638): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacaggatcgtgggccctttctgccctgactcagcctgcctccgtgtcgtggtctccgtggacagtcgatcacctagtcggcctgccacgtacggaaccaagaggtagacttggttaggggtagttttttagttttcgtccgttcccgttaggtaacccaaaccgtaaacccgaacccccccgggtagaaaacccgacccccccgaaaaacttaaactacctaaagtttttaacgaacggggaacctaaacgttaacgggcccgggttaccccggttacgggggtttaccaaacggttccgtaccgtttcctcgttacggtcctaccgtaaagtccgtacggacccaaaccgaccggtccccttcccgtaagaacctaacttccgtcgtcgggcccttaccgacgggtcctacgacgggtacggacggctaggtatttacgtttcgtgttacgcttacgattagcgtcgacggaccagtcgttcgttcgggtgttaccgggnggtacggtactacggttcgaccgttcgtacggccacgccgaacggtccgttacccgccccgttagggtaccctaccgtttccgtccggttcccccgcctttccgttccgtaccgtccg

SEQ ID NO: 35683 - DNA, 746 bp, Homo sapiens
  misc_feature: GYAE6OF02HFE20.45.79.H02.1.454.CMB.1.raw
  modified_base (233)..(233): a, c, t, g, unknown or other
  misc_feature (233)..(233): n is a, c, g, or t
  modified_base (477)..(477): a, c, t, g, unknown or other
  misc_feature (477)..(477): n is a, c, g, or t
  modified_base (552)..(552): a, c, t, g, unknown or other
  misc_feature (552)..(552): n is a, c, g, or t
  modified_base (559)..(559): a, c, t, g, unknown or other
  misc_feature (559)..(559): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatccacctatctcctgcacgtggaacccngccagtgagttggtgggtattaactaaccgttgtcctcgtacggtaccaacacgccacccaaggaccaaaaccgtacccccaaaactaccgtaattacggtaactttaggtcgggaaggtaccgtaacggtaacggtcccggtacccttaccgggtaggggtttacctaacgtccgtcttaccgtacgtcgtaacctccgaaacgtttctacgggacctaaccgtacccggtcccttacccgtntaaccgtaactcgtaccggtcggtcctaccggtacggtcgtaggaacgggacgtaggtccgtagtacgtttaacncgttacncgttcgaccttcgattacgtacggtaccgtagggttacgtttacggtttacggtttcggttacggtcggggacgggtaacgggtacccgtaaggttcccgggtaagtacccccggttataaccgggttcaaacccgggtacccgtacggtacccgtaccccgggtaccccgttggtaccccttccgg

SEQ ID NO: 35684 - DNA, 607 bp, Homo sapiens
  misc_feature: GYAE6OF02JLS3I.45.79.H02.1.454.CMB.1.raw
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (414)..(414): a, c, t, g, unknown or other
  misc_feature (414)..(414): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcatcaccatctcctgcacgtggaaccagcagtgatggtggattatactgtctctggtaccangcacccgagacaacgccccaatcatgattangacggacagtaacgccgccctagtacgggttctaacgtcgtcttcgtctcggtacctaccgagttcgacgacaccgtacgccctcagactacgtcgtcgtcggctacgagcgtgacggngaggtctagtattactacgtgtctcgtctactatgtacgcgtaggttagtacgtttaggtttggttcggttacgggacgggtaaccggtacgtaaccggtcgttaccgggtacccgtttcggtaacggttaccgtaaccgacccggtaagggtccccgttccccggtacccccgttacggttaccctacccgg

SEQ ID NO: 35685 - DNA, 696 bp, Homo sapiens
  misc_feature: GYAE6OF02JROLD.45.79.H02.1.454.CMB.1.raw
  modified_base (140)..(140): a, c, t, g, unknown or other
  misc_feature (140)..(140): n is a, c, g, or t
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacngggtcctgggcccagtctgccctgactcagcctgcctccgtgtcgtgggtccnccgtggacagtcgatccacngtcctctgcacgtggaccagcagtgattggtggtattactacttgtctcgtacgtaccacgagtccaccgtaggaccaaaccgacccctaactctagtacgttagttacgaggtacggacctaggtacggccgtaccgtcggtagggtttactacgtcgtacttcgtacgtcgactacgtagtcgtcggacaaccggtccgtcctaccgtacgaactactccgtcggtcgccttacggacgttacgtacggacggacggtacgtacggtactaagtttaccgttacgtaccgtctaccggttatcgtacgttacggtacggttaccgtaaggttacgttacgggttttacgttagggtcgggtaaccgggacgttaaccgggccgtaaggtccgttccgggtaacccgtttccggacgttaccggtaccgtaccggggacgtttcccccgtaacccggtccccggttacgacccgttacccgg

SEQ ID NO: 35686 - DNA, 692 bp, Homo sapiens
  misc_feature: GYAE6OF02HI1Z1.45.79.H02.1.454.CMB.1.raw
  modified_base (229)..(229): a, c, t, g, unknown or other
  misc_feature (229)..(229): n is a, c, g, or t
tcagacgcgatcgacacgaccggtgctcgatttagtgtcacacgaagggaaagggggggggtcacgaagaggcagcgctctcgggacgtctccaccatggcctgggctctgctgctcctcactctcctcactcaggacacagggtcctgggcccagtctgccctgacctcagcctgccctccgtgtcgtggtctccgtggacagtcgatcaccatctctgcactgaacngcagtgatggtaggtattactaacttgtctcctagtaccaacagaccaccagaccaacgaccccctaaatcatagtattagtggtaggactagtaacggccggtccctacggtagggtttcctaacgtccgtacttccgtcgtcggtaccttaccgtacggttcgtacggacctaaccggacccgtacccgtaccccgtacgaaccgtaaccgttccgtaccggtcgggtaccctacccggtacggtccgtaggtaacgggacgtacgggtacgtacgtaatttacgtttaacgtcgtacttacgtctacgtacgttagtacggtacgtaggttagttaacgtttcggtttcgggtacggttacgggacggtacgggtactacggtcgtaaccggaccggttcggtaccgtacgaccgtcccgaggtcccgttacccggtccccgttacggtcccttacccgg

SEQ ID NO: 35687 - DNA, 710 bp, Homo sapiens
  misc_feature: GYAE6OF02J01DN.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctaggacagtcgatcaccatcgtcctagcactggaaccagcagtgattggtaggattataccttgtctctgtaccacacgacaccaggaccaaaccgacccctaactcagtcgtagttacgaggaggacgaacggtaacggccggacccgtacggtaggggtttactaacggtccgtacttctcgtcggtctaccgtagtccgtagacctaacgtccgtccgtcccgtacgaactacttccgtaccgtcggaccgtccgaggtaccgtaggacggtacggtacgtccgtaagtagtttacgttacgtcggtaccgtacgtccttaccgagttacgtggttaacgtacgggtttaacggttttcggtttaacgttttcggggttacggttaccggggtaacggacgggttaccgagttacccgtaaccggttacccggttaccgttaaacgggttaccgaccggttaccgtaacccgggttaccgtcccggttacccccgtttccgggtaccttacccg

SEQ ID NO: 35688 - DNA, 781 bp, Homo sapiens
  misc_feature: GYAE6OF02JJL3D.45.79.H02.1.454.CMB.1.raw
  modified_base (229)..(229): a, c, t, g, unknown or other
  misc_feature (229)..(229): n is a, c, g, or t
  modified_base (267)..(267): a, c, t, g, unknown or other
  misc_feature (267)..(267): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgctactggaaccngcagtgatggtaggattactactgtctcgtgtacaacncgccaccgagacaaccgccccaaactcatcgtattagtcgaggactacggtaacggccggtacccgttacgtacggggttttacctaacgttcgtccgtttccgtacgttcggtaccgtaccgtaacggttccgtaccgggtaacctaaacccggtacccggtccccgttaccccgtacggtaaacctaacgtttccgttaccgtaccgggtacccgtaccggtaccgtcgtaacgggtaacggacggtacggtacgtacgttaacgttaacgttacgttacggtacgtacgtccgtacgtaacgtacgttacgaaccgttaagggttaacggttaacgtttaaccggtttcgggttacgggttaccggggtaccggggtaaccgggtaccgttaacggtaccggttaccgggttaaccccggtttaacgggtaaccggtaaccgtaaccgggtacccggtaaaccggtcccgttaaccccggttaccccggttaccggttacccgttacccgg

SEQ ID NO: 35689 - DNA, 688 bp, Homo sapiens
  misc_feature: GYAE6OF02HRVSO.45.79.H02.1.454.CMB.1.raw
  modified_base (234)..(234): a, c, t, g, unknown or other
  misc_feature (234)..(234): n is a, c, g, or t
  modified_base (279)..(279): a, c, t, g, unknown or other
  misc_feature (279)..(279): n is a, c, g, or t
  modified_base (323)..(323): a, c, t, g, unknown or other
  misc_feature (323)..(323): n is a, c, g, or t
  modified_base (475)..(475): a, c, t, g, unknown or other
  misc_feature (475)..(475): n is a, c, g, or t
  modified_base (504)..(504): a, c, t, g, unknown or other
  misc_feature (504)..(504): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatccacctatcctccgtgccacgtggaaccngcagtgagttggttgggtattactaccttgtcctcgtgaccaacncgccaccgaggaccaaaccgaccccaaactcatcgttaattagnggacgactaaggtaacgccggtaccttaggtacgggtttacacgtccgtcttctcgtgcctacgtacgtcgtcgactaaccgccgtccctccgacgtaactacttccgtacggtcggtacccgtacgacggtccgtaagggacgggaacggnggttcgttagtaactttaccttgacgttntaccgtctagtactacggttcgacggttaggttacgtttacggtttacggttcggggttaccggtacgggggtaccgggtaaggacccggttacggtaccggttaaccggtacccggttaccggtacggacccgacggacccggtacgtcccgtccccggttacccgtccggtaccttacccgg

SEQ ID NO: 35690 - DNA, 742 bp, Homo sapiens
  misc_feature: GYAE6OF02F2P00.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctttgctgctcctcactctcctcactcaggacacgagggtcctgggcccagtctcgccctgactcagcctgcctcgtgtcgtgggtcctccgtggacagtcgatccaaccattcctcctgcctacgtacggaacccaggccgagttacgtagttgggttacggggtaatttaacgttaacccgtttcgtccgttacccgttacggggtaaaccctaaacgacggacccaaccccggtaacggaacctaaaacccggaccccccctaaaacttacaacgttagtaacgttttagaggaacgggtactaacggtaacggcccgtaccgtagggttacgggtttactaacgtcgttccgttaccgtcgtacggtcctaccgtagtccgtacggacctaccggaccgtccctccgtacgaacctactcgtcgtcggtcctaccgaggtcgtacggaggacgacgggtctaacgtactttacgttacgtctacgtcgtcttaatagttacgtgtacggttaggtaacgtttacgttcggtttagggttcggaggttaccgggaacgacggtacgtcgtacgggtactcggtacgtcgaccgtacgtacgtaccgtcccgtcccgtcggtaccgtcgttcccg

SEQ ID NO: 35691 - DNA, 656 bp, Homo sapiens
  misc_feature: GYAE6OF02H775A.45.79.H02.1.454.CMB.1.raw
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctcgggcccagtctgccctgactcagcctgcctcgtgtctgggtctccgtggactagtcgatcaccattcctcctgacactcggaaccagcaagtgagtggttgggactttataaccttgtctccgtgtaccgaacagccaccagacaacgaccccaaacnctatcgtatttancggaggcagtaacgcgccgtcgtagggttactaatcgtcttactcgtcgcctcaacgttcgcgactacgacgtccctcctagactactctacgcgggtcctaccgcgactggacggaacggtacggtcgttagaatttacgttactcgtctgtctaccgtatacgtcgaccgtaggttacgttacgttacgtttacggttgggttaccggtaggggtaaccgggaaccgtaacggtaccggttaccggtaaccggtttaccggttacgggaaccgttcccgggaaccggtaacgggttccgtcccggtcccccggttacgttaccgtttaccccgg

SEQ ID NO: 35692 - DNA, 715 bp, Homo sapiens
  misc_feature: GYAE6OF02JTJCJ.45.79.H02.1.454.CMB.1.raw
  modified_base (149)..(149): a, c, t, g, unknown or other
  misc_feature (149)..(149): n is a, c, g, or t
  modified_base (228)..(228): a, c, t, g, unknown or other
  misc_feature (228)..(228): n is a, c, g, or t
  modified_base (329)..(329): a, c, t, g, unknown or other
  misc_feature (329)..(329): n is a, c, g, or t
tcagacgcgatcgacacgaccggtgctcgatttagtgtcacacgaagggaaagggggggtacgacgaagaggcagcgctctcgggacgtctccaccatcggcctgggctctgctgctcctcactctcctcactcaggacacagggtccngggccagtctgccctgactcagcctgcctccgtgtctgggtctctggcagtcgatcacatctctgcacgtcggaaaccngccagtgactggtgggacttataaccttggtctccgtcggtaccaagtacgcctaccaggacctaaacggccccctaaacgtccacgtacgtaacttttancggaacggtcgaagtaaacggccggtcccctacggtacggggtttactaacgtcgtacgttctcgtacgcttaccgaagttcgtcggactaacgaccggttccctaccgtataaccgacttccgtacgttcggaccctccgtacggtcctacggtacggtacggacgtcgtacgtaacgttacgttttaaccgcggtcctcggtacctacggtacgttacgtaacgtacggtaaggttacggttacgtttacgtttcgggtacggttccgggtaacgggtcgggtaacgaccggttcggttaacggtacccggttaccggttaacggttcgtaacggtcccggtaacggtccgttacccgggtacccgttaccggtacctacccgg

SEQ ID NO: 35693 - DNA, 778 bp, Homo sapiens
  misc_feature: GYAE6OF02JD8Q0.45.79.H02.1.454.CMB.1.raw
  modified_base (225)..(225): a, c, t, g, unknown or other
  misc_feature (225)..(225): n is a, c, g, or t
tcagacgcgatcgacacgaccggtgctcgatttagtgtcacacgaagggaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctctgcactggaaccngcagtgatggttgggatttactaaccttgtctccgtggtaccaacagccacccaggcaaacgcccccaaatcgatcgtaatttatcggacggtctaaggtaacgccggtccctgtacgggggtttctaagtccgtctttctacgtcggtcctaccgtaacgtcgttaccggaccaaccgtaccgggtccccttaccccgtaggtaaaccctaacgttccttcccggtacggggtcccgttacccgacgggtccgtacgggacgggaacggtaacgggcctacggtaactttacgtttacccgtagtccgttcgtacctcgtaacgttagtacggtaccggttaagggttaacgttacgttttaccggttttggggtaaccgggttttcggggaccgggggtaaccggggtaccgttaacgggtcccggttaaccgggttaacccccggttacgggtttaaccgggtacccgtaacccggggttaccccgtaaccggggttccccgttaacccgggtccccccgggtttaccggtaccccgttttaacccccgg

SEQ ID NO: 35694 - DNA, 731 bp, Homo sapiens
  misc_feature: GYAE6OF02HJLPO.45.79.H02.1.454.CMB.1.raw
  modified_base (277)..(277): a, c, t, g, unknown or other
  misc_feature (277)..(277): n is a, c, g, or t
  modified_base (321)..(321): a, c, t, g, unknown or other
  misc_feature (321)..(321): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcacgtaggaacccagcagtgagtggttgggattataaccttgtctctacggtaccaacncgaccacccgaggaccaaaccgacccccaaatcatgtatttagnggagggctaaggtaacgccggacccttggtacggggtttactaacgtccgtacttcgtctcggtctaccgtaagtcgtacggacgaaccgtaccggtccctacccgtagaacctacgtaccgtccgacgggtcctaccggaggccgtagggacggaacggtggtaccttaggtaactttaacgttacgtcgccgttagtctcgttaaatcgtacggtacgttaagggttaacgttaacggtttccgttttgggtacgggtttccggggacggggttaacgggtaacccgtacggttaccgggtaaccggtaccccggttaccgggtacggttacccggaacccgggtacccggtaaccgggtccccgttaaccccggtaccccccggtttcggtaccctttaaccccggg

SEQ ID NO: 35695 - DNA, 826 bp, Homo sapiens
  misc_feature: GYAE6OF02J2QC6.45.79.H02.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacngtccgatccaaccatcctcctgcacgtggaaacccngcagtgagtggttaggaattacgtaaccttgtcctcgtcggacaacacgacacccaggacctaaaccggccccctaaatctactagttaactttagaggtacggacgtaacggtaaccgggtccgtaccggttaccggtacggggtttaacctaagtccggttccttaccgttccggtaccggtacccttaccgtaaggttccgtaacggtaccgaaacccgtacccgtccccttacccgtacgaacttaacgttcccgacggttccggtaccctacccggtacgtacgggtacggaacgggtaaccggtaggtcccgttaaggtttaactttaacgtttccgtccgggtttacctaggttacccctttaccgtaagtttaccgggaacggtaccggttttaaacgggttacggttttaaccggttttacgggtttccggggttacgggtttaccggggaccgggtaaccggttacccgtaaccggttccgggtaaaccggtcccggttaacggtaccgggtaacgtaccccggtacggtaccggtcccgttacccccggtccccggtttacggtaccgtttacccccgg

SEQ ID NO: 35696 - DNA, 795 bp, Homo sapiens
  misc_feature: GYAE6OF02F8R2M.45.79.H02.1.454.CMB.1.raw
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
tcagacgcgatcgacacgaccggtgctcgatttagtgtcacacgaagggaaagggggggggtcacgaagaggcagcgctctcgggacgtctccaccatggcctgggctctgctgctcctcactctcctcactcaggacacagggtcctgggcccagtctgccctgactcagcctgcctccgtgtctgggtctcctggacagttcgatcaccatcctcctgcacgtggaaccngcagtgatggttggattataccttgtctctgtacaacagccaccgagacaaacgccccaactcatgtatttagnggaggcaaggtacgccggtccctagtagggtttactaagtccgtacttctcgtcggtcctaccgtaaggttcgtacggtaccaaaccgtaccggtaccctacccgtacggtaacctaaacgttccgttaccggttaccgggtacccgttaccgtaacgggttccgtacgggtaacggggaaccgggtaacgggtacgttaggttaaacgttttaacgtttaccggttacggttaccgtacgtccgttaacttaacgttaacgttacggtaaccgttaacggggtttaacgtttaacggttttaccggtttttacgggttaccgggttttaccggggacggggttaaccgggtaacccggtaaggttcccggttaacgggttaccccgtttaccgggttaaccggttaccggtaacccggtacccgggtaaacgggttcccggttaccccgggtaccccccggttacgggttaccccgtttaaccccggg

SEQ ID NO: 35697 - DNA, 752 bp, Homo sapiens
  misc_feature: GYAE6OF02I1UO6.45.79.H02.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
  modified_base (374)..(374): a, c, t, g, unknown or other
  misc_feature (374)..(374): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggaacnggtcgatcacctatcctcctgcacgtggaaccngcagtgatggttggattactacttgtctctgtaaccacncgccaccgagaccaaacgcccctaactcatacgtatttagcggacggtctaaggtaaccgccggtaccctaggttacgggtttactaagtccgtctttacncgtacgtacctacctagtcgtacggactaaccgtaccggtcctacccgtagtaaccgtactccgtaccgtacgggtccctaccggtaacggtccggtaggtaccgggaacggtacggtccgtattaccgtttaatacccggttagttaccctggttacctacgtaagttaccgtacggttaacggttaaggtttacgtttaacgtttccggggtttttaacgggttccggggttaacccggggaacggggttaacccggaaccgttaacgggtacggttacccggtttaccccggaacgggttttaaccggaacccgtaccgggaaccgttaaccggcccgtttaaccccggtcccccgttaggtacccgttacccgg

SEQ ID NO: 35698 - DNA, 741 bp, Homo sapiens
  misc_feature: GYAE6OF02HILZD.45.79.H02.1.454.CMB.1.raw
  modified_base (232)..(232): a, c, t, g, unknown or other
  misc_feature (232)..(232): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgcctccgtgtcctgggtctccgtaggtcagtcgatcaccatctctgcacgtggaaccngacagtcgagtcggttggggtaattactaaccgttgtcttaccgtcggtaacctaacaggacctacccgacggaccgaaaaccgaccccctaaaactccaagttgtaactttagtacgggacggacgtaaggttaaccgccggtacccgttggttaaccggggtttactaacgtcgtccgttacgtctcggtcctaccgtaagtcgtacggaccgtaccgtcccggccttacccgtagtaacctaactcgtccgtacgggcctaccgcgggtacgtacggacgggtaaccgagtacgtagtaacgtttaacgtctacgtcgtgtactacgtactagtcgtaggtaacggttaagttcgttaaccggtttggggtacgttacggggtaccgggtaaccggtaccgggtaactccgggttacggttacccggtacggttacgggtacccgtcggaacccggtacgggtacccgttaccccggtccccggtttacccggtacccgtacccgg

SEQ ID NO: 35699 - DNA, 686 bp, Homo sapiens
  misc_feature: GYAE6OF02J0VTT.45.79.H02.1.454.CMB.1.raw
  modified_base (198)..(198): a, c, t, g, unknown or other
  misc_feature (198)..(198): n is a, c, g, or t
  modified_base (498)..(498): a, c, t, g, unknown or other
  misc_feature (498)..(498): n is a, c, g, or t
tcagacgcgatcgacacgaccggtgctcgatttagtgtcacacgaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatctcctgccactcggaaccagctagtcgatggttgggattactaaccttgtctcctggtaccaacagctacccaggacaaacgcccccaaatcaatgatttatcggaggacagtacgcggtaccttaggggtttcctaatcgtcgttctacgtggtctaccaacggttctcggtactaaaccgccgggtccctcccgttacggaaacctaacgttccttaccggtcgggtcctacccgtaagggtcttaacgggacgggaccgtagggtaccttggtaatttacgtttnttacggttacgtaccgttcaacgttagttacggccgtacgggaacccgtaggtaacccgttaggtttacgggttgggtacccgggtcggggtaacgggtaccgttacgggttcgtacccggtcggttaacggtcgtaccggacccgtaaggtcctcggccccccgtggtccacgttaccgttccccgg

SEQ ID NO: 35700 - DNA, 719 bp, Homo sapiens
  misc_feature: GYAE6OF02GW3EO.45.79.H02.1.454.CMB.1.raw
  modified_base (236)..(236): a, c, t, g, unknown or other
  misc_feature (236)..(236): n is a, c, g, or t
  modified_base (307)..(307): a, c, t, g, unknown or other
  misc_feature (307)..(307): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggactagtcgactccaccatcctcctgccacgtggaaccngcagtgatggtggattactaccttgtctctgtaccacacgacaccaggacaaaccgaccccaaactcagtntatttagtggaggtacaggtaacgcggtccctaggtacgggtttactaagtccgtcttctcgtgtctaccgtaagtcgtacggactaaccgtaccggtcccttacccgtacgaacctaacgttccgtcggtcgggtccctccggacggtcgtggaacggacggtacgggtcgtaggttaactttacgttacgtcgtaccttgtcctactagttacgtcgggtacgttaagggttagtttaacggtttacggttttacggggtggtttacccggggaacggggtaacgggttaccgtacgggttaccgttaacccgggttaccggttaccggttaaccggtcccgtaaccgggtacccggtaacgggtccccggttaccccggtcccccggttacggttaccccttaccccgg

SEQ ID NO: 35701 - DNA, 775 bp, Homo sapiens
  misc_feature: GYAE6OF02FTQOW.45.79.H02.1.454.CMB.1.raw
  modified_base (271)..(271): a, c, t, g, unknown or other
  misc_feature (271)..(271): n is a, c, g, or t
tcagacgcgatcgacacgaccggtgctcgatttagtgtcacacgaagggaagggggggggtcacaagaggcagcgctctcgggacgtctccaccatggcctgggctctgctgctcctcactctcctcactcaggacacacgggtcctgggcccagtctcgccctgactccagcctgcctccgtgtctgggttctcctaggcagtcgatcaccatctcctgcactaggaaccagcagtgatgttgggattactaactgtctcgtgtaccacngaccaccgaggacaaaccgacccccaaactcacgttcgattttaatgaagggtccagtaacggccggtccgttacgagggttttctaagtcggtccttccggtcttcgggacctaccggtaagttccgttaggacctaaccgacgtaccccttacccgtaggtaacctaagttcccttaccggaggggttacccttacccggaacggttccggtaacgggaaacgggtaacggggaggttccctaaggtttaacgttttaacccgttactacgggtctacggtaccttaccgtaagtttagaacgttccgtaaagggtttaaacgtttcggttttaaacggtttccgggtttaaaggttttccggggacgggggtaccgggttaaaccgaccggtacggttaacccgggtacccggttaacccgttaacgggttacccgaacccggtaaccggaaccggtttccgaaccccggttccccccggttacgtacccggtttaacccg

SEQ ID NO: 35702 - DNA, 769 bp, Homo sapiens
  misc_feature: GYAE6OF02I13IR.45.79.H02.1.454.CMB.1.raw
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (467)..(467): a, c, t, g, unknown or other
  misc_feature (467)..(467): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacaggatcgtcggtccctttctcgccctgactcagcctcgcctccgtgtctgggtctccgtggactagtcgatcccccccanagtcggcctgcacgtacgaaaccaanagtgagttggttgggttagtttttagtttcgttcctaccgttaggtaaccctaaacgaaccgacccccgggacaaaccgaccccctaaaataactacctattttaacgaacggaccaacgttaacgggcccggtacccggttacgggggtttacaacggttccgtactttctcgtcggtccttaccgtaagtccgtagaccaaacgtccggtaccctccganaactaacttccgtcgtcgggacctacgacggtctcgaacgggacgtaggtcgtagttactttacgttttcgttacggttcgtacttcgtaagttacgtcggtacgacgggtaaccaggtacgttaaccggtttcggggttacggttaccggggaccggggtaacgggtaccgtacgtaccgtccggtaaccggtcgttaacggtaccgaccgtacccggaaacggtccgtacccggtccccgtaccggttcctacccgtttaccgtcccgttaccccgtccccgttcccgttccgtacccgg

SEQ ID NO: 35703 - DNA, 931 bp, Homo sapiens
  misc_feature: GYAE6OF02HTAJB.45.79.H02.1.454.CMB.1.raw
  modified_base (131)..(131): a, c, t, g, unknown or other
  misc_feature (131)..(131): n is a, c, g, or t
  modified_base (434)..(434): a, c, t, g, unknown or other
  misc_feature (434)..(434): n is a, c, g, or t
tcagacgcgatcgacacgaccggtgctcgatttagtgtcacacgaagggaaggggggggtcacaagaggcagcgctctcgggacgtctccaccatggcctgggctctgctgctcctccactctcctcactnaggacacacgggtcctcggggcccaggtcctcgcccctgtacctcacggccctgccctaccgttggtcctgggtcccttaccgtgggaactacggtacgtatacccaaccgtctccttaccgtagtaccaaccggttacggaaacccaggtaccgtaaggtgtacgttgggttaacgggtaacgttttaacctaaaccgttttacggttaccttaccgttaaccggtaaccctaaaccgaccggtaccctaacccgtaacgaacccgaaacccaacccctaacgtactactattaacgtttanacgtagtactaacgtaactaccgtaccgtacccgtaggttaccggttctaccgtacgttccgtcgtttcgtcgtacgtacgtaacccgtacgtttaccggtagtaaacgttaaccgttacccgggttaccctaccgtaaccggttaacctaccgtttaccgtcggtaccggtcctaccgggtcggtaaccgtaacggaacggacgttaacggtcgttaaacggttttaacttaccggttaaaccgtacgtaacggtaaacctaaccgttaaattaaacgttaaccgttttaagttaacggtttcccgttaaccgtttaaccgggttacgggttaaaccgttccgggggaacccggggttaacgtaacccggttaacggggtttaaccggtaaaccccgggtttccgttaaaccgggtaacccgttacccggtacccggttaacccgggtacccggttcccccggtaacccccggttccccgtaccgttaccccccgg

SEQ ID NO: 35704 - DNA, 756 bp, Homo sapiens
  misc_feature: GYAE6OF02GTHHH.45.79.H02.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (394)..(394): a, c, t, g, unknown or other
  misc_feature (394)..(394): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgcctccgtgtctggtcctcgtggacngtcgatcacatctcctgcactggaaccngctagtcgtagtcggtttagggaacttacttaaccttggtcctaccgtaggtaaccaaagcgaccaccgaggaaccaaaccggaccccctaaatcgaacgttagttaacgtttacgaggacggtactaacgtaacggcccggtacccgttaggttaacgggtttanaacgtcgtacctttcgtacgtcgtcgtactaacgttcgaggacctaacgtccgtccctaccgtagtactacgttcgtacgtacggtccgtacgcggtacctgggaacggacggtacggtacgtaacgttactttaacgttcgtcggtaccttacgtcctaaccgttagtacgtacgggactttaaagggttacgttttaacgtttcgggtttccgggttacggttacgggggaaccggggtaaccggtaaccggtacggttcccggttaaccgggttacccggttacggtaaccggttacccggaccggtaaccggtacgttccccgggtaaccggtcccccggtttagtacccgttcccgg

SEQ ID NO: 35705 - DNA, 810 bp, Homo sapiens
  misc_feature: GYAE6OF02I6GTF.45.79.H02.1.454.CMB.1.raw
  modified_base (176)..(176): a, c, t, g, unknown or other
  misc_feature (176)..(176): n is a, c, g, or t
tcagacgcgatcgacacgaccggtgctcgatttagtgtcacacgaagggaaagggggggggtcacaaggaggcagcgctctcgggacgtctccgaccatggcctgggctctgctgctcctcacttctcctcactcgagactacgagggtcctcgggccagtctcgccctgactacncgcctgccgtcgtcgtcgtcggttctaccgtggacacgggctaactccacactccgtctggtccacgtagaaccgagcgtagtcgtacgtttgggttaattacctaaagtcttacgtaccgttaccgttacggtaaccaaaaccgtaacccgtaccgaacggaacctaaaaccccggtcccctaaaacttacggaacttaggttaacgttttacgtacgtaacggttacgtaacgtaacgtaccgtaacccggttcccgtaaacgggttcgggtttaaccggtccgtacgttccgtcgtttaccgtacgtcgggtccctttaaaaccggtggtacggttaccgaaccgtaccggtaaccccggtccttacccggtaactaccgtaacggttccgttaacgtccggtaacggttccggtacggtcgtacggtacgggtaaccgtcggtcgttaacttacggttaactacgttaaccggtgttatcctacgtcgttacgacggtacgtaacggttacttacgggttaacggttcggtttaaccggaggttaccggtacggtaaccgaggttacgtaccgaacgggtctacggttaccgacggaccgttacggcccggttacgcccgttacgtaccg

SEQ ID NO: 35706 - DNA, 589 bp, Homo sapiens
  misc_feature: GYAE6OF02I8BSE.45.79.H02.1.454.CMB.1.raw
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggtgggattataacttgtctctggtaccacagccaccagacaaacgccccaaactcatgattatgaggacagtaagcggccctgagggttctaagtcgtcttctctggtctccgaagtctgacaacacgcctcctagacaactctccgtgggcctacgacggtctaggacggacggagtactagtatttacttacngtaccgtgactntaattagtgtaccggtaagtagttacgttacgtttggtcggttacgggacgggaggaccgtacggtacgtcggtaccgttaccgtaaggttccgacggtacccgtaacggtcccgtaccgtcccccggttaccgtaccgtacccg

SEQ ID NO: 35707 - DNA, 697 bp, Homo sapiens
  misc_feature: GYAE6OF02JKVE0.45.79.H02.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctccgtgtcgtggtctcctggactagtcgatcaccnttctctgcactcggaacngctagtgattggtggtaacttactaaccttgtcctcgtacgtaacctaacacgaccgaacccgaggtaccgaaaccgtacccccctaaacgtctaactacgttactttacgacggtaggtacctaacgggttaaccgcccggttccgttacggttaacgggtttacctaacgttccgttaccgttccgttcgttacggtctaccgtaacggtcgtcggaaaccaaccgtccggcccttaccgcgaactacgttcctacggtcggtcctccgtagtccgtagggaacggtacgtacggtaacgtacgttaagttaccgtttcgtacgtaccgttcgtacgttacgtaattcggtacgaccgtttaggtaccgtttagttcggtttaggtcgttacggagtaccgtacgtcgtacgtaacgtccgtacggtcgacgtaccgccgacggtccgtcccgccgtcgctacccg

SEQ ID NO: 35708 - DNA, 536 bp, Homo sapiens
  misc_feature: GYAE6OF02GN5J9.45.79.H02.1.454.CMB.1.raw
  modified_base (504)..(507): a, c, t, g, unknown or other
  misc_feature (504)..(507): n is a, c, g, or t
  modified_base (509)..(536): a, c, t, g, unknown or other
  misc_feature (509)..(536): n is a, c, g, or t
tcagacgcgatcgacacgaccggtgctcgatttagtgtcacacgaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgttattactgtgcgagagatcctaatacgtattacttgataggtaggggtagtttttgatatcgtggggaccaagggacaagtggtcaccgttctccttcacgccctccaacccgaacgggcccagtccggttccttcccccgtcggccctaccctcctaccaacgacgcctacctcggtcgggggcacgacggcccggcccgtcgggctcggccgtggtacgaacggtaccttaccgttccgttaccggactcccggtacgtcgtacggacggtccggggtcgtcgggacggaacgggccgacgagtcgnnnngnnnnnnnnnnnnnnnnnnnnnnnnnnnn

SEQ ID NO: 35709 - DNA, 779 bp, Homo sapiens
  misc_feature: GYAE6OF02FPGNF.45.79.H02.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
tcagacgcgatcgacacgaccggtgctcgatttagtgtcacacgaagggaaaggggggggggtcacaagaggcagcgctctcgggacgtctccaccatggcctgggctctgctgctcctcactctcctcactcaggacacagggtcctgggcccagtctgccctgactcagcctgcctcgtgtctgggtctctgacngtcgatcacatctcctgcactggaaccngcagtnagtggttggaattactaaccttgtcctctggtaccaacacgtcaaccgagacaaaccgacccccaaatcaatgtaatttagacggtaggacgtaagtaacggccggtacctacggtacggggtttactaagtccgtcttccgcgttcggcctaccgtaaggtcctagggaaccaaccgtaccggtcccttacccgtacggtaaaccctaaacgtcgttacccggtaggggtacccttacccggaacgggttccgttaacgggaaccgggtaacggtaggtaccgttacgggtaaacttttaacgttaacgttcggttaaccttcgtccttaacgaaagttataggaccggtaaggttaacggtttaacgggtttacgttttgggtttaccgggttccgggggttaaccggggtacgggtaaccccgtaacggtaccggttaccggtaaccccgggtttaacccggttacgggtacccgtaacccggttacccggaaaccggtcccggttaccccggtacccccggttaccggtacccgttaaccccgg

SEQ ID NO: 35710 - DNA, 761 bp, Homo sapiens
  misc_feature: GYAE6OF02JBV04.45.79.H02.1.454.CMB.1.raw
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (340)..(340): a, c, t, g, unknown or other
  misc_feature (340)..(340): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctggtctccgtggacagtcatcaccatctcngcactcggaaccngcagtgagttggttagggtattaacttaccgttgtcctccgtacggtaaccaacgacgaccaacccgaaggaccaaaaccgacccccctaaactccgaagtagttagtttagnggaacgggactaaggtaacggcccggtaccctaggtacgggtttactaacgttccggtcctttcgtccgtacggtaccctaccgtaagttccgacggtaaccaacgtacccggtcccttacccgtacgaacctaacgttccgttcggtccggtacctaccgacgggtcgtaggacggtacggacggtccgtaggttaactttaacgttaccgttgtccgttacgtaccttacgtaagttcgtaggtaccgttaaaggggtttggtttaacgttttacggttttacgggttacgggttacccggggtacgggtaaaccggtaccgttaacgcccgggtttaaccggacccggtttacggttacgggacctaaccggtaccgacgggttcccgtcccgtacccccgttcggtaccttacccgg

SEQ ID NO: 35711 - DNA, 699 bp, Homo sapiens
  misc_feature: GYAE6OF02H5L2R.45.79.H02.1.454.CMB.1.raw
  modified_base (198)..(198): a, c, t, g, unknown or other
  misc_feature (198)..(198): n is a, c, g, or t
  modified_base (314)..(314): a, c, t, g, unknown or other
  misc_feature (314)..(314): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacngtcgatcaccatctcctgcactggaaccaggcagtgattggttggattataccttgtctccgtggtaccaacgagcacccaggaccaaacgacccccaaatccatagtaatttagnggaggtcaaggtaacgtccggcccgtacgtaggggtttacctaagtcgtcttctccgttacggtcctacgtaacgttctacggactaaccgaaccggtccctcccgtacgactaaccgtccttacgtcgggtccctccgaggtccgttaggacgggtaacgggacggtacgttagtaaccgtttacttacgtcgtcgtacgtctacgttacttagtacgtcgttaaggtaacggttaacgttttacgtttgggtcggtttacggggtccgggtaacgggaccgtacggtaccgtcggtaacccggttaccggtcggttaaccgaccggtacccggtaacggccccgtttacccggtcccccgtttacccggtccgttaaccccgg

SEQ ID NO: 35712 - DNA, 614 bp, Homo sapiens
  misc_feature: GYAE6OF02JM0BY.45.79.H02.1.454.CMB.1.raw
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (493)..(493): a, c, t, g, unknown or other
  misc_feature (493)..(493): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatcctcngcacgtggaaccagcagtnattggtaggattactacttgctctgtacancgacaccagacaacgaccccaactcagtcgtattagtcggaggacaggtaacgccgtcccgtcggtagggtttactaagtcgtcttctcgtcgcctacctagtcgacgacgaacgtaccggtccctccctagaactactcgtcgtcgggtcctcgaaggtcgtaggacggagtacggctagttactttactttcgttagtctctacaagttcgtggtacgaccggtacnggtaccgttcggttagggtggtaccggtacgggtacgtacggttaggtaccggtcccgtaacggttgaccgaccgtaccgtacgtcccggtccgtccccgttacgtcccgtacgttcccgg

SEQ ID NO: 35713 - DNA, 889 bp, Homo sapiens
  misc_feature: GYAE6OF02IUAYU.45.79.H02.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (637)..(637): a, c, t, g, unknown or other
  misc_feature (637)..(637): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgcctcgtgtcgtggtctccgnggacagtcgatcacctactccttcctgcacgtgaacccngacagtgagttggtacgggtatttactaaccgtttcgtccttaccgttacggtaacccaacgtacgccccgtaaaccccgaggtaaccctaaaaccccgtaccccccaaaattcgaacgttacggttaaacgtttagccggggaacgggtacgtaaacggtaaccggtcccggtacccccgttaaggggtttaccgggtttaacttaaccggttccgttaccgtttcccttacggtaccgggtaccccttaccggtaacggttttccggacggtaaccctaaaccggtaccccgtccccgtttacccgtaaacgtacccgtttaactcggtttaccggtcgggtacccgtaaccggtacggtaccgggtacggtaacggggtaacccggtaacggtttaccgnggtttttaaactttaacccgttcggttaaccggtcgttaccgttaaccctagttaaacgttcgggttaccgttaagggttagggtttttaaaccggttaggttttaccggggttttccggttaggggttacccggggaacgggttaaccgggtacctaacgggtcgttaaacccggtcccggtacgtaacggttacccgacccgtaccgggtaccgttccccttacccgggtcccccgtgtaccgttccccg

SEQ ID NO: 35714 - DNA, 753 bp, Homo sapiens
  misc_feature: GYAE6OF02G625I.45.79.H02.1.454.CMB.1.raw
  modified_base (576)..(576): a, c, t, g, unknown or other
  misc_feature (576)..(576): n is a, c, g, or t
  modified_base (595)..(595): a, c, t, g, unknown or other
  misc_feature (595)..(595): n is a, c, g, or t
  modified_base (627)..(627): a, c, t, g, unknown or other
  misc_feature (627)..(627): n is a, c, g, or t
  modified_base (637)..(637): a, c, t, g, unknown or other
  misc_feature (637)..(637): n is a, c, g, or t
tcagacgcgatcgacacgaccggtgctcgatttagtgtcacacgaagggaagggggggggtcacgaagaggcagcgctctcgggacgtctccaccatggcctgggctctgctgctcctcactctcctcactcgaggacacgtacgggtcctcgggcccagtctcgccctagacctcgacgtccctcgccgttccgtgtcctcgggtcctaccgtggactagtcgactccaccatccgttcctaggacctacgtacgggaaacctggaccaggtatagttggttaggggtactttaaccttaaccgttcggtccctaccgtacggtaaaccaacgaccggaccccaaccgacggaaaccaaacccggttaacccccaaacctataactaacgttaattttaacgacggtaacggtaccgaagtaaccgggtcccgtcccttagggttaacgggtttaactaaccgtccggttccttacttcggccggtttaccaaccggttacgtcgtacggaacctaccggtaacccgtccctacccggtataacgtacctcggttacgtcggtcctacgaccggntacgggacggaccggagtntacggtaatttacaccgtctggtacctcgtanaagtttccgngtaccgtaagtacgtttaagtcggtttacgcggtaccgggagggtaaccgctacggagttccgaccgttcgtaacgcgaaccaccggacgcggtacccgtcccgtagtcccgtacg

SEQ ID NO: 35715 - DNA, 830 bp, Homo sapiens
  misc_feature: GYAE6OF02JH5DJ.45.79.H02.1.454.CMB.1.raw
  modified_base (216)..(216): a, c, t, g, unknown or other
  misc_feature (216)..(216): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctcgccctgactcagcctgcctcgtgtcgtgggtctccgtaggacaggtcatccacctntcctcctgccacgtggaaccagcagtgagttggttagggattactaaccgttgtcctcctaggtaccaacacgcctaccgaggaccaaccgaccccctaaactcacgtagtacgttacgtaggacggtacgtaacggtaacggccgggtacccgttaggtacggggttttaccgtaacgttccgttacgtttccgttaacggttccggtaccttaaccgttacggtaccgttaccggtaccgaaccgtaacccggttccccgttacccgtaacggaaccttaaccttccggtccggttaccggtaccgtaccggtaccgggtacggtacggtaaccggggaacggtacggtccgttaacggttacgttaaccgtttaaccgtcggttccgttacgttaccgtaacctaaggttccgttacggaccgtttaaggggttaaccgtttaacggtttccgggttttaagggtaccggttaccgggggtaacgggtaaccgggtaccgtaaccggtcgttacccgggtaacggttacccggtacggttacccgaaccggttacccggacccggttaccggtcccccggttaccccggtaccgtacccgtttaccccggg

SEQ ID NO: 35716 - DNA, 935 bp, Homo sapiens
  misc_feature: GYAE6OF02HSNBK.45.79.H02.1.454.CMB.1.raw
  modified_base (199)..(199): a, c, t, g, unknown or other
  misc_feature (199)..(199): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggccagtctgccctgactcagcctgcctccgtgtctgggtctccgtggacngtcgatcaccattcctcctgccacgtcggaaccagccgtagtgtagttgggtttagggttaagtttttgttttgttcgttccgtacggtaacccaaaccgtaacccgaaccccggaccgaaacccgaccccctaaaacttaactacgttaaagttttaacgtaacggggtaactaacgtaacggcccggttacccgggtttccgggggtttactaaacgggttccgtccgtttactccgtacggtcctaccgtaacgtccgtacggaaccgtaaccggtacccggtcccgttacccgtacgtaacctaacgttccgttaccggtcgggtacccgttaccgaccgggtaccgtacgggtaaccggggaaccggtagggaccgtttagttaaacgtttacgtttaacggcgttaccgttacggtaccttaaccggtaagttaccggttacgggaacgtttaacgggtttaaacggtttacgggtttaacggttttggggttaccggggttacgggtaccgggggtaacgggtaacccgttaaacggttaccggttaacccgggttaaccccggttacggttacccggggttaaccggtaacccgggtaacccgggttaaacccggggtccccgttaaccccccggggttaccccgtttcccgggttaacccttaccccggtttccggttttaccccgggttcccccggtttaccccgttccccccggttttaacccgg

SEQ ID NO: 35717 - DNA, 705 bp, Homo sapiens
  misc_feature: GYAE6OF02G7ECD.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtcgtggtctccgtaggactagtcgatcacctatccgtcctgacacgtacggaacagcaggtagacgttgttaggtttaacttaattaacttacgtcgtccgtaccgtacggtaaccaaactaaccacccgacgaacctaaacccgaccccaaactacacgtacgttaactttagacgtagtacgtacgtaacgtacgtccggaccgttaggtacggttctcgtactcgtcttcgtcgtcgtactacgtagtcgtacgactacgaccgtccgtactagactacgtcgtcgtcggctacggcgtcgtagacggacggtacgtagttagttactacttacgcgtactcgtaccttggtaacttacggtacgtacgttacggttagtttacggtttcggttcggggttacgtcggggtaccgggaacggtaaccggtacgtaccgggttaccgtaccggtaccggtaacggtacccgaaccggtccccgtaacgggttacccgtccccggttaccccgttacccggg

SEQ ID NO: 35718 - DNA, 722 bp, Homo sapiens
  misc_feature: GYAE6OF02IFA4Z.45.79.H02.1.454.CMB.1.raw
  modified_base (245)..(245): a, c, t, g, unknown or other
  misc_feature (245)..(245): n is a, c, g, or t
tcagacgcgatcgacacgaccggtgctcgatttagtgtcacacgaagggaaaggggggggggtcacaagaggcagcgctctcgggacgtctccaccatggcctgggctctgctgctcctcactctcctcactcaggacacgagggtcctcgggcccagtcgtcgcctgactcacgtccgtcgccgtccgtgtcgtggtctccgtgactagtcactccaccatcctccgtcgctacgtcggaaccngctaagtgtagttcggtagggtacttaacttaccgttcgtaccttccgtacggtaccaacgaccgacccaccgtacggaaccaaccccgaacccctaaacacctaattacgtaagtttacgacgggtcggtaacgagggtaaccggccgtacccggtacgggttcggttactactcggttccgttacctcgtcgtcgacctacctacgtcgagtaccgaacgtccggtcctccggactaccgtctcgtccggtcggtacctacggacggtacaggacggacgtacgtatacgttaacttcgaacgtcgacagaacattaagttaacttacgtttacgtccggttaacgttcgggttaggtaccgggttcggggaccgttaacggttacgtccggttaccggccggtttaaccgtcgtaacccggtaaccgcccgtacgggtccccttacccgggtccctcggtaccctcgttccccg

SEQ ID NO: 35719 - DNA, 759 bp, Homo sapiens
  misc_feature: GYAE6OF02HVF3J.45.79.H02.1.454.CMB.1.raw
  modified_base (335)..(335): a, c, t, g, unknown or other
  misc_feature (335)..(335): n is a, c, g, or t
  modified_base (495)..(495): a, c, t, g, unknown or other
  misc_feature (495)..(495): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgccttcgtgtcctgggtctccgtggacagtcgatcaccatctcctgcacgtggaaccagcagtgattcggttaggagtttaacttaaccgtttgtacgtcctaggtaaccaacagaccaaccgaggaccaaaccgacccctaaactcaatagttagttagnggacggactacggtaacggcccggtaccgttacgggttacgggtttactacgtccgtcttccgtcgtacggtcctactacgtcgacggactaacgaccgtccctccgagtaactacttccgttcggcggtcctaacgtgggtacgtaggacggaaccggngtcttaacggtaatttacgttacctgtcctacgtcttacgattaggacgttacggtaacggttacgggtttacgtttaccggttttaaggggggtccggtttaacgggggaccgggtaaacgggtaacgtaaccgggttcccggtaaccgggtacccccggttaacgggttaacccggttaacccgtacccggggtaaccggtaccccggggttaccggttccccccggtacccccgggttttacccggtacccgtttccccgg

SEQ ID NO: 35720 - DNA, 610 bp, Homo sapiens
  misc_feature: GYAE6OF02GSP1M.45.79.H02.1.454.CMB.1.raw
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (295)..(295): a, c, t, g, unknown or other
  misc_feature (295)..(295): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctncactggaaccngcagtgatggtaggattatacttgtctctgtaccanagcaccagcaacgccccaactcatcgtatttagnggaggcaaggtacgccgtcctcgtaggggtttctaacgtcgtcttctcgtcgctaccgaacgtcgtcggaccacgaccgtcctccgtagaacctatcctggtacggcctaccgaacggtctacgggacggtacggacggtcgtagtaactttacttacgtgtaccgttcgcctacgtactacgtctacggtaagttaggttacggtttagtttacgggttcggtacgggacgggacggtacacggtccgtacggtacccgtacgttcggaccgtacgaccgtcggtacccgttcggaccccgtacgtacttaccg

SEQ ID NO: 35721 - DNA, 635 bp, Homo sapiens
  misc_feature: GYAE6OF02G8D8O.45.79.H02.1.454.CMB.1.raw
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctcgggcccagtctgccctgactcagcctgcctcgtgtctgggtctcctggacagtcgatcaccatctcctgcactggaccagcagtnatggtggattatacttntctctgtaccacagcaccagcaacgccccaactcatntattanggaggacagtaacgcgtcctacgtagggtttactaactcgtcttctcgtcggccttaccgagttcgtacggaccaacgacccggtcccttaccgtacggaactaacgttccgtacgtccggactaccgacggtcgtacgggaagggtacggaacggttcgtaggttaatttacgtacgtggtctcgtactacgtatagtacgtacgtaggttaggttagtttacggtttcgggttgtacgggcgggtaacggtacgtaagtcgttaaccggaccggttaccgtaacggtcgaacgtacccgggtaggtcccgtacccggtacccccggttcgaccttcccg

SEQ ID NO: 35722 - DNA, 746 bp, Homo sapiens
  misc_feature: GYAE6OF02H9QFB.45.79.H02.1.454.CMB.1.raw
  modified_base (159)..(159): a, c, t, g, unknown or other
  misc_feature (159)..(159): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (314)..(314): a, c, t, g, unknown or other
  misc_feature (314)..(314): n is a, c, g, or t
tcagacgcgatcgacacgaccggtgctcgatttagtgtcacacgaagggaaaggggggggtcacaagaggcagcgctcgtcgggacgtctccaccatggcctgggctctgctgctcctcactctcctcactcaggacacgaggatcggtgggccctttntcgccctgactcagcctgcctcgtgtcgtggtctcgtaggacagtcgatccgacatcctctgccactggaaccagcagtgagtggttaggattactacttgtctcgtacgtacanacnccaccgacgacaaccgacccaatcagtatagtttagnggagacgagtacggcgtaccgtcgtacgggtttacacgttccgtctttaccgtcgtacgtacctacgtaacggtcgtacgaaccgtaccggtaaccgtcccttaccgtacgtaactaccgtacgttcggtacggtccctacggtacgtcggtacggaacggacggtagtccgttagttacgttactttacgtcgtacgttcgacgttactaagttactacggtacgtaagggtttacggttaccggtttttacgggtttacgggttaccggttacggggtaacccggggtaacggtttaacccgtaacgggttcccggttaaaccggttaaccccgggtttacggtaacccgttaaccgggtacccttaaccggggtaaccggttcccgttaacccccgggttcccgtttaccgggtccccttaaccccggg

SEQ ID NO: 35723 - DNA, 692 bp, Homo sapiens
  misc_feature: GYAE6OF02GOPP2.45.79.H02.1.454.CMB.1.raw
  modified_base (234)..(234): a, c, t, g, unknown or other
  misc_feature (234)..(234): n is a, c, g, or t
  modified_base (428)..(428): a, c, t, g, unknown or other
  misc_feature (428)..(428): n is a, c, g, or t
tcagacgcgatcgacacgaccggtgctcgatttagtgtcacacgaagggaaaggggggggtcacaagaggcagcgctctcgggacgtctccaccatggcctgggctctgcctgctcctcactctcctcactcaggacacagggtcctgggcccagtctgccctgactcagcctgcctccgtgtctgggtctcctggacaggtcgatccaccattcctcctgcacgtggaacccngcagtgattggttagggattactaccgttgtctccgtgtaccaacgacgccaacccgaggacaaaccgcccccaaactcagtgtactttagtaggagggacaggtaacggccgtacccgtaggttacgggtttacaacgtcgtaccttcgtctcgcctaccgtagttcgagaccgaccgaccgtccctaccgtnaacctacgtcgtcggtcggcctaccggtacggtctacggaggtacgacggtacgtagttactttactacgttcgtcgtacgtacttacgtattacgtacgtacgttagggttaacgttacggttttcgtttacgggttcggtttacggggacggttaaccgggtacgtaacccggttacggtaacccggttacgtaccggtaaccgtacccggtaccggacgtcccggtaccccgttccccggtacgttacccgtcttccccgg

SEQ ID NO: 35724 - DNA, 681 bp, Homo sapiens
  misc_feature: GYAE6OF02F64P4.45.79.H02.1.454.CMB.1.raw
  modified_base (232)..(232): a, c, t, g, unknown or other
  misc_feature (232)..(232): n is a, c, g, or t
  modified_base (335)..(335): a, c, t, g, unknown or other
  misc_feature (335)..(335): n is a, c, g, or t
  modified_base (551)..(551): a, c, t, g, unknown or other
  misc_feature (551)..(551): n is a, c, g, or t
  modified_base (616)..(616): a, c, t, g, unknown or other
  misc_feature (616)..(616): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcacggacacgagggtcctgggcccagtctgccctgactcagcctgcctcgtgtctgggtctccgtggacagtcgatcaccatcctctgcacgtcggaaccngcagtgagtggttaggaattattaaccgttgtcctccgtacggtaaccaacacggccaccgacggacaaaaccgacccccaaactcacttagtattttaacgnggaaggacgtaaggtaacgccggtacccttcggtaagggtttacctaacgtcgttacttcgtacctcggtaccttaccgtaaacggtcggtacgaccgaaccgtcccggacccttcccgagtaacctaacgttccgtccgtacgggaccttaccgaggtcgtagggacgggaacgggacgtcgtagttactttattacgtcggtcctcgtacttanacgtaagtcggtagtaacggtttcgtagttttacggttcggttacggtcgggacgtacgggtacnggtacggtccgtccgtacggtggtaccacggacccgacggtccgcccgtcccgttcgactacccg

SEQ ID NO: 35725 - DNA, 741 bp, Homo sapiens
  misc_feature: GYAE6OF02G8S3B.45.79.H02.1.454.CMB.1.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (302)..(302): a, c, t, g, unknown or other
  misc_feature (302)..(302): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctcgccctgactcagcctgtctccgtgtctgggtctccgtggacagtcgatcaccatcctcctgccacgtggaaccngcagtgattggttggattactaccttgtctctgtaccaacncgcaccgacgaccaaacgaccccaaacncatagtatttagaggacggactaaggtacgccggtccgtacggtacgggtttactaacgtccgtcttaccgtcgttcggtacctaccgtaacgttcgttacggacctaaccggtacccgtacccgttacccgtacggtaacctaacgttaccgtaccggtccgggtaccgtcccggtacgggtccgtacgggacgggaaccggtacggtcgtacgttaactttacgtttacgtacgtcgtcgtccgtagtacgttagtacgtacgtaggtttaacgttacggtttacgggtttacgggttacgggttaccggggtaccgggtaacgggtaccgtaacggtccgttaccggtacccggttacggtaacccggtccgtaacccggtacccggtaccggtacccggtaccccggttcccggttaccggtacccgttacccgg

SEQ ID NO: 35726 - DNA, 613 bp, Homo sapiens
  misc_feature: GYAE6OF02GA3UP.45.79.H02.1.454.CMB.1.raw
  modified_base (236)..(236): a, c, t, g, unknown or other
  misc_feature (236)..(236): n is a, c, g, or t
  modified_base (277)..(277): a, c, t, g, unknown or other
  misc_feature (277)..(277): n is a, c, g, or t
  modified_base (315)..(315): a, c, t, g, unknown or other
  misc_feature (315)..(315): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcgaggacacgagggtcctgggcccagtctcgccctgactcagcctgcctcgtgtcgtggtctcgtggactagtcgatccactatcctcctgctacgtcgaaaccngcagtgattggtaggattataccttgtctctaggtaccacngaccaccagtacaacgccccaactctatgtactttagnggaggctagtacgcgtccctgtacgggttcatccgtcttctcgtcgtcctacgtacgtcgtcggaccaaccgccgtccctaccgagtacctatccgtacgtcggtacctcgacggtcgtaggtacggacgtagccttagtattacgtctgtctcgtctatatagtcgtacgtagttaggtacgtttagggttcggtacggttacgggacggtacgggacctaaggtccgtacggtacccggtacgtcggtaccgacgtacccggacggtcccgtcccgccccggttcgccgttacccg

SEQ ID NO: 35727 - DNA, 752 bp, Homo sapiens
  misc_feature: GYAE6OF02J3BX8.45.79.H02.1.454.CMB.1.raw
  modified_base (370)..(370): a, c, t, g, unknown or other
  misc_feature (370)..(370): n is a, c, g, or t
  modified_base (539)..(539): a, c, t, g, unknown or other
  misc_feature (539)..(539): n is a, c, g, or t
  modified_base (549)..(549): a, c, t, g, unknown or other
  misc_feature (549)..(549): n is a, c, g, or t
  modified_base (582)..(582): a, c, t, g, unknown or other
  misc_feature (582)..(582): n is a, c, g, or t
  modified_base (728)..(728): a, c, t, g, unknown or other
  misc_feature (728)..(728): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactcctcctcactcaggacacgagggtcctcgggcccagtcctgccctgactcagcctgccctccgtgtcgtggtcctccgtggactacgtcgactccacctcgtctccgtagacctacgaccggaacccagtacgaggttagtaaggttggggttacggttaacttacgttaacccgtttcgtccgtaccggttacggtaaccaacgacggaaccaacccggaacgtaacctaaccccgacccccttaanaccctagtcgttaattaacggcggtacggaacgtaacggaccggtcccggtccgtcggtttaaccggtctaaccgtcggttcccttagtccgtcgaaccggtaccgttacgtacggtaccgaccgtaccggtcctacccgttaccgacgtaactccgttcgtcggtccncgtccgaacnggtacgggacgtcgtacgacttagttattaccngtcgacctagtacctaagttttaacgtacgttaccgttacggtacccttaggggtttccgggaacggttccgggagtaccgaacctttccgacggttaccctcggtacgctaccccgggacgtggtaccccgttccgccccgttanaccccgttccgtacccggttcccc

SEQ ID NO: 35728 - DNA, 807 bp, Homo sapiens
  misc_feature: GYAE6OF02FP1UL.45.79.H02.1.454.CMB.1.raw
  modified_base (238)..(238): a, c, t, g, unknown or other
  misc_feature (238)..(238): n is a, c, g, or t
  modified_base (505)..(505): a, c, t, g, unknown or other
  misc_feature (505)..(505): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggccccagtctcgccctgactcagcctgccctccgtgtcgtgggtctccgtggactagtcgatccaccatctcctgctactcggaaccngctagtgtagtggtttagggactttaactaaccgttgtccttccgtacggtaaccaacgacaccgacccaaggtaccaaaaccgacccccaaacgtacagtagtatttaacgtaggaggacaaggtaaccggccggtacccgtgtaacggggttttacaacgtcgttacttccgttcgtcgtccttacccgaagttcgtaccggtaaccaaacgtcccggtaccccttaccgtacgtactaaccttccgtacggttcggcctaccgnggtacgtacggtaggacccggtagggtacctaagttacgtttaacgtacgttcgtccgtacgtacttcgtacgttagttacggtaccgttaaggggtaaacggtttacgggtttaaacgggttttgggtttaccggggtttaccggggaaccgggggtaaccgggtaacccgaacggttcccgggtaaaccggttaccccggttaaccgggttaaccggtaacccggttaaccggacccccggttaacgggtacccgttacccccgggtttaccccccggttcccgttaccggtaacccccg

SEQ ID NO: 35729 - DNA, 577 bp, Homo sapiens
  misc_feature: GYAE6OF02I053A.45.79.H02.1.454.CMB.1.raw
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
  modified_base (451)..(451): a, c, t, g, unknown or other
  misc_feature (451)..(451): n is a, c, g, or t
tcagacgcgatcgacacgaccggtgctcgatttagtgtcacacgaagggaaagggggggggtcacaagaggcagcgctctcgggacgtcctccaccatggcctgggctctgctgctcctcactctcctcactcaggacacagggtcctgggcccagtctgccctgctcagcctgcctcgtgtctggtctcctggacctagtcgatcaccatctcctgcactaggaaccagcagtgatgtggattatacttgtctcgtcgtacacagacaccagacaacaccccaacacatatattanggaggacagtacgcggacctcgtagggttactagtctcgtctcgngtcactacgtctcggacaacaccgcctccgtagacctatcgtaccgtcggtactacgacgtcgtaggagacggacggacgtagttattacttacgtcgtctacgtactntacgtacagagttacgagttagttagtttcggcgtttacgggacgggtacgacgtacgcgtaggtaccgacgtacggtacaccggtaaccgaccggtaccgccggtaccccggttacgtcctaccg

SEQ ID NO: 35730 - DNA, 949 bp, Homo sapiens
  misc_feature: GYAE6OF02HJNOP.45.79.H02.1.454.CMB.1.raw
tcagacgcgatcgacacgaccggtgctcgatttagtgtcacacgaagggaagcggggggtcacaagaggcagcgctctcgggacgtctccaccatggcctgggctctgctgctcctcactctcctcactcaggacacgagggtcctgggcccagtctcgccctgactcagcctgccttccgtgttcgtcgggtcctaccgtgggaactaggtcgaactccacctatcctccgtgaccacgtaggaacccagtactaagtgaagttgggttagggtaacgttaactaaccgtttgttaccgtaccttaacgggtaacccaaacgtacgacccgtaaacccgaacgggaaaccaaaacccggtaacccccctaaaactaccgtaagttaacggttaacgttttaacggacggtaacggggaccgtaaacggtaaaccgggtcccggtacccgtttacgggttaacgggggtttaaccttaacgttccgtaccgtttaccgttcgtcggtaccgttaccgtaaacggtccgttacggaaaccgtaacccggtaaacccggtcccttaacccggtacggaaacccttaacgttaccgttaccggttaccggggtacccgttacccgggtaaccgggttaaccggttaacggggaaccggggtaaccggtaaaccgggttcgttaaacggtttaaccgttttaagttaacccgtacgggttaactaccggttaccgttaacgtaacgttacggttacggtaacccgggttaagggtttaaacggtttaacggtttaccgggtttaaggttaaccgggttaccgggggtaacgggtaccggggaaacttaaccgggtacgttaccggttacccggttaccggttaacggaccggtaacccggtacccggtaacgggtaccccgtaccccgggtaccccgttacccgggttaaccc

SEQ ID NO: 35731 - DNA, 698 bp, Homo sapiens
  misc_feature: GYAE6OF02J13HI.45.79.H02.1.454.CMB.1.raw
  modified_base (343)..(343): a, c, t, g, unknown or other
  misc_feature (343)..(343): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccatcctcctgccactacggaacagcaagtgtacgtggttacgggattacttaaccgttgtctccgtacggtaccaacgacgtaccacccgaaggaccgaaacccgaccccctaaacttacctagtacgtatttagnggtacgggactaggtaaccgcccggtaccgttcggtaacgggttttctaacgtccgtcttaccgtcgtcggtacctacgtaacgtcgtcgaccaccgtaccgtcccttacccgataaccgtacgtccgtacggtcggccttaccggacggtacgtacggacggtacggtacgtacgtcggttaagttaccgttcgtgtcgtcgtctacgttatacgtcgtagtaacggttgtacgtttacgttggttcggtacggacgggtacgtacgaggtaccgtcggtaaccgttcgtaaccggtaccgtaaccgggtaccgtaccggtccggttaccccgccggtttaccggacttcccgg

SEQ ID NO: 35732 - DNA, 693 bp, Homo sapiens
  misc_feature: GYAE6OF02H2SZ4.45.79.H02.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
  modified_base (320)..(320): a, c, t, g, unknown or other
  misc_feature (320)..(320): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggactagtcgatcacctntcctctgcacgtggaaccngtcagtnagtggttcgggaattataaccttgtctccgtaggtaccaanacgcaccgaggacaaccgaccccaaatcatcgtatttacgnggacgggacaggtaacgccggtaccctggtagggtttctaacgtcgtcctttctcgtcggtacctacaacgttcgtacggactaaaccggccgtaccctacccgttagaaccgtaactttccgtcggttcgggcccttaccggtacggacgtagggaacggaacgggtcggacgttacggttaaatttactacgtcgtccgtgtacctacttagttaacgtggtaccgttagggtttaagttaccggttttagttttcggggtacggttacgggacggggttaacgacctaacgggtcgtaacggtacccggttacgtaaccggcgtaccggtaccggacggtccgtaccccggtcccgttcggtacctaccg

SEQ ID NO: 35733 - DNA, 523 bp, Homo sapiens
  misc_feature: GYAE6OF02FMSJ3.45.79.H02.1.454.CMB.1.raw
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (503)..(508): a, c, t, g, unknown or other
  misc_feature (503)..(508): n is a, c, g, or t
  modified_base (510)..(522): a, c, t, g, unknown or other
  misc_feature (510)..(522): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcctaatacgtattactttgatagtaggggtagtttttgatatcgtgggccaagggacaatggtcaccgtctcttcagcctccaccgacgggcccagtcggtcttccccctggccaccctctccagcncacctcgtcggggcacncgccggcccgngggctcgccgtggtcaacggtctacgttcctacgtactccgtcgtcgtggacggcgggctgggaccgtaagggccgacgtagttacgatcanctagncngnnnnnngnnnnnnnnnnnnnc

SEQ ID NO: 35734 - DNA, 670 bp, Homo sapiens
  misc_feature: GYAE6OF02HF8EW.45.79.H02.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (464)..(464): a, c, t, g, unknown or other
  misc_feature (464)..(464): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgtgcccagtctgccctgactcagcctgcctccgtgtctgggtctctggacagtcatcaccntctcctgcactggaaccngcagtgatggttagggattataaccttgtcctcctaggtaaccaacacgtcaacccgaggacctaaaccgacccccaaactcatgtattagaggtacggacaggtaacgccggtcctaggtacggggtttactaacgtcgtcttactcgtgacctcaagttccgtcggacaacgtaccgtccctcccgtatacacttcgtcgtcgggtcctacgacggtctaggaacggtcggaggtntagttaagtttacttacgtcggtcttccgtctacgtattacgcggtaccgttagggttagttaacgttcggtttaggtccggggttaggtaccgggtaacgggtaccgtaacggtccggtaacggtacccggttaccgttacggggtacctacggtaacccggtaaccggtccccgttacccggttaccccggtaccggttacccg

SEQ ID NO: 35735 - DNA, 643 bp, Homo sapiens
  misc_feature: GYAE6OF02IW24I.45.79.H02.1.454.CMB.1.raw
  modified_base (459)..(459): a, c, t, g, unknown or other
  misc_feature (459)..(459): n is a, c, g, or t
  modified_base (619)..(619): a, c, t, g, unknown or other
  misc_feature (619)..(619): n is a, c, g, or t
  modified_base (623)..(643): a, c, t, g, unknown or other
  misc_feature (623)..(643): n is a, c, g, or t
tcagacgcgatcgacacgaccggtgctcgatttagtgtcacacgaagggaaagggagctggatccggcagcccccagggaagggactggagtggattgggtatatctattacagtgggagcaccaactacaacccctcctcaagagtcgagtcaccatatcagtagacacgtccaaagaaccagttcctccctgaacgctgacgctctgtcgaccgctggcggacgacggccgtgttacttacgtgttgacgagagtacttacctaaagttaccgttatttacgtttgtaagttaggttaggggttatttttacgattagtcggtacggggtacaagggtactaaggttcggtaccgaccgttcttacgttcgacgtccctcccgaacgtaaccgggtcccctacggttcccgttcccgttccccgtcggacccctaccccctcctaccgaacgtaccnccgtacccgttcggacggggtaaccacggaccggtcccggcccggtagggtccctcgggtaccgtacgggtaaccgtaacggtaaccttcccgtttccgtcgtaccgtcggtccggttacgcggtcgggtcggtgacggacgaggccctgacgtagctgntgcnnnnnnnnnnnnnnnnnnnnn

SEQ ID NO: 35736 - DNA, 830 bp, Homo sapiens
  misc_feature: GYAE6OF02GIWCW.45.79.H02.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (263)..(263): a, c, t, g, unknown or other
  misc_feature (263)..(263): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgccctcgtgtcgtcggtctcctggacngtcgatcacngtctcctgcacgtcggaaccngtcagtgtagtggttaggattacttacgttntctaccgtagtaaccacacgaccgaccgaggaacctaaaccgaaccccctaaactaccgtaagtacgttaacgtttacggacgggaacgggtactaacggtaaccggtcccggtacccgttagggttacgggtttaacctaagttccgtacctttcgtcgtacggtacctaccgtaagtccgtacggaacctaaaccgtccggtacccttacctaacgtaacctacgttaccgtcgggttacggaccgttaccgaacggtcggtaaacggacgggtaccgggtacggtaccgtttaagtaacgttttacgtaccgttcggttaccgtcgttaccctaaggtaacgttacggttaccggtaacgggttaaccggttttaggtttaaccggtttttcgggttacgggtttacgggtacccgggggtaaacggggaccggttaaaccggtcggttaaccccggggttaacgttaaccccggttaccggttaaccgggtcccgtaaccggttaaccccggtacgggttaccccgtacccccgtccccgggttaccgttacccgtttccccg

SEQ ID NO: 35737 - DNA, 715 bp, Homo sapiens
  misc_feature: GYAE6OF02G2UFB.45.79.H02.1.454.CMB.1.raw
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
tcagacgcgatcgacacgaccggtgctcgatttagtgtcacacgaagggaaaggggggggggtcacaagaggcagcgctctcgggacgtctccaccatggcctgggctctgctgcctcctcactctcctcactcaggcacagggtcctgggcccagtctgccctgactcagcctcgccgtccgtgtctgggtcctccgtaggacaggtcgactcacctatctccttagcctaacgtggaaccagcagtnaacgttggtaggtattactacttgtctacgtgtaccatacgccaccgngtacaaccgcccctaaatccagtcgtatttacgagggtacggacgtacgtacggtccgtaccgtcggttaacgggtttactacgtccttcgttctcggcgttacctcgagttcgcgaccaacggtccgtaccctccgtagtacctacgttccgtggtccgccgtacgtccggacgtacggacgggacttagggaccttgttaaccgttttgtttccgttaggtaccctaaccgtttagtaacggtcgtacgggtaaccgtacggtaaccgtacggttccgtttaaacgggggttgttaaaccggttacggggaccggtacgggtacgttcggtaacccgggttcctacgggtaacggtcccaacggttccggaccgttcccggtaccgtacccgttccggtactttccccggtacccg

SEQ ID NO: 35738 - DNA, 725 bp, Homo sapiens
  misc_feature: GYAE6OF02FGXRV.45.79.H02.1.454.CMB.1.raw
  modified_base (123)..(123): a, c, t, g, unknown or other
  misc_feature (123)..(123): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactcncctcactcaggacacagggtcctgggcccagtctgccctgactcagcctgcctccgtgtcctgggtctcctggacagtcgatcaccatctccgtgcacgtggaacccagcagtgatggttggattataacctgtctcgtacggtaccaacacgtacacccaggacaaaccgaccccaaacttcactagatttagtgaggacagtaacgccggtcctacggaaggggtttacctaagtccgtactttcctacgtcgggcctaccgtaacgtacgtcggaccaaacgaccccggtcccccctaggaacctaactccgtccgttagggcctacccgagggtacctacgggtacgggaccgtacggggtcctaaggtaagtttaccttacgtacgtaccttggtcctaacgacttagttccggacgttaagggttaacgtttaccggtttacgttttacggggtcgtttacggggaccggggaacggtaacccgtaggcccgtaccgggtaacccttccggggtaaacgttccggaacccggtacccgaaacgggttccccgtaccggtacccccggtttcgggtacccttacccgtttaccccgg

SEQ ID NO: 35739 - DNA, 624 bp, Homo sapiens
  misc_feature: GYAE6OF02I51DA.45.79.H02.1.454.CMB.1.raw
  modified_base (301)..(301): a, c, t, g, unknown or other
  misc_feature (301)..(301): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcacctatctcctgcacgtgaaccagcagtgatggtgattactacttgtctcgtgtacacacgccaccgagacaacgccccaactcagtgtattanggaggactaagtacgccggtacctgggtacggttactaacgtcgtcttccgtgtacgtcctaccgtagtcgtcggtaaccaccgtaccgtaccctccgtagtaaccctatccgtcgtcggtacccgtcgtacggcgtggaacggcgtagtcgtagtagttctacgtcgtctgtcctagagtctacggtcgtaacgttcgttagttccgtttggtcggttacggccgggtaacggccgtaacggtaccgtcggtaccctcggtaaccgtccgtaccgaccggtaaccggtcccgtcccgggtaccccgtcggtaacccttccgg

SEQ ID NO: 35740 - DNA, 778 bp, Homo sapiens
  misc_feature: GYAE6OF02HN4YN.45.79.H02.1.454.CMB.1.raw
  modified_base (296)..(296): a, c, t, g, unknown or other
  misc_feature (296)..(296): n is a, c, g, or t
  modified_base (418)..(418): a, c, t, g, unknown or other
  misc_feature (418)..(418): n is a, c, g, or t
  modified_base (632)..(632): a, c, t, g, unknown or other
  misc_feature (632)..(632): n is a, c, g, or t
tcagacgcgatcgacacgaccggtgctcgatttagtgtcacacgaagggaagggggggtcacaagaggcagcgctctcgggactcgtccaccagtcggcctgggctctggctgctcctcactctcctacacctcgaacggtaccacggcgggtcctcggggccctagggtcctggtccctaggtacccacgacgtccttcgcccgtcggtcgttccgtcggggtacctccgtaggacctaggttccgacttacgaccgtgttccgtcctaggccctaacggttacgggaaaacctnaacggtaacggtggtaacgtttgggttacggtaagtttacgttaaccgttccgttcgttaccgtacggttaaccaacgtacgtaccgaaacccgaggaaccccgaaaccgtaaccccttaancgtaaacttcgttaacgtttaccggacggtacggactacggttaaccgcccgggttctaccgggttacgggttacctaacgttcgtacttcgcgtacgttccacggtacgttcgacgtcaaccgtccggtcctacgtcgtaactacgtctcgcggtacacggtcgaacgtggaacgtcgggagtccgtattacggttaactttacgcgtaacgngtcctaatacgttcacggtacggtagttaccgttaggttaccgtgttcgggacgtacggacgtcgtaacgcggtttcccgacggttaccgtagaccgtaaccggtccgtaacggtcccgtacccgacggttccgccgtttaacccg

SEQ ID NO: 35741 - DNA, 839 bp, Homo sapiens
  misc_feature: GYAE6OF02HVJQY.45.79.H02.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactcctcctcactcgaggacacgtgggtccgtcgggccctagttctcgccctgacctcacgtcctcgtccctcgttgttcgtggtcttccgtaggactgtcatccactnttcctctgccacgtagaaccngacgtagtgtagtggttaggtatttaacttacgttgtcctcgttacggtaccaanacgccacccgaggaaccaaccgacccctaaactcagttagttaatttaggacggacggtacgtaacggtaaccggtcccggtacccggttaggtacggggtttaacctaaccgttccgttaccgtttcgtcggttaccggtaccttaccgtaaccggtttaccgtacggaaccctaccggtaccccggttccccgttaccgttaacgaaccttacgtttacccggttcggttacccgggtccgtaccggtaccgtcgggtagggaacgggacggtacgggttccttaggttaacttttacgttcgaccgtttagtacctctttacgaaatttcggtaagggttacggttaacggggtttaaggttttacgggttttacgggtttttggggtaccggggtttaacggggaccgggtaccgttaacgggtacggttaccggttaacccggttaccggttacgttaccggtaccggtaaccgtacccggtacggttaccccgtccccggttacccccgggttcgttaccctaccccgg

SEQ ID NO: 35742 - DNA, 643 bp, Homo sapiens
  misc_feature: GYAE6OF02HLAX2.45.79.H02.1.454.CMB.1.raw
  modified_base (238)..(238): a, c, t, g, unknown or other
  misc_feature (238)..(238): n is a, c, g, or t
  modified_base (286)..(287): a, c, t, g, unknown or other
  misc_feature (286)..(287): n is a, c, g, or t
  modified_base (321)..(321): a, c, t, g, unknown or other
  misc_feature (321)..(321): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgacgggtcctgggcccagtctgccctgactcagcctgcctccgtgtctcgggtctccgtggactacgtcgactcactatcctctgcacgtacggaaccngcgagtgtagttggtaggtattactacgttgtcctcgtacgtacaacnnccaccagacaaccgaccccaatcatagtattacnggacgacaagtacggccgtctacggttaggttactaacgtctcttacgtcgtcggtactacgtaacgtcgtacgaccgaacgtcccgtcctactacgaactacgttcctacggtccgtactaccgacggtcgtaggacggtcggtacgtcgtaagttaactttacgtacgtcctgtcctactcttaagtccgtaggtacgtaaaggttcgttacggtttacggttacggtcggtaacggacgggttacgaaccgttagtccgttacggcccgttacgttcgaccacggtaccgacgtccctacccgtccgtcgtactacccg

SEQ ID NO: 35743 - DNA, 698 bp, Homo sapiens
  misc_feature: GYAE6OF02GE956.45.79.H02.1.454.CMB.1.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgcctccgtgtctggtctcgtggacagtcgatcacctatctcctgcactggaaccngcagtnatgtggattatacgttntctctgtacaacncgcaccgagacaaacgccccaactcatcgtatttacaggacgggtcaaggtaacgccggtcctcggtacgggtttactaacgttccgtctttctcgtcggtccttaccgtagttccgtggaccgtaaccgaccggtcccttaccgtacgtaaccgtaacgtttccgtaccggttacggggtccctaccggacgggtccgttacgggacggtacgggtacggtaccgttagtaaacgtttaacgttacgtcgtacttacgcctttacgagttaacgtcggtacggtaaggtttacggttacggttttacgtttaggggttaccggtttacggggacggtacgggtacaacggtcggtacgtaacccggttcgtaacggtccgaaccggtacccgaacggttccgtaccccggtccccgttggacccgttcccgg

SEQ ID NO: 35744 - DNA, 837 bp, Homo sapiens
  misc_feature: GYAE6OF02HKLAG.45.79.H02.1.454.CMB.1.raw
  modified_base (212)..(212): a, c, t, g, unknown or other
  misc_feature (212)..(212): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcgaggacacgacgggttcctcgggcccagttcctcgaccctgacctcacgcctgcctccgtgtcgtgggtcctcgtggacncgtcgactccaacctactcctcctacgcctaacgtcggaaccagcctaggttgtaacgttgggtttaggggtttaagttttttacggttttcggttccttaccgttacggttaacccaaccaaccccggacccccgggaaccgaaacccgaacccccctaaactaccgtaacgtagttacgtttacgtagggacggacgtaaggttaaccggccggtaccccttacgggtttacgggtttactaacggtccgttcttaccgtcgttacgaccgttccgtaacgttcgtacggaccaacggccgtcctccgtcaacgtctcgtcgtcggctaccgcgtcggtacggtacggacgtacggtcgtaacgttagtttaccgtaacgttccggtaattccggtacttaacgttagtacggttacggttacgggttaacggtttaacgtttaacgggtttcggtttaacggggtttcggttaaccggggtaacggggtaccggtaacggtacgtaccgggttacgtacccgggtttacgtcgggttacccgaaccggttaccggaaccgttcccggttacccggtaccccgttccggtaaccttacccgttacccgtcccgtttacccccg

SEQ ID NO: 35745 - DNA, 680 bp, Homo sapiens
  misc_feature: GYAE6OF02HUI1X.45.79.H02.1.454.CMB.1.raw
  modified_base (139)..(139): a, c, t, g, unknown or other
  misc_feature (139)..(139): n is a, c, g, or t
  modified_base (391)..(391): a, c, t, g, unknown or other
  misc_feature (391)..(391): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacngggtcctcgggcccagtctgcccctgacctcacgccttcgccttccgtggtctgggtcctcgaggtacacgtcgatccaccattcctctgcacgtgaaaccaggctagtgacgttggtggtaacttacgtaccttgtcctcgtacggtaaccactacgcacccgtaggacaaccgcccaaacgtcatgttacttagacgtaggacaaggtacgccgccgttaggaggtttacaacgtcgtcctgtctcgctntaagtccgaggacaaaccgcgtcccctacggtacaacgtaccgtcctcggttacggaccgttaccgacggacccgttagggaccgggtaacggacggttacgttacggttaaactttacccgttttaagcggtttacctcgtaccttacgtacgttaacgtcggtaacggtaggttaacgtttacggtttcgttacggttcggttacgggacggtaccgacgtacgtcgttacggtacgtacggacgtacgtacgaccgtacggccgtaccgtaccctccgtacgtccg

SEQ ID NO: 35746 - DNA, 620 bp, Homo sapiens
  misc_feature: GYAE6OF02F94UK.45.79.H02.1.454.CMB.1.raw
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
  modified_base (399)..(399): a, c, t, g, unknown or other
  misc_feature (399)..(399): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggtcctgggcccagtctgccctgactcagcctgcctccgtgtctggtctcgtggacagtcgatcaccatctcctncaactcggaaccagcagtgatggttggatttaataccttgtctcctaggtaccaactacgccaacccaggtacaaacgcccccaaatccatgatttangaggacaggtaacgcggtacctgaggggtttcaagtcgactttcgtctggcttacaagtctaggacaacgacggtccctaccgngaacctaactcgttcgacgggtctacccgaggtctacggaggaacgtacgcttagagtttaactacgtggtaccgtgtcctacgtatagtcgacgtaaacgggacctaggctaacgttgggtaacgtcgggacgggaggtaccgtaggttccggaccgttaccgtacggtacgaccggtaccctacgggaccttacccgccccggttaggttacctacccg

SEQ ID NO: 35747 - DNA, 786 bp, Homo sapiens
  misc_feature: GYAE6OF02ICETQ.45.79.H02.1.454.CMB.1.raw
  modified_base (119)..(119): a, c, t, g, unknown or other
  misc_feature (119)..(119): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctnactctctcaatcaggacacagggtcctgggcccagtctgccctgactcagcctgcctccgtgtctggtctccgtggactagtcgactcaccattctccngcactgaaccngcagtntatggttacggattactaacttgtctccgtcgtaccacacgaccaccgtagaccaaaccgacccccaaatcgattagttactttagcggaggactacggtacgcccgtaccgtgttacgggttactacgtcgtacctttcgtcgtcggtacctaccgtaacgtcgtacgtaccgtaacccgtaccggtccctccggtaacgaaccgttaacgtccgttacgtccggtacctaccggtcggtcggtaacggacgggaccggtaccggttactacgttaaactttaacgttcgttaggtaccttacgggtcctaaacgtacggttaaaccgttcggttaaccgttaaggggttaagtttaacccgttttacgggttttacgggttacgggttaaccggggtaacggggtaacggttaaccctaaccggggtcccgtttaaaccgggtaaccccgtttaccgggttaaccggtaccggttaacccgtaccccgggtaaccggttaccccgttcccccgggttaccccgttaacccgggttcccgttaaccccgg

SEQ ID NO: 35748 - DNA, 687 bp, Homo sapiens
  misc_feature: GYAE6OF02FLSUP.45.79.H02.1.454.CMB.1.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtnatgttggattatacttnctctgtacacngcaccagacaacgccccaaactcatagtattagtggaggtcaaggtacgccggaccgttcgtaggggtttactaacgtcgtcttcgtctcggactcctaagtcgtacgaccgaaccgtacccggtcccttacccacgtaacctaacttccgtacgttcgggccgttaccggacggtccggtacgggaacggtaccggtacggtacgttaagtacttttaacgttaccgtacgtccgttacgtcttaacgttatacgttacggtaccgtaagggttacggtttaaggtttaccggttttagggttcggttacgggggtaccggaagggtaccgtaaggtccggttacggaccgtttaccggtacggttaccgtaaccggtaccgtaacggtcccgttaccggtcccccggttacggtcctaacccg

SEQ ID NO: 35749 - DNA, 816 bp, Homo sapiens
  misc_feature: GYAE6OF02HTU1X.45.79.H02.1.454.CMB.1.raw
  modified_base (247)..(247): a, c, t, g, unknown or other
  misc_feature (247)..(247): n is a, c, g, or t
tcagacgcgatcgacacgaccggtgctcgatttagtgtcacacgaagggaaaggggggggtcacgaagaggcagcgctctcgggacgtctccaccagtgcctgggctctgctgctcctcactctcctcactcaggacacagggtcctgggcccagtcctcgccctgactcagtcctcgcctcgtgtctgggtctacgtgactgtacgactccgacctattcctcctcgacctaccgtacggaacccngaccgtagtagtacgttggtagggtaactttaacgttaccgttcgtaccttccgttaacgggtaaccctaaacgcgtacccgaaacccgaggtaacccgaaaacccgtaccccctaaaacgtcctaaacgttggtaacgtttacggtagggtaaccggtaccgtaacgggtacggtacccggtacccggttacggtttaacgggtttactaaacgtccgtaccgttcgtcgttcggtacctacgtaacgttcgacgaaccgaacgtcccgtaccttacctacgtaaccgtacgttaccgtcggtaccgtcccgtaaccgtacggtacgtacgggaaccggtacggacgttacccgtagtttaaccgttacgttacgtactcgtaacgtcttaacgattacgtacggtacgtaggttacgttaccggtttcgtttaccgggtacggttaccgggtacgggtaaccgtaccgtaacggtccggtaccggttaaaccggtcggtaaccggtacggttaccggaaccggtaccggttcccgtccccggtacccggttaccgtaccgttcccgg

SEQ ID NO: 35750 - DNA, 761 bp, Homo sapiens
  misc_feature: GYAE6OF02JGW0Q.45.79.H02.1.454.CMB.1.raw
  modified_base (357)..(357): a, c, t, g, unknown or other
  misc_feature (357)..(357): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacgagggttcctgggcccagtctcgccctgacctcagcctgcccttccgtgtcgtcgggttcctccgtggacctggtccgtactccacctacttcctcctggccactacggaaccagcgagtagtagttggttagggtaacttacttaacgttcgttccttacgtcgtaaccacgagccaacccgagaccaaaccgaccccaactactagtacgtattanggacggacaggtacgccgtccgtaggtacggtttactaactcgtaccttactcgtacgtcctacgtacgtttcgacgaccgaaccgtccgtcccttacccgtacgtaaccgtaaccgttcgtccggttaccggtcctaaccggtccggttaacggacggaaccggttacggcggttaaccgtagttaacttaacggtttacctggtaccgttctctaaccgttattacggtcgtacggttaagttacgggtttagtttcgggtttcgggttacggttaccggggaagggttaacccggacgtccgttacgtaccccggttacggttaaccggtaccgttacccgaccggttaacccggtaaccgtccggttaccccggttcccggttcgaacccgtttacccgg

SEQ ID NO: 35751 - DNA, 711 bp, Homo sapiens
  misc_feature: GYAE6OF02F41X7.45.79.H02.1.454.CMB.1.raw
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctcgccctgactcagcctgcctccgtgtcgtgggtctcctggacagtcgatccacctatcctcctgcacgtaggaaccagcagtgtagttggtagggtacgttacttaaaccttcgtccttccgttacggtaacccaacgacgaccgaacccgacggaacctaaacccgaccccctaaactaccaagttagtaatttagtcgggagggtacgtaacggtaacggccggtaccctcgttaacggggtttactaacgtcgtaccttcgttccgtcgtacctaccgtaacgttcgtacgggaacctaacccgtacccggtcccccttaacctacgtaacctacgtccgttccggtacgggtccctccggacggtactacgggaacggtacgtacgggtctacgtagtttacgtcgtacgtcgtacgtcacttaacgtagtacgtacgttaacggttaggttaacgtttggtttggtcgtacggggtacgacggtacgtacgtcgtacggtcgttacgcgtacgtaccgacgacggccgtacccgcccgtacgtctccg

SEQ ID NO: 35752 - DNA, 951 bp, Homo sapiens
  misc_feature: GYAE6OF02JCANI.45.79.H02.1.454.CMB.1.raw
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (291)..(291): a, c, t, g, unknown or other
  misc_feature (291)..(291): n is a, c, g, or t
  modified_base (344)..(344): a, c, t, g, unknown or other
  misc_feature (344)..(344): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgccctcgtgtcgtcggtctcgtgactgcgactcaccntcctcgcncacgtacggaactggctagtgagttcggttaggttacttacttaccgttcgttcctccgtacggtaaccaacncgaccaacccgagaaccaaaaccccgaccccaactcaacgttgtaatttacgngggacggtacgtaacggtaccgccggtacccgttagggttacgggttttaacctacgtccgttcgttccgtcgtcgggtacccttacggtaacgttccggtaacggaaaccctaaccgtaccccgggtaccctttacccggtaaccgtaaccgtaaccgtttccgttaccggggtttacccgggtacccgtaaccccgggtacgggtttacccgggtaacggggtaacccgggaaccgggggttaacccgggttaccgtttaaacgggttttaaacctttaacggttttacccggtacggtttcggttacccgtacccgtttaggttaaccgtttacgggtttacggtaaccgggttttaaacgggtttaacggttttaacgggtttttaccgggttttcgggggttacggtttaacccggggggtaacgggtaaacccggggtaaccccggttaacgggttaaccccggtttaccggggttaaccccgttacgggggtttaaacccggtaaccccgttaacccggggtaaccccggttaacccgggttccccggttaaccccccctacccccggggggtttacccgtaccccggtttaacccccgg

SEQ ID NO: 35753 - DNA, 783 bp, Homo sapiens
  misc_feature: GYAE6OF02FZ4FV.45.79.H02.1.454.CMB.1.raw
  modified_base (239)..(239): a, c, t, g, unknown or other
  misc_feature (239)..(239): n is a, c, g, or t
  modified_base (533)..(533): a, c, t, g, unknown or other
  misc_feature (533)..(533): n is a, c, g, or t
tcagacgcgatcgacacgaccggtgctcgatttagtgtcacacgaagggaaagggggggggtcaaaagaggcagcgctctcgggacgtctccacatggcctgggctctgctgctcctcactctcctcactcaggacacagggtcctgggcccagtctgcccctgactcagcctgccctccgtgtcgtgggtcctcctggacagtcgatcaccatcctcctgcactggaaccagcaggtnacgttggttagggactttactaaccgtttgtccttccgtaggtaacccaaacacgtacccaaccccgaaggaccaaaacccgaccccccctaaaaactctaagttacggtaacttttacggtacgggaacgggtaccgtaaaggttaaaccgggccccggtacccgtttaccgggtaaccggggttttacctaaccgtccggttcctttccttacgtccggtacctaccgtaagtccgtacgacctaaccgccggtaccctcccgtagaaccttacgtcgtcggtcgggtcccncggaggtcgtaggacgggtacggtacggtcgtttacgtaatttaacgtacttacggtccgttgtactcgtaattgtacggtaccgttaaagggtttacgttaaggtttccgtttaggggttaccggttacggggacgggtaacggtacctacgtccgtaccggtaacccggttacgaccgggttaaccaccgggttacccgtacggtcccggtaccccgttaccccggtcggttaccctcggttaccccg

SEQ ID NO: 35754 - DNA, 623 bp, Homo sapiens
  misc_feature: GYAE6OF02JLLLK.45.79.H02.1.454.CMB.1.raw
  modified_base (182)..(182): a, c, t, g, unknown or other
  misc_feature (182)..(182): n is a, c, g, or t
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (472)..(472): a, c, t, g, unknown or other
  misc_feature (472)..(472): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
  modified_base (578)..(578): a, c, t, g, unknown or other
  misc_feature (578)..(578): n is a, c, g, or t
  modified_base (585)..(585): a, c, t, g, unknown or other
  misc_feature (585)..(585): n is a, c, g, or t
tcagacgcgatcgacacgaccggtgctcgatttagtgtcacacgaagggaaaggggggggtcacaagaggcagcgtctctcgggacgtctccaccatggcctgggctctgctgctcctcactctcctcactcaggacacgagggtcctgggcccagtctgccctgactcagcctgcctcgtntcgtggtctcgtggtactaggtcactcgacctatctccgancacgtggaccngctagtcgagttcggttagggtacttacgtaacctttgtctccgtacgtaccaacacgcctaccgtagaccgaaccgtaccccaactacgagtacgttaagttgacggaggtactaacggtaacgccggccgtaggttcggttaccgttaactcgtcgttctccgtaggcctcgtaactcgacggtcaacgtccgcctccgctaacgtattacgctacggtctcgcgtcgtgaacggngttgaccgtgtacttagttnacggtcncgtacgtcagttgtacgcgtacgtaggtttacgttagttcggtcgtacgggttacggagtaccgtacgcgtcggtaccncggtacncgtaccgcggtacgtccgtccgtaccgttctagtcccg

SEQ ID NO: 35755 - DNA, 760 bp, Homo sapiens
  misc_feature: GYAE6OF02H7YOI.45.79.H02.1.454.CMB.1.raw
  modified_base (130)..(130): a, c, t, g, unknown or other
  misc_feature (130)..(130): n is a, c, g, or t
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (416)..(416): a, c, t, g, unknown or other
  misc_feature (416)..(416): n is a, c, g, or t
tcagacgcgatcgacacgaccggtgctcgatttagtgtcacacgaaggggaaagggggggggtcacaagaggcagcgctcgtcgggacgtctccaccatggcctgggctctgctgctcctcactctcctnactcgaggacacgtacgggtcctgggaccctagtccgtcgccccttaggcctcgtacgccgttcgccgttccggtgttcggtcggtactccgtaggacaggtcgactccaccgtatcctcgngtacgacgtacgaacagntacgttagagttgttagggaacttactactcggtctaccgttaacgacacgctaccgacggagacctaaccgacctaactgtacgtattacgttagaacggtcggacgtacggaccggtccgaacgtttcgggtacggtttaaccncggttcttcctacggttaccgtcgtaccgtaacggttacggccgttacgggaaccaccggttaacccgtcccgtacgttaacgtaaacctcggttccgtaccggtaaccggtccgtaacggtcggtacgtacggggtacgacggttacggtagttacgttaacgttagtaccgtcgtctacgtactaccgttagttacggacgtacggttaacggttaacgttacggttcggtttaacgggtcggtaaccgggtacggtacggtaccgtcggaccgttcggtaccgtacgtacgaccgaccgttacgtaccggtccgtacccgtaccgtacctaccgttaccgg

SEQ ID NO: 35756 - DNA, 626 bp, Homo sapiens
  misc_feature: GYAE6OF02HE6JI.45.79.H02.1.454.CMB.1.raw
  modified_base (333)..(333): a, c, t, g, unknown or other
  misc_feature (333)..(333): n is a, c, g, or t
  modified_base (454)..(454): a, c, t, g, unknown or other
  misc_feature (454)..(454): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
  modified_base (557)..(557): a, c, t, g, unknown or other
  misc_feature (557)..(557): n is a, c, g, or t
tcagacgcgatcgacacgaccggtgctcgatttagtgtcacacgaagggaaaggggggggtcacaagaggcagcgctcgtcgggacgtctccaccatggactggctctgctgctcctcactctcctcactcaggacacgcgggtcctcgggccagtctgccctgactcacgtcctcgcccttcgtgttcgtcggtcctccgtggactacgtcgactccacctatcctcctgacctacgtacggaaccagctaagtgtagttggtaggtacttactacgttcgtcctcgtacacacacgccacacgacaacctacccaatctatagtattacgnggacggtacacgtacgccgtacgtacggttacgttactacgtccgtgttacctcgcgtacctacgtacgtcgacggtaccacgtccctccgtacgacgtacgtacgtcctacggtcgtacncgtagcgtaggacgtagtcgtactagttacttacgtacncgtacngtcatactgtacgagttagtagttcgttcgttacggcggtaacggacgacgtcgtacncgggtaccttacggtcgtaacgacggtccggacgtacccgttcggaccccgttcggtcctccggtcccg

SEQ ID NO: 35757 - DNA, 762 bp, Homo sapiens
  misc_feature: GYAE6OF02GSBZ7.45.79.H02.1.454.CMB.1.raw
  modified_base (158)..(158): a, c, t, g, unknown or other
  misc_feature (158)..(158): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtcngccctgactcagcctgccctcgtgtctgggtctccgtggacagtcgatcaccatcctcctgcactacgaaccagcaagtgagtggttgggtaattataaccgttgtcctcgtacggttaaccaaccgacgtccaaccccgaggaaccgaaaccgaccccctaaacgtaccaattcgtaatttaacgtacggacgggtacgtaaggtaaccggccggtacccgttacgttacggggttttaacctaacggtaccgttcgtttccgtccgtcggtaccgtaccgtaacggtccgtacgaccgtaaaccgtccggtaccccttaccctacggaaccgtaactccgtcgtacgggtaccgtaccggtaggaccgtagggtacgggaaccgtacgggtacgttagttaacgtttacgttaccgtacgtcgttacgtaccttacgtattacggagtacggttagttaacggttagtttaccggttaggttcggttaccggtagggtaaccggaccgtagtccggtaaccgtcccggttacggtacggttaccgaccgtaaccggacggttcccgtaccccggttacccccgttacggtcccgttaacccg

SEQ ID NO: 35758 - DNA, 893 bp, Homo sapiens
  misc_feature: GYAE6OF02FF151.45.79.H02.1.454.CMB.1.raw
tcagacgcgatcgacacgaccggtgctcgatttagtgtcacacgaagggaagggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcacatctcctgcacgtcggaaaccagctaggtagtagttcgggttagggtaactttaacttaaccgtttgtaccttaccgtacggttaaccaaacgtacggacccaaccccgagggtaacccaaacccggtaacccccccaaaacgttacccgtaagttacgtaacggtttttaacgtacgggaaacggggtacctaaagggttaaccgggacccgggttaccccgttacggggttaaccgggggtttttaaccctaaacggttaccggttcccttttaccggttaccggtacggggtaccccgttaacccgttaacgggttacccggttaccggggaaaccctaaaccggttacccggggtttaccccttttacccggaaccggtaaaccttaacgtcccgtttccgggtacgggtacccctccgggtacggtacggtacgggaaccgggtaacgggtacggtctaagtttagtttacgttcgtttacgtcgtacttatacttagtcggaccgtaaaccgggtctaacggtacgttttacggggcggtttacgggtccggggaccgggtaccgggttaccgacgggttaccgggtaaccccgttcggttaaccgggtccccgaaccgggtaccccggtaggtcccccggttcccggaccccgtttccgacccgttacccgttcccggg

SEQ ID NO: 35759 - DNA, 815 bp, Homo sapiens
  misc_feature: GYAE6OF02F4Z00.45.79.H02.1.454.CMB.1.raw
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcgaggacacgagggtcctgggcccagtcctgccctgactcgacgtcctgccctcgtgtcgtgggtctcgtggacngtcgatcaccattcctcctgcacgtacggaaccngcgtagtgtagttggttacggaatttacttaaccgttcgttccgttccgtacggtaccaacgcgaccgacgaacgaacctaaccccgaactaatacgtattaacgtcggaacggtaacctaggtacccggtccgggttaccgggttcggtaacgtccgttaccgttccttacgttcggtacccgtacgttaaccgttacggcgaccgtaacccgtaccgtcccggttaccctaaccgaacgtaccttaaccgttcccggtaccgggtcccgtaccggtaccgtaccggtaccgtaacgggtacggtacggtcggttaaccgtttacgtttaacttttccgttcgttcgtaacccgttgttaacgtcgttagggtaacccggaccgggtaacgttaccggtaccgttacggttacgggtttacgggtcgggttaccccgggaagggttacccgtacgggttaccgtcccggttacctaccgggtccggtacgggacccttaaccggtcccgttcccggttacccggtaccccgttgttacccccgttccgtttccccgtacccgttcccctccccg

SEQ ID NO: 35760 - DNA, 731 bp, Homo sapiens
  misc_feature: GYAE6OF02JATFM.45.79.H02.1.454.CMB.1.raw
  modified_base (124)..(124): a, c, t, g, unknown or other
  misc_feature (124)..(124): n is a, c, g, or t
  modified_base (183)..(183): a, c, t, g, unknown or other
  misc_feature (183)..(183): n is a, c, g, or t
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
  modified_base (520)..(520): a, c, t, g, unknown or other
  misc_feature (520)..(520): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactcncctcactcaggacacgagggtcctgggcccagtctgccctgactcagcctgccctcgtntctgggtctccgtggacagtcatcacntctctgactacgtcggaaccngacgtagtgagttggttagggtaactttactaacgttcgtcctcgttacgtaccaacgacgccacccgagacaaccgtaccccaaactcacgtagtaactttagtacggacggtacacggtaacgccggtccttggtacggttacagtcgtcttctcgtacgtctacgtatctcggaccaacgtccgtccctcgtacgtactactcgtacgtcggtaccacggtagcggtacggacggtacgacggtacgtacggttaatttacgtacgtcgtaccgttcgttaccgtnttacgtacggttcgtagggttaacggtttcggttaacgtttacggggttttacggtacgggttacgggaaccggggttaaccgtacccggtaacggttcggttaaacccgggttaccggttaccgggttaccgggtaaccgtaacccggttaccgggttaacccggtcccggttaccccgggttccggttcccgggacccgttttccccgg

SEQ ID NO: 35761 - DNA, 746 bp, Homo sapiens
  misc_feature: GYAE6OF02HSU0G.45.79.H02.1.454.CMB.1.raw
  modified_base (132)..(132): a, c, t, g, unknown or other
  misc_feature (132)..(132): n is a, c, g, or t
  modified_base (174)..(174): a, c, t, g, unknown or other
  misc_feature (174)..(174): n is a, c, g, or t
  modified_base (180)..(180): a, c, t, g, unknown or other
  misc_feature (180)..(180): n is a, c, g, or t
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
  modified_base (320)..(320): a, c, t, g, unknown or other
  misc_feature (320)..(320): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
tcagacgcgatcgacacgaccggtgctcgatttagtgtcacacgaagggaaagggggggttcacaagaggcagcgctcgtcgggacgtctccaccatggcctgggctctgctgctcctcactctcctcactnacggacacgacgggtcctcgggcccagtctcgaccctgactnacgccngcctcgtcgttccgtgggtaccttccgtggactaacgtcgactaccactactcctaccgtgaccacgtacggaacagactagngtatggtacggtatatactgctctagtacacncgccacgacgactaaccgacccaanctagtatattagacgaggataacggtacgcgtaccgtcgtaaggttacctatcgttacngttccgngtacctagtagttcccagggacccaacgtaccgtccctaccggtanacctactcgtaccggtacgtccgtacggaccgtaggtacggtagggaaccggtaggtacggtacggttaacgtttaaacttccggtcgttacggttacgtaccgttacctaggttaaccgacggttaaacggtaacgggttttagtaccggggtttaacggttttacggggtaccggttaaccggggtacgggtaacgggaacccggttaaggcccggtaaccggaacccggtttcgaaccggttacccgaccgggtaacccggtacggacccccggttacccgtacccccgggttcgtacccggtttaccccg

SEQ ID NO: 35762 - DNA, 213 bp, Homo sapiens
  misc_feature: GYAE6OF01ESB9S.45.20.B09.1.454.CMB.1.raw
  modified_base (212)..(213): a, c, t, g, unknown or other
  misc_feature (212)..(213): n is a, c, g, or t
tcagacgcgatcgacacgaccggtgctcgatttagtgtagtgtgaagggtgccagggaccctggtcaccgtctcctcagcctccaccagggcccatcggcttccccctggcaccctcctccaagagcacctctgggggcacagcggccctgggctgcctggtcaaggactacttccagtactctatctgagcgggctggcaaggcgcatagnn

SEQ ID NO: 35763 - DNA, 821 bp, Homo sapiens
  misc_feature: GYAE6OF02JSOMW.45.20.B09.1.454.CMB.1.raw
  modified_base (235)..(235): a, c, t, g, unknown or other
  misc_feature (235)..(235): n is a, c, g, or t
  modified_base (280)..(280): a, c, t, g, unknown or other
  misc_feature (280)..(280): n is a, c, g, or t
  modified_base (322)..(322): a, c, t, g, unknown or other
  misc_feature (322)..(322): n is a, c, g, or t
tcagacgcgatcgacacgaccggtgctcgatttagtgtagtgtgaagggtaaaggggggggggtctcaggaggcagcgctctcgggacgtctccaccatggcctgggctctgctattcctcaccctcctcactcacggcacagggtccgtggcccgagtctgccctgactcagcctcgcctccgtgtctggtctcctggacaggcgtactcaccatcctcctgcactcggaaccngcgagtgtacgttagttattatatatcgttctcgtcgtaaccaanaccaccaggacaaaccgtcccccaaactcgtatcgtattacngtatcgtactagtaacgtccggtcctacggtagggtttcagtactcgtccttctcgtcggtcctacgtacggttcgtacggaaccgtacccgtacccgtccccgtttaccgaaccgtacccgtaccttttccggtcccgggtttccggggaaccccctcgggtaacgggttccgaacggggtaaacgggtaccggtaccgggttattaccgggttttaaaccttttacggtaacccgttcgggaccgtacggttacccttaaggtaccctttaggaccgtttacccgaacccgtacctaaacggttcttaaaccgggttcctaaccggtttaacggtttacggtaacccggttacgggggtaaccccgtaacggggtaaaccctttaaccgggccgttaaaccccggggtcccgtttaaaccccgggtacccggttaaaacccggcccgttaaacccccggtagggttcccccgttccccgggttaaccccccccgggg

SEQ ID NO: 35764 - DNA, 656 bp, Homo sapiens
  misc_feature: GYAE6OF02HUD41.45.20.B09.1.454.CMB.1.raw
  modified_base (508)..(508): a, c, t, g, unknown or other
  misc_feature (508)..(508): n is a, c, g, or t
tcagacgcgatcgacacgaccggtgctcgatttagtgtagtgtgaaggtaaaggggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacaggcatccaccatctcctgcacgtggaaccagcagtgacgtttgttaattataactatcgtctctgtaccaacaacaccagacaaacgaccccaaactcatagtatttatgtatgtacgtaagtaacgtccgtcccgtcgtacggggttttactgtacgtcgtccgttctcgtcggtctacctaagtcgtacggacaaccgaccgtccctcccgacgacctactccttcgtcgggtccctaccgaggtcgtagggacggacggtacggtcgtgtaatttacgtacgtacgctacgctactaagtcgtacnccgaccgacgaagtctaaacgttcgtaacctacgttagttaccggttcggggacggtaacgggaacctaacggtcgtacccggtacccgttaccgttaacgggtaccgaccggttaccccggaaccggtccgtaccccggtcccccgg

SEQ ID NO: 35765 - DNA, 515 bp, Homo sapiens
  misc_feature: GYAE6OF01AIQZ1.48.36.D03.1.454.CMB.1.raw
  modified_base (400)..(400): a, c, t, g, unknown or other
  misc_feature (400)..(400): n is a, c, g, or t
  modified_base (505)..(505): a, c, t, g, unknown or other
  misc_feature (505)..(505): n is a, c, g, or t
tcagagtatacatacacgaccggtgctcgatttagctgcgtcacgatctctcttggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctggctccaggctgaanatcaggctgattatactgactgttctattttcaagtttcctttttgtcttcggacttgggaccgtaggtccaccgtcctaggtccagcccctaaggcccaacccnctgtctaccg

SEQ ID NO: 35766 - DNA, 523 bp, Homo sapiens
  misc_feature: GYAE6OF01CHSQW.48.36.D03.1.454.CMB.1.raw
  modified_base (513)..(513): a, c, t, g, unknown or other
  misc_feature (513)..(513): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtcccaaggtcattatttatgatgtcactaagcggccctcgggggtccctgatcgcttctctggctccagtctggcaacacggcctccctgaccatctcgtgggctccgaggctgaagatcaggctgatttatactgtctgttctattttctaagttttcctttttgtctttcggaacttgggaccgtaggtccaccgttcctaggtccacgcccaaggcccaaccccnctcgtctacc

SEQ ID NO: 35767 - DNA, 508 bp, Homo sapiens
  misc_feature: GYAE6OF01A7DGL.48.36.D03.1.454.CMB.1.raw
  modified_base (500)..(500): a, c, t, g, unknown or other
  misc_feature (500)..(500): n is a, c, g, or t
tcagagtatacatacacgaccggtgctcgatttagctgcgtcacgatctctcttggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaagtcattatttatgatgtcactaagcggccctcgggggtccctgatcgcttctctggctcaagtctggcaacacggcctccctgaccatctctgggctccgagctgaagatcaggctgattattactgcttgttctatttctaagtttcctttttgtcttcggtaactgggtaccgaggtcaccgtctaggtcagcccaaggccaacccnctgtctac

SEQ ID NO: 35768 - DNA, 522 bp, Homo sapiens
  misc_feature: GYAE6OF01BDKHO.48.36.D03.1.454.CMB.1.raw
  modified_base (511)..(511): a, c, t, g, unknown or other
  misc_feature (511)..(511): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcgtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccgaggctgaagatcaggctgtattattactgcttgttctattttctaagtttcctttttgtctttcggaacgttcggaccgtggtctaccgtcctaggtcacgccctaaggcccaacccnctcgtctaccg

SEQ ID NO: 35769 - DNA, 534 bp, Homo sapiens
  misc_feature: GYAE6OF01BKMGY.48.36.D03.1.454.CMB.1.raw
  modified_base (522)..(522): a, c, t, g, unknown or other
  misc_feature (522)..(522): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctcaagtctggcaacacggcctccctgaccatctctggctccaggctgaagatcaggctgattattactgcttgttacttatttacttacgttttcttttcgttcgttacgtacgttcgggaccgtacggtcctaccgtacgtcggtacacgacccgtaacgaccccaacccnctcgtctacccg

SEQ ID NO: 35770 - DNA, 543 bp, Homo sapiens
  misc_feature: GYAE6OF01BEMTK.48.36.D03.1.454.CMB.1.raw
  modified_base (371)..(371): a, c, t, g, unknown or other
  misc_feature (371)..(371): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgactcgcttctctggctccaagtctggcaacncggcctccctgaccatctctggctccaggctgaagatcgaggctgattattactgtctgttctattttctaagtttcctttttgtctttcgggtaacttcgggtacccgtaggttcctacccggttccttacgggtcctacgaccccaacgggccctaaaccccgcttaccg

SEQ ID NO: 35771 - DNA, 524 bp, Homo sapiens
  misc_feature: GYAE6OF01ES8Y3.48.36.D03.1.454.CMB.1.raw
  modified_base (404)..(404): a, c, t, g, unknown or other
  misc_feature (404)..(404): n is a, c, g, or t
  modified_base (515)..(515): a, c, t, g, unknown or other
  misc_feature (515)..(515): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctcaagtctggcacgacgcctcctcgaccatctcgtgggcctccgaggctgaagntcgagtctgattattactgtactgttctattttctaagtttcctttttgtctttcggaacgttgggaccgtaggtccaccgttctaggtccacgcccaacgacccaacccntcgctaccg

SEQ ID NO: 35772 - DNA, 522 bp, Homo sapiens
  misc_feature: GYAE6OF01B3BXD.48.36.D03.1.454.CMB.1.raw
  modified_base (511)..(511): a, c, t, g, unknown or other
  misc_feature (511)..(511): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgacccatcctctgggctccaggctgaagatcaggctgatttattactgtctgttctattttctaagtttcctttttgtctttcggactgggaccgtaggtctaccgtccgtagtcagcccgaaggcccaaccccnctcgtctaccg

SEQ ID NO: 35773 - DNA, 691 bp, Homo sapiens
  misc_feature: GYAE6OF01CXP09.48.36.D03.1.454.CMB.1.raw
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatccgtgggctcagtctgccctgactcagcctcgctcagtcgtccgggtctccgtggacagtcggtcaccatcgcctgcacgtggaaccagcagtgatagttggtgtcttactaactttgtctctggtaccaacatccaccagacaaacgtcccaaggtctattattatgatgtacactaacgccggtaccgtcggggtcctgactcgcttctctggctaccgtaagtctggacctaaccgccggtccctacccgtacgaaccctactccgttcgtcgggcccttaccgacggctaagaacgtatacgacggtctagtaactttacgttaaccgtgtaccttaggtttaccttaacttttttacccgttaaacggttttttcccgttttttttacggttacccgtttacccggggttaaaccgtttaccggggggtaacccggttaacgggttaccccgttaacccggtttcccgttaacggggtacccgtaaccggtaacccccgaaaccgggtacccccctaaaccccgtaccgtttacccgg

SEQ ID NO: 35774 - DNA, 705 bp, Homo sapiens
  misc_feature: GYAE6OF01C1XS7.48.36.D03.1.454.CMB.1.raw
  modified_base (236)..(236): a, c, t, g, unknown or other
  misc_feature (236)..(236): n is a, c, g, or t
  modified_base (329)..(329): a, c, t, g, unknown or other
  misc_feature (329)..(329): n is a, c, g, or t
tcagagtatacatacacgaccggtgctcgatttagctgcgtcacgatctctcgttgggggggtctcaggaggcagcactcgtcgggacgtctccaccatggcctgggctctgctcctcctcagcctcctcactcgagggcacaggatccgtgggctcagtctcgccctgactcagcctcgctcagtcgtccgggtctccgtggacaggtcggtcaccatcgcctgcactggaaccngcagtgatagttggtgtcttaactaactttgtcctccgtcggtaaccaacactccaacccgaggaccaaacgtcccaaggtctatttatttangtatgtacaacgtaagccggtcccgtcgggggtccctgactcgtcttctcgtcggctacgaagtcgtacggaccaaccgaccgggtccctacccgtacgaaccctacgtccgtaccggtcgggtccctaccggaacgggtcctaacggaaacgtactaccgaacggtccgttaggttaactttacttacggttgtccgttcggtttactttacgttttaccgttaagtttttcccgtttttacgtccgtttaccgggtaacgttccggggtaacccgtacgggttcccgtacccggttaccggttacggttacccgaccggtaaccccgtaaaccggaccccctaaacccccgtacgttccggtcccttaaccccg

SEQ ID NO: 35775 - DNA, 611 bp, Homo sapiens
  misc_feature: GYAE6OF01DLB6K.48.36.D03.1.454.CMB.1.raw
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcgtcaccatcgctgcactggaaccngcagtgatattggtgcttactaactttgtctcctggtaccaacatcaccaggcaaacgtcccaagtcattatttangatgtcactaagccggccgtcggggtcctgactcgcttctcgtggctccaagtcgtcggaccaacgaccggtcccttcccgtacgacctacttcgtcgtcgggcctaccgacggtctagaacgtactcgacggtccttagtaatttacttacgtgtacttagtttaccttaattttacttaacgtttttcccgttttttaggtaccgtttacggtaacgttcgggtacttcgggtacggttcctacccggttccgttaaggtccctaacggtaccccgaacggacccctaaacccccgtgtcggttaccc

SEQ ID NO: 35776 - DNA, 516 bp, Homo sapiens
  misc_feature: GYAE6OF01DVQES.48.36.D03.1.454.CMB.1.raw
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcaccaggcaaagtccccaaggtcatatttatgatgtcactaagcggccctcgggggtccctgatcgcttctctggctccaagtctgcacacggcctccctgaccatctctcgggctccgaggctgaagatcagctgattattactgcttgttctattttcaagtttcctttttgttcttcggtaacttgggaccgtaggtctaccgtccgtaggtctagacccaaggcccaacccgctcg

SEQ ID NO: 35777 - DNA, 606 bp, Homo sapiens
  misc_feature: GYAE6OF01DQ6GS.48.36.D03.1.454.CMB.1.raw
  modified_base (271)..(271): a, c, t, g, unknown or other
  misc_feature (271)..(271): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaanatcacccaggcaaagtcccaaggtcattatttatgatgtcactaagcggcccgtcgggggtccctgactcgcttctctcggctccaagtctggcaacacggcctccctcgaccatctctcgggcctccgaggcctagaacgtatcgacggtctagtatttaattacgtcgtcttgtttacttatttttactaacgtttttccttttttcgtacgtttaccggtaacgttcggggtaaccggtacgggttccctacccggttcccgttaacggttcccgaaccggtaccccgaaacgggtacccccaaaccccgtaaccgttcgttccctaacccg

SEQ ID NO: 35778 - DNA, 566 bp, Homo sapiens
  misc_feature: GYAE6OF01BY033.48.36.D03.1.454.CMB.1.raw
  modified_base (227)..(227): a, c, t, g, unknown or other
  misc_feature (227)..(227): n is a, c, g, or t
  modified_base (398)..(398): a, c, t, g, unknown or other
  misc_feature (398)..(398): n is a, c, g, or t
tcagagtatacatacacgaccggtgctcgatttagctgcgtcacgatctctcttggggggggtctcaggagtcagcactctcgggacgtctccaccatggcctgggctctgctcctcctcagcctcctcactcagggcacaggatcctgggctcagtctgccctgactcagcctcgctcagtgtccggtctcctggacagtcgtcaccatcgcctgcactggaaccngcagtgatattggtgcttacaactttgtctcctggtaccaacatcacccaggcaaagtccccaaggtcattatttatgatgtcactaagcggccctcgggggtccctgatcgcttctctggctcaagtctggcaacacgcctccctgaccatctctgggctccagctgaantcgaggctgtattattactgtactgttctattttctaacgttttccttttttgtcctttcggtaacgttcgggtaacccggtacgggttcccgtacccggttccgttacgggtccaacggtacccccgtaaacggcccctaaaacccccctcttccggtccctacccg

SEQ ID NO: 35779 - DNA, 766 bp, Homo sapiens
  misc_feature: GYAE6OF01C2MCN.48.36.D03.1.454.CMB.1.raw
  modified_base (239)..(239): a, c, t, g, unknown or other
  misc_feature (239)..(239): n is a, c, g, or t
tcagagtatacatacacgaccggtgctcgatttagctgcgtcacgatctctcgttgggggggtctcaggaggcagcactctcgggacgtctccaccatggcctgggctctgctcctcctcagcctcctcactcgagggcacaggatccgtgggctcagtctgccctgactcagcctcgctcagtcgtccgggtctccgtggactaggtcggtcaccatccgcctgcacgtacggaaccngcgagtgattagttggtgtacttaactaacttttcgtccttccgttacggtaaccctaaactacttacccaaccccgaacgggaaccgtaaaaccgtacccccgtaaacgggttaccttaattttaatttttaagtaggtaactttcgtacctaaccgtaaacgggtccccgggtccccggttccggggggttccctaggtacttccggtcctttccgttcgtcggtccttaccgaacgttcgtacggacctaaccgacccggtccctacccgtacgaccctacgttccgtcgtcgggtcctccgacggtcctaggaacgtacgtaccgaggtcgttagtaacgttttattacgtgtactttcgtttactttacgttttacgttaacgttttttccgtttttacgttccggtttacggtaacggttccggggtaccgtacgggttcctacccggtttaccgttaacgggtcctaaccggaccccgtaaaccggacccctaaccccgtaccgttcggtaccttacccg

SEQ ID NO: 35780 - DNA, 542 bp, Homo sapiens
  misc_feature: GYAE6OF01EQUC9.48.36.D03.1.454.CMB.1.raw
  modified_base (229)..(229): a, c, t, g, unknown or other
  misc_feature (229)..(229): n is a, c, g, or t
  modified_base (531)..(531): a, c, t, g, unknown or other
  misc_feature (531)..(531): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtgcttacaactttgtctcctgtaccaacatcacccaggcaaacgtccccaaggtcattatttatgatgtcactaagcggccctcgggggtccctgatcgcttctctggctccaagtctcggacaaccgaccggccctcccgtcgacccactcctcgtcgggcctccgaggcctagaagatcgaggctgtattattactgtcttgttctattttctaagtttcctttttgtcttcggtactgggaccgtggtcctaccgtcgtagtccagcccctagggaccccaacccnctcgtctaccg

SEQ ID NO: 35781 - DNA, 547 bp, Homo sapiens
  misc_feature: GYAE6OF01A456C.48.36.D03.1.454.CMB.1.raw
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcaccaggcaaagtccccaaggtcattatttatgatgtcactaagcggccctcggggtccctgactcgcttctctggctccaagtctggcaacacggccctccctgaccatcctctcgggcctccgacggtcctagaagactcgaggctgtattattactgtacttgttctattttctacgtttcctttttgtctttacggtacgtcgggtaccgtaggtcctccgttccgttaggtcctacggaccccaaggccccaaccccgtgttaccg

SEQ ID NO: 35782 - DNA, 600 bp, Homo sapiens
  misc_feature: GYAE6OF01CKBES.48.36.D03.1.454.CMB.1.raw
  modified_base (230)..(230): a, c, t, g, unknown or other
  misc_feature (230)..(230): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcggtcaccatcgcctgcactggaaccngcagtgatattggtgcttactaactttgtctcctggtaccaacactcacccaggacaaacgtccccaaggtctatttatttatgatgtacactaacgccggccgtcggggtcctgactcgcttctcgtgctacagtctggacaacgcggtcctcctcgacctactcgtcgtcgggcctccgaggtctagaacgctcgagtctagtactttacttactgtcttcgttacttacttttacgttaacgtttttccgtttttcgtaccgtttacggtaacgttcgggtaccgtacggtccctaccggttccgttacggtcctaaccggaccccgtaaacggaccccctaaaccccgtcgttccgtccttacccg

SEQ ID NO: 35783 - DNA, 569 bp, Homo sapiens
  misc_feature: GYAE6OF01CTKGQ.48.36.D03.1.454.CMB.1.raw
  modified_base (211)..(211): a, c, t, g, unknown or other
  misc_feature (211)..(211): n is a, c, g, or t
  modified_base (272)..(272): a, c, t, g, unknown or other
  misc_feature (272)..(272): n is a, c, g, or t
  modified_base (389)..(389): a, c, t, g, unknown or other
  misc_feature (389)..(389): n is a, c, g, or t
  modified_base (493)..(493): a, c, t, g, unknown or other
  misc_feature (493)..(493): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccntcgcctgcactggaaccagcagtgatattggtgcttacaactttgtctcctggtaccaacntccacccaggcaaaacgtccccaaggtcattatttatgatgtcactaagccggcccgtcgggggtccctgactcgcttctcgtggctccagtctggcacacgctcctgaccatctcnggcctccgaggctgaagctcgaggctgatttacgttactgtcttgttcttattttactaacgtttttcctttttggtcctttacggtaacgttcggggtaccgngggttccctaccggttccgtaggttcccaacggccccgtaaacgggcccccaaacccctacgttcgtccctacccg

SEQ ID NO: 35784 - DNA, 517 bp, Homo sapiens
  misc_feature: GYAE6OF01BNVBE.48.36.D03.1.454.CMB.1.raw
  modified_base (508)..(508): a, c, t, g, unknown or other
  misc_feature (508)..(508): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtcccaaggtcattatttatgatgtcactaagcggccctcgggggtccctgatcgcttctctggctccaagtctggcacacggcctcctgaccatctctcggctccaggctgaagatcaggctgtattatactgtcttgttctattttctaacgtttctttttgtcttcggaactgggaccgtaggtctaccgttcgtacggtcacgcccaacgcccaacccnctgtctacc

SEQ ID NO: 35785 - DNA, 531 bp, Homo sapiens
  misc_feature: GYAE6OF01CM9OF.48.36.D03.1.454.CMB.1.raw
  modified_base (526)..(526): a, c, t, g, unknown or other
  misc_feature (526)..(526): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagccctcgctcagtgtccgggtctcctggacagtcggtcaccatcgcctgcactggaaccagcagtgatattggtgcttacaactttgtctcctggtaccaacatcaccagcaaagtcccagtcattattatgatgtcactaagcggcccgtcggggtccctgatcgcttctctcggctccaagtctggcaacacggcctccctgaccatctctcgggcctccgacggctagaaagatcaggtctgtaatttattaactgtctgtttctattttcaagttttcctttttgtcttcggtaactgggtacctaggtccaccgttccctaggtcacgacccaaggcccaaaccccgntaccg

SEQ ID NO: 35786 - DNA, 536 bp, Homo sapiens
  misc_feature: GYAE6OF01CPCO1.48.36.D03.1.454.CMB.1.raw
  modified_base (229)..(229): a, c, t, g, unknown or other
  misc_feature (229)..(229): n is a, c, g, or t
  modified_base (364)..(364): a, c, t, g, unknown or other
  misc_feature (364)..(364): n is a, c, g, or t
  modified_base (391)..(391): a, c, t, g, unknown or other
  misc_feature (391)..(391): n is a, c, g, or t
  modified_base (523)..(523): a, c, t, g, unknown or other
  misc_feature (523)..(523): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtgcttacaactttgtctcctggtaccaacatcacccaggcaaacgtccccaaggtcattatttatgatgtcactaagccggccgtcggggtccctgactcgcttctctgctcagtctgcacncgcctcctgaccatctcgtggcctcgnggctgaagatcgaggctgattattactgcttgttctattttctacgttttcctttttgtcgttacggaacgttcgggaccgtacggtcctaccggttccgtaggtccacggacccgaacggccccaaccccncgtcgtctacccg

SEQ ID NO: 35787 - DNA, 708 bp, Homo sapiens
  misc_feature: GYAE6OF01DV160.48.36.D03.1.454.CMB.1.raw
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacaggtcggtcaccatcgcctgcactcggaaccagcaggtgtatagttggtcgtacttactaacttttgtccttccgtacggtaaccaacacttaccaaccccgaggacctaaaacgtacccctaaaggttacctaagttttattaatagtacttcgtacaacgtaacggccggtaccccgttcgggggtccctacgtacgtccggtcttttccgtcgtccggtacctaccgaagttcgtacgggacctaaccggaccggtccctcccgtacgacctacttcgtacgtcgggtcctccggtacggctagaacgtatacgacggtcttagtatttactacgttacgtctttacgttactttaacgtttttacttaacgttttttccgttttacgttaccgttacgggtaaccgttacggggtaccggtacggttcccgtaacccggttccgtacggtaccctaaccggtaccccgtaaacggaccccctaacccgtccgtcgttacccg

SEQ ID NO: 35788 - DNA, 523 bp, Homo sapiens
  misc_feature: GYAE6OF01D945W.48.36.D03.1.454.CMB.1.raw
  modified_base (232)..(232): a, c, t, g, unknown or other
  misc_feature (232)..(232): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtgcttacaactttgtctcctggtaccaacatcaccaggcaaagtccccaaggtcattatttatgatgtcactaagcggcctcgggggtccctgatcgcttctctggctccaagtctggcaacacggcctccctgaccatctcgtgggcctccaggctgaacgatcgaggtctgtattattactgtcttgttctattttctagttttcttttgtcttcgtacgtcgggtaccgtaggtcctccgtctaggtccagccccaaggccccaacccgtctacg

SEQ ID NO: 35789 - DNA, 798 bp, Homo sapiens
  misc_feature: GYAE6OF01CAJLQ.48.36.D03.1.454.CMB.1.raw
tcagagtatacatacacgaccggtgctcgatttagctgcgtcacgagtacgtttcttgggggggtctccaggaggcgagcactctcgggacgtctccaccagtcggcctgggctctgcgtcctcctcacgcctcctcacgtcacgggcacaggatccgtgggctcacgtctgccctcgactcacgccctcgctcagtgtccggtctccgtggacagtcggtcacatcgcctgcgacgtacgaaccgagcgagtagatagttgggtgcttactaactttgtctccgtacgtaaccaacgactaccaaccgacgaccaaacgtacccgtaaggtactaagtttactttagtacgtaagttagtacgtacgtaacggccgtacccgtccggggttcctggtacgtcgtcgttcgtcgtcggctacgaacgtcgtacggactaaccgaccggtcctacccgtacgacctatccgtcgtcgggaccttaccgaggtaccttaggaacgttaacgttccgaaccggtacgtttaaggttaacctttaacgtttaaccgtacgttaccgttacgtttaccgtttaaacttttttaacccggtttaaaccttttttcccgtttttttacggtacccgtttaccgggttaaaccggttaccgggggtaaacccgttacgggttaaccccgtaacccgggttacggttaaccgggtaacccggttaaccggtaacccccggtaaacgggttaaccccccaaaccccggtttaccgttacccggttcccgtaaaccggttttacccccg

SEQ ID NO: 35790 - DNA, 605 bp, Homo sapiens
  misc_feature: GYAE6OF01A6CZZ.48.36.D03.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacngtcggtcaccatcgcctgcactggaaccngcagtgatattggtgtcttactaactttgtctcctggtaccaacatccaccagcaacgtcccaaggtctattattatgatgtactacgtaagccggtcccgtccgggggtcctcggactcgtcttctcgtcggctccgtaagtcgtggacaacgaccggccctccctcgaccctactccgtcgtcggtcctaccgacggtctagtaaacgtacgtcgtaggtctagtaactttacttacgtgtcttcgttacttattttcgttacgttttccgttttgtacgttacggtacgtcgggtaccggtacggtccgtaccgtaccgtcggtaccgtacgacccgtaaccggacccctaaccccgtactcgtcctacccg

SEQ ID NO: 35791 - DNA, 784 bp, Homo sapiens
  misc_feature: GYAE6OF01B2TNH.48.36.D03.1.454.CMB.1.raw
tcagagtatacatacacgaccggtgctcgatttagctgcgtcacgatctctcttgggggctggggtctcaggaggcagcactctcgggacgtctccaccatggcctgggctctgctcctcctcagcctctcactcagggcacaggatcctgggctcagtctgccctgactcagcctcgctcagtcgtccgggtctcctggacagtcggtcaccatcgcctgcactggaaccagtcagtgatattggtgcttacaactttgtctcctggtaccaacactcaccaggcaaacgtccccaaggtctattattatgtatgacactaagccggccgtcggggtcctgatcgtcttctcgtcggcctaccgtaacgtctagggaccaaacccgacccgggtcccctcccgtacgaacccctaacttcccgttccgttcggggtacccttacccggaacgggtccgttaacgggaaacggtaacttaccggtaacgggtccgttaacgggttaactttttaaaccgtttaaccgttcgggttacccttttacggtttacccttttaacgttttttttaacccgtttaaaccggttttttccccgtttttttttagggtttacccgttttacccggggttaaaccggtttccggggggtaaaccccggtttaaccgggttaccccggttaaaccccgggtttaccccgtttaacggggttaccctaaaccccggggtacccccggtaaaacccgggtcccccctaaaaaccccccgtcggttttaaccccgg

SEQ ID NO: 35792 - DNA, 536 bp, Homo sapiens
  misc_feature: GYAE6OF01AK4KU.48.36.D03.1.454.CMB.1.raw
  modified_base (364)..(364): a, c, t, g, unknown or other
  misc_feature (364)..(364): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattattatgatgtcactaagcggccctcgggggtccctgatcgcttctctggctccaagtctggcacncgcctcctgaccatctctggctccgaggctgagatcgagctagattatacgtgtcttgttcttatttaccttagttttcgttttgtccgttacggacgttcggtaccgtacggttccgtaccgttaccgtcgtccgacgacccgacgtaccccaacccgtctcgcttacccg

SEQ ID NO: 35793 - DNA, 554 bp, Homo sapiens
  misc_feature: GYAE6OF01BNL5D.48.36.D03.1.454.CMB.1.raw
  modified_base (233)..(233): a, c, t, g, unknown or other
  misc_feature (233)..(233): n is a, c, g, or t
  modified_base (386)..(386): a, c, t, g, unknown or other
  misc_feature (386)..(386): n is a, c, g, or t
  modified_base (539)..(539): a, c, t, g, unknown or other
  misc_feature (539)..(539): n is a, c, g, or t
tcagagtatacatacacgaccggtgctcgatttagctgcgtcacggagtctctcttggggggggtctcaggaggcaggcactctcgggacgtctccaccatggcctgggctctgctcctcctcagcctcctcactcagggcacaggatcctgggctcagtctgccctgactcagcctcgctcagtcgtccgggtctcctggacagtcggtcaccatcgcctgcactggaaccngcagtgatattggtgcttacaactttgtctcctcggtaccaacatcacccaggcaaagtcccaaggtcattactttatcgatgtcactaagcggtcccgtcgggggtccctgactcgcttctctcggctcaagtctggcaacgacgcctccgnaccatctcgtggctcgagctgaagtatcgagtctagtattattactgtcttgttcttagttttactaacgttttcttttcgtcttacggtacttcgggaccgtacggtccgtacccgtcgtacggtccaacggtccccaacgggcccaacccncttccgccttacccg

SEQ ID NO: 35794 - DNA, 662 bp, Homo sapiens
  misc_feature: GYAE6OF01BEQGS.48.36.D03.1.454.CMB.1.raw
tcagagtatacatacacgaccggtgctcgatttagctgcgtcacgatctctcttggggggggtctcaggaggcagcactctcgggacgtctccaccatggcctgggctctgctcctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacaccaggcaaagcccccaaatcatgatttatgatgtcagtaactcggccctcgtaggggtttctaagtcgtacttctcgtggctccgaagtctggacaacacggcccttcccgtgacctatctcgtcgggctccgaggctaggacgggacgagggctaggtaactttagttaccgtgtaccctaacccgttctaacgttaacttaaccgaaggtcccaaaggtccgaacggtcccttaaccgttccggtttaccgggttacgggttaaaccggtttccgggggaccggggtaaacggggacccgttaaagggtcccgttaccggggtaaccccggttacccgttaacggggttacccgaaccgggtacccccgtaaagggttccccccgg

SEQ ID NO: 35795 - DNA, 696 bp, Homo sapiens
  misc_feature: GYAE6OF01DDRJJ.48.36.D03.1.454.CMB.1.raw
  modified_base (228)..(228): a, c, t, g, unknown or other
  misc_feature (228)..(228): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcgtcaccatcgcctgcactggaaccngcagtgatattggtgcttactaactttgtctcctgtaccaacatcaccaggacaaacgtcccaaggtctaattattatgatcgtacacgtaagccggtccgtcggggtccctagactcgtcttcgtcgtcggcctaccaagtctggaccaacgaccggtccctacccgtacgaccctattctacgtcgggtcctaccgaggtcctaggaagtactacgacggtccttaggtaactttacgttacgttaggtcctttacgtttaccgttaacgttttttaccgttaaacggttttttcccttttttttacggttacccggttttaaccgggtaaaccggtttccggggtaacccggttacgggtttacccgtaccccgggtttaccgttaaccgggtaccgtacccggtacccccgtaaaccgggtaacccccctaaacccccgtaccttccggttacccttaaccccg

SEQ ID NO: 35796 - DNA, 592 bp, Homo sapiens
  misc_feature: GYAE6OF01BFL8L.48.36.D03.1.454.CMB.1.raw
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatccgcctgcactggaaccagcagtgatattggtgcttacaactttgtctcctggtaccaacatcaccaggcaaacgtcccaaggtcattatttatgatgtcactaagcggccgtcggggtcctgatcgcttctcgtggctccaagtctggcaacgccggccctccctgacccatcctctcgggcctaccgaggtcctaggaacgtacgtcgacggtcttagtatttattaccgtggtacttcgtttacttacgtttttactaacggtttttcccttttttggttaccgtttccgggtaaacgttcggggtacccgtagggttccctacccggttccgtaggttccacggtccccaacggaccccaacccctgtcgtaccc

SEQ ID NO: 35797 - DNA, 629 bp, Homo sapiens
  misc_feature: GYAE6OF01C19JE.48.36.D03.1.454.CMB.1.raw
  modified_base (227)..(227): a, c, t, g, unknown or other
  misc_feature (227)..(227): n is a, c, g, or t
  modified_base (274)..(274): a, c, t, g, unknown or other
  misc_feature (274)..(274): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcaggcacaggatcctgggctcagtctgccctgactcagcctcgctcagtgtccggtctcctggacagtcggtcaccatcgcctgcactggaaccngcagtgatattggtgtcttaactaactttgtcctcctggtaccaacnctccaccgagaccaaacgtccccaaggtcaagtttatttatgtatgtacacgtaacgccggtcccgtcggggtcctaggactcgtcttctcgtcggcttacagtctggacacgcggccctcctcgaccatctcgtcggtctccgagcgtagaatcgtacgacggtcttacggtatttacgtacgttcgtactttacggtttaccttatttttaccgttaacgtttttccgttttttcgtaccgtttaccggtaacggttaccgggtacgtacgggttaccctaccgggttaccgtcggttaccgaaccggaccccgtaacggacccctaaccccgaacgttcgtaccctaacccg

SEQ ID NO: 35798 - DNA, 606 bp, Homo sapiens
  misc_feature: GYAE6OF01DYDB6.48.36.D03.1.454.CMB.1.raw
  modified_base (371)..(371): a, c, t, g, unknown or other
  misc_feature (371)..(371): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcggtcaccatccgcctgcactggaaccagcagtgatattggtgcttacaactttgtctcctggtaccaacactcacccaggaccaaacgtccccaaggtcattatttatgatgtcactaacgcggccgtcggggtccctgactcgcttctctgctcagtctggcaacncggcctcctcgacctactctcgtggcctaccgaggtcctagaagtctacgtacggtcttagtactttacttactcgtacttgtttacttactttttaccgttaacgtttttcccttttttgtacgttaccgggttaacgtcggggtaacccgtcgggttcctacccggttccgtacgggtaccctaccggaccccgtaaaccggacccctaacccctcgttccgtccttaccccg

SEQ ID NO: 35799 - DNA, 608 bp, Homo sapiens
  misc_feature: GYAE6OF01DOG4C.48.36.D03.1.454.CMB.1.raw
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctccgtgtaccaacatccacccaggcaaacgtcccaaggtcatttatttatgatgtacactaacgccggtcccgtcgggggtccctgatcgctttctcgtcgctaccagtcgtcggacaaccgacggtcctccctacgaccctatcctcggtcggtcctaccgacggtctaggaacgacttcgaggctttgtaactttattacgtgtccgttgtttaccttatttttactacgtttttctttttggtaccttacgggtacgtcgggtaccgttacgggtaccttacccggttacgtacggtacctaccggaccccgtaaacggacccctaaccctcgtcgtccgttacccg

SEQ ID NO: 35800 - DNA, 599 bp, Homo sapiens
  misc_feature: GYAE6OF01D8ZXM.48.36.D03.1.454.CMB.1.raw
tcagagtatacatacacgaccggtgctcgatttagctgcgtcacgatctctcttgggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgattagttggtgtcttactaactttcgtcctccgtacggtaccaacactccaccaggaccaaacgtccccaaggtctatttatttatgatgtacactaacgccggtcccgtcggggtccctgactccgcttctcgtcggtcctccgaagtcgtcggaccaaccggaccggtccctcccgtacgacctactccgtcgtcgggcctcccgacggtctaggaagtactcgacggtcttagtacttattactgtcttcgttacttactttacttacgtttcctttttgtcgttacggtacgtcgggaccgtcggtcctaccggtccgtacgtccacgtaccccgaacgacccaaccctcgtcgtccc

SEQ ID NO: 35801 - DNA, 574 bp, Homo sapiens
  misc_feature: GYAE6OF01AKYXF.48.36.D03.1.454.CMB.1.raw
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatatggtgcttacaactttgtctcctggtaccaacatccaccaggacaacgtccccaaggtctattattatgatgtcacgtaagccggcccgtcggggtccctgactcgtcttctctcggctccgaagttcgtcggaccaacgaccggtccctcccgtacgacctactcctcgtcggcctccgaggctgaagactcgaggtctgtacttattacgtcgtcttgttacttattttcttaacgttttccttttgtacttcggtacgttcgggaccgtcggtacctaccgttccgtacggtaccgacgtcccgaacgtaccccaacccgtcgtcgtacccg

SEQ ID NO: 35802 - DNA, 548 bp, Homo sapiens
  misc_feature: GYAE6OF01BXO7Z.48.36.D03.1.454.CMB.1.raw
  modified_base (229)..(229): a, c, t, g, unknown or other
  misc_feature (229)..(229): n is a, c, g, or t
  modified_base (537)..(537): a, c, t, g, unknown or other
  misc_feature (537)..(537): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcggtcacatcgcctgcactggaaccngcagtgatattggtgcttacaactttgtctctggtaccacatcaccaggcaaacgtcccaaggtctattattatgatgtacactaagccggtcccgtcgggggtcctgactcgtcttctcgtgctcagtctgcacacgcctcctgaccatctcgtcgggcctaccgaggtctagaacgtactcgaggtctagtaactttacttactgtacttgttcttaattttactaacgttttccttttagtcgttcggtaacgtcgggaccgtaggtcctaccggtcctaggtccacgcccgaacgcccaacccnctcgtctaccg

SEQ ID NO: 35803 - DNA, 755 bp, Homo sapiens
  misc_feature: GYAE6OF01A70CK.48.36.D03.1.454.CMB.1.raw
  modified_base (178)..(178): a, c, t, g, unknown or other
  misc_feature (178)..(178): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctnagtgtcccgggtctcctggacaggtcggtcaccatcgcctgccactggaaccagcagtgattattggtcgtacttactaactttgtccttcctcggtaaccaactactccaaccccgtaggaccaaaacgtaccccgaaaggttacctaatttactttaactagtacttacgttactaacgttaaacggccggtcccggttaccggggggtaccctaggtaacgtccgtcttcgttcgtcggtcctaccgaagtccgtaggacctaacgaccgtcccgtacccgtcgtaacctacgtcgttccgtcgggtcctaccggacggtctaggaaacgtacgtaccgtaggtccttaggtaacttttaacgttacgtcgttaccgtttcgtttacctttaacgtttttaccgttaaacgttttttcccgtttttacggtttaacgtttaccgggttaaaccggttcggggtaacccgttacgggttaacccgtacccgggttaccgttaccgggtaccgtaaccggtaccccgtaaccgggtaacccctaaacccccgttaccgttacgtcccgttaacccg

SEQ ID NO: 35804 - DNA, 734 bp, Homo sapiens
  misc_feature: GYAE6OF01BZ426.48.36.D03.1.454.CMB.1.raw
  modified_base (235)..(235): a, c, t, g, unknown or other
  misc_feature (235)..(235): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcacgcctcgctcagtcggtccgggtctccgtggacagtcggtcaccatcgcctgcacgtcggaaccngcagtgatagttggtgtcttaactaactttgtccttccgtcggtaaccaacactccgaacccaggaccaaacgtccccgaaggtctaatttaacttttatacgtattacgtactaacgtaacggtcccgggtcccggttccggggggttccctaggtacctcgtcctttctcgtcggtcctaccgtaacgtcgtacggaccaaaccgaccgggtcccttacccgtacgaaccctacgttccttcggtacgggtcctacccggacgggtaccgtaagggtaacgtactaccgacggtcttacggtaagtttacgttacgttcgtcctttacgtttacctttaagtttttaccttaacgtttttccgttttttcggtaccgtttacgggtaaccggttccggggtaaccggttacggtcccgtaacccgttaccggttacggtccctaaaccggcccgtaaaccggaccccctaacccgtaccgttcgtacccttacccgg

SEQ ID NO: 35805 - DNA, 752 bp, Homo sapiens
  misc_feature: GYAE6OF01BTWUU.48.36.D03.1.454.CMB.1.raw
  modified_base (274)..(274): a, c, t, g, unknown or other
  misc_feature (274)..(274): n is a, c, g, or t
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttactaactttgtctcctggtaccaacntcaccaggacaacgtcccaaggtcattattatgatgtacacgtaagccggccgtcggggtccctgactccgtcttctcgtcggcctaccgaagttcgtaggaccaaccgaccgggtcccctcccgtacgaccctacgttcccgttccgtacgggtcccttacccggaagggtccttaaggaaacggtacttacccggtaacgggtcccgtttaaggttaaccgttttaacgtttaaccgttcggttaccgttttcgggttttaaccctttaagtttttttacccgttaaaccggttttttttccccgtttttttacggttacccggttttaacccggggttaaaccggtttaccgggggttaaccccggtaccgggtttcccgtaaccccgggtttcccgttaacgggttaccctaacccgggtacccccgtaaaccgggtacccccctaaacccccgttaccgttcgttaacccccg

SEQ ID NO: 35806 - DNA, 772 bp, Homo sapiens
  misc_feature: GYAE6OF01DE1O7.48.36.D03.1.454.CMB.1.raw
  modified_base (249)..(249): a, c, t, g, unknown or other
  misc_feature (249)..(249): n is a, c, g, or t
tcagagtatacatacacgaccggtgctcgatttagctgcgtcacgatctctcgttgggggggggtctcagggaggcagcactctcgggacgtctccaccatggcctgggctctgcctcctcctcagcctcctcactcgagggcacaggactccgtgggctcagtctcgccctgacctcagcctcgctcgaggtcgtccgggtctccgtggactaggtcggtcacctatccgcctgccacgtcggaaccngctagtgattagttggtgtacttaacttaactttcgtccttccgtacggtaaccaaactactacccgaacccgaaggaacctaaaaccggtaccccgtaaaggtaccttaatttaatttaagtacgtagttacgtacctaacgtaacggtcccgggtacccggttccgggggtaccctagtactccgtcttcgtacgtcggtcctacgacgttcgacggaccaaaccggacccggtcccctacccgtacgtaccctacgttccgttccgggtaccgggtccctaaccggtaacgggtccgtaagggtaaacggtacgtaccggtaacgggtacctttaagttaacgtttaacttacgtcgttacctttaggttttacctttaactttttccgtttaacgttttttccgttttcgtacggttaaccggtacggtaccggggtaccgtacggtaccgtacccgttcggtaacggtacccgaccggtacccgtaaccggacccctaacccgtcgtctaccgtaccc

SEQ ID NO: 35807 - DNA, 566 bp, Homo sapiens
  misc_feature: GYAE6OF01CL8OE.48.36.D03.1.454.CMB.1.raw
  modified_base (237)..(237): a, c, t, g, unknown or other
  misc_feature (237)..(237): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
tcagagtatacatacacgaccggtgctcgatttagctgcgtcacgatctctcttgggggctgggggtctcaggaggcagcactctcgggacgtctccaccatggcctgggctctgctcctcctcagcctcctcactcgagggcacaggatccgtgggctcagtctgccctgactcagcctcgctcagtcgtccgggtctcctggacagtcggtcaccatcgcctgcacgtggaaccngcagtgatacttggtgcttacaactttgtctcctggtaccaacactccaccgaggacaaacgtccccaaggtcctattatttactgtatgtacactaagccggtccgtcggggtaccctgactcgcttctctgctcagtcngcacncgcctcctcacnctcnctggcctcgagtctagaagtncgagctagtattactaacgtgtcttgttacttacttttactacgttttcctttttacgttcgttacggtactacgggtaccgtagttccgtacccgttcgtacggtactacggtaacccacggacccctaaacccgtcgttacccg

SEQ ID NO: 35808 - DNA, 587 bp, Homo sapiens
  misc_feature: GYAE6OF01EIUAN.48.36.D03.1.454.CMB.1.raw
  modified_base (232)..(232): a, c, t, g, unknown or other
  misc_feature (232)..(232): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (442)..(442): a, c, t, g, unknown or other
  misc_feature (442)..(442): n is a, c, g, or t
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcggtcaccatcgcctgcactggaaccngcagtgatattggtgtcttactaactttgtctcctggtaccaacactcaccaggaccaaacgtccccaaggtctatttatttatgatgtacactaacgccggccgtcggggtcctgactcgcttctctggctcagtcngacacncggcctcctcgaccatcctcgtcgggctccgacggctagaagactcgaggtctgtatttacttctntcgttgttacttactttcttacgttttccttttcgttcgtttacggtacggttcgggtaccggtacggttccgtacccggttccgttacgggtaccgaccggtaccccgaaaccggaccccgtaaacccccgtcgtccggtaccc

SEQ ID NO: 35809 - DNA, 560 bp, Homo sapiens
  misc_feature: GYAE6OF01CDJ6K.48.36.D03.1.454.CMB.1.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (379)..(379): a, c, t, g, unknown or other
  misc_feature (379)..(379): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacngtcggtcaccatcgcctgcactggaaccngcagtgatattggtgcttacaactttgtctcctggtaccaacatcaccaggcaaagtccccaaggtcattatttatgatgtcactaagccggcccgtcgggggtccctgactcgcttctctggctcaagtctggcaacgcgcctccncgaccatctcgtggcctccgaggctagaacgtactacgaggtcttagtaatttattactgtcttgttcgttacttttactaacgttttcctttttcgtcgtttaccggtaacgttcgggaccgtacggttcctaccggttccgtaggtccgtacgacccgaagccccaacccgtgttaccg

SEQ ID NO: 35810 - DNA, 629 bp, Homo sapiens
  misc_feature: GYAE6OF01APVMY.48.36.D03.1.454.CMB.1.raw
  modified_base (240)..(240): a, c, t, g, unknown or other
  misc_feature (240)..(240): n is a, c, g, or t
tcagagtatacatacacgaccggtgctcgatttagctgcgtcacgatctctcttggggctgggtctcaggaggcagcactctcgggacgtctccaccatggcctgggctctgctcctctcagcctcctcactcagggcacaggatccgtgggctcagtctgccctgactcagcctcgctcagtcggtccggtctccgtggaccagtccggtccaccagtccgcctgccacgtggaacccngtccagtgtatagttggtcgtacttactactttcgtcctccgtcgtaccaactactccgacccgacggaccaaccgtcccgtaacgtactacttacttacgtcgtatcgtacctacgtaacgccggtcccggtccggggtccctgtacgtccgtccttccgtcgtcgtcctaccgtacgtcgtcgaccaccgtaccgtcctcccgtcgtacctcgtctcgtcgtccgtccgacgtcgtagacgtctcgagtctgtacttacgttacgtgtcgttgttcttactttacgttacgtttccgttttcgtccgttaccggtacgtcggtaccgtacgtaccgtcccgtccgtacgtaccgtaccgtacccgaaccgccctaacccgtcgtacg

SEQ ID NO: 35811 - DNA, 682 bp, Homo sapiens
  misc_feature: GYAE6OF01CFEM1.48.36.D03.1.454.CMB.1.raw
  modified_base (237)..(237): a, c, t, g, unknown or other
  misc_feature (237)..(237): n is a, c, g, or t
  modified_base (446)..(446): a, c, t, g, unknown or other
  misc_feature (446)..(446): n is a, c, g, or t
  modified_base (487)..(487): a, c, t, g, unknown or other
  misc_feature (487)..(487): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtcggtccgggtctccgtggacagtcggtcaccatcgcctgctactcggaaccngcagtcgattatggtgtcttaactaactttgtctccgtggtaacccaacactccaacccaggacctaaaccgtcccctaaacggtcgtaatttactttaatagtaatcgtactaacgtaacggaccggtcccgttacgggggtccctggtacgttaccgtctttacctcgtcggccttaccgagttccgtcggactaacgccggtcccncccgtcgaacctactcccgtcgtcgggacctaccgacggtntacgtaacgtagtccacggtactagtagttaacttacgtcgtcgttcgtttattaacttttccgtacgtttttccttttacggttacgtttaccggtaacggttcgggaccgttacgggttaacctcccggttaccggttacggtacctacccgggtaacccgaaccggtacccctaaccccggtacttacccgg

SEQ ID NO: 35812 - DNA, 734 bp, Homo sapiens
  misc_feature: GYAE6OF01CHWXH.48.36.D03.1.454.CMB.1.raw
tcagagtatacatacacgaccggtgctcgatttagctgcgtcacgatctctcgttgggggggtctcaggaggcagcactctcgggacgtctccaccatggcctgggctctgctcctcctcagcctctcactcagggcacaggatcctgggctcagtctgccctgactcagcctcgctcagtcgtccgggtctcctggacagtcggtcaccatccgcctgccactaggaaccagcagtgatattggtgtcttaactaacttttgtacctccgtacggtaaccaactataccaaccccagggaccaaaaccgtaccccgaaaggtacctatttaattttatgtaatgtacaaccgtaaagcccgggcccgtacgggggactcccgtagtacgtccgtcttcctcgtcggcctaccgaaacgtcgtacggaccaaccgacccgggtcccctccccgtacgaacccctagttacccttccgtacggggccttacccgacgggtacttaggaaacgtacgttacgacggtacttaggtaactttaactttaccgtgtccgtttagttactttacgtttttacgttaaccgtttttccgttttttacggttaccgtttaccggtaaacggttccggggtaacccggtacgggttacccgtacccggttcccgttaacgggtccgaaacccggtaccccgtaaaccgggaccccctaaacccccgtacgttcgttaccccg

SEQ ID NO: 35813 - DNA, 558 bp, Homo sapiens
  misc_feature: GYAE6OF01BCZGV.48.36.D03.1.454.CMB.1.raw
  modified_base (229)..(229): a, c, t, g, unknown or other
  misc_feature (229)..(229): n is a, c, g, or t
  modified_base (414)..(414): a, c, t, g, unknown or other
  misc_feature (414)..(414): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgataattggtgcttacaactttgtctcctggtaccaacatcacccaggcaaagtccccaaggtcattatttatgatgtcactaagccggacccgtcgggggtccctgactcgcttctctggctccaagtctggcaacacggcctccctgacccatcctctcgggcctccgaggctgaagntcgaggctgtattattactgtcttgttactatttttcaagttttccctttttgtccgtttacggaacgttcgggaccgtaggtccgtaccgttccgtacggtccacggacccctaacggcccctaacccctctcgtcctacccg

SEQ ID NO: 35814 - DNA, 816 bp, Homo sapiens
  misc_feature: GYAE6OF01CT3VG.48.36.D03.1.454.CMB.1.raw
  modified_base (242)..(242): a, c, t, g, unknown or other
  misc_feature (242)..(242): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatccgtgggctcagtctgccctgactcagcctcgctttttcagtcgtccgggtctccgtggacagtcggtcaccatccgcctgcacgtcggaaccngcagtgtatagttggtgtacttaactaactttgtcctccgtaggtaccaactactccgacccgaggacctaaacgtccccgaaggtcctaatttattatcgatcgtacacgtaacggccggtcccgttccgggggtccctgtacgtcgtcttcgtcgtcggccttaccgaacgttcgtacggacctaaccgtaccggtccctacccgtacgtaccctacgttacccgtcggttacgggtcccttacccgggacgggtaccgttaacgggtaaacgtaccgttaccggtacgggtaccgtttagtttaaacgttttacgtttaaccggttcggttaccgttttacggttttaccttttaacgttttttaacccgttttaacggtttttttcccgtttttttaccggttacccgggttttaacccgggtaacggggtttacccgggggtaaccccgggttaaccgggtttaccccgttaacccggggttttaccccggtaacgggttaccccgaaacccgggttaacccccgtaaaccgggtacccccccgtaaaaccccgttccgttaaccccgg

SEQ ID NO: 35815 - DNA, 771 bp, Homo sapiens
  misc_feature: GYAE6OF01B391P.48.36.D03.1.454.CMB.1.raw
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggactccgtgggctcagtctcgccctgactcacgcctcgctcagtcggtccggtctccgtggacagtcgtcacatcgctgcacgtacgaccagcagtgatagttggtcgtacttactacgtttcgtccttccgtacggtaaccaactactaccgaacccgaggaacctaaaccggtaccccgtaaggttcttaactttagtttacgtagtagttcgtactaacggtaaccggtccgggtccccggttccgggggtacctacggtaccgtccggttacctttccgtacggttccggtaccttaccgtacggttccgtacggaccctaaaccgcccggttacccgtccccgtagtaccccgttacgttccggtcgtaccggtaccttaccgggagtacgtacggtaacgtacgtaccgtaacggtcgttaacgttaacgtttacgttaacgttcggttaccgtttacttaccgtaaacgttgtacccggaaccttaacgtaacctttaaacgttagttaccggttaccgtttaaccgtaaccgggtataaccgggtaaccgtaacccggtaaccggttccctaaccgggttaccgtaacggtacccgaaccccggtaacccggtaaaccccg

SEQ ID NO: 35816 - DNA, 644 bp, Homo sapiens
  misc_feature: GYAE6OF01A4EUG.48.36.D03.1.454.CMB.1.raw
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
tcagagtatacatacacgaccggtgctcgatttagctgcgtcacgatctctacgttggggtggggtctcaggaggcagcactctcgggacgtctccaccatggcctgggctctgctcctccgtcacgcctcctcactcagggcacaggatcctgggctcagtctgccctgactcagccctcgctcagtcgtccggtctcctggacagtcgtcaccgatcgactgcactggaaccagtcaggtgatagttggtncttacatttgtctctagtaccanagtcaccaggacaaacgtcccaaggtactattacttactgtactgtacacgtaacgccgtaccgtcgggtacctgacgtccgtctttacgtcgtgtacctacgtaagtcgtggacctaacgtcgtcctaccgtagtacctactcgtcgtcgggtcctaccgaggtctagtagtactacgacggtactacggtatttactactacgtcttacgttacttacgttttaccttaagttttcctttttacggaccgtttacggtaaccggttagggtaaccccgttcggttacccgtacccggttacggttaccggtaaccgaccgttaaccccggaacggtaccccgtaaccccacggttaccgtaacccg

SEQ ID NO: 35817 - DNA, 642 bp, Homo sapiens
  misc_feature: GYAE6OF01ATUI1.48.36.D03.1.454.CMB.1.raw
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttactaactttgtctcctggtaccaacactccaccaggacaaacgtccccaaggtctatttatttactgtatgtccacgtaacggccggcccgtccggggtccctgactccgtctttctcgtcggtcctaccgaagtcgtaggccaacgaccggtccctccctcgacctactcgtcgtcgggtcctaccgacggtcgtagaacgactcgacggctagtaatttacgttactgtcgttgtttaccttacgtttttaccttaacgttttccgtttttgttaccgtttacggtaaccggttcggggtaaccgtcgggttacctaacccggttccgtaacgggttcccaaccggtacccccgtaaccgggtaaccccctaaccccgtcgttccgtacccg

SEQ ID NO: 35818 - DNA, 745 bp, Homo sapiens
  misc_feature: GYAE6OF01CJCJL.48.36.D03.1.454.CMB.1.raw
  modified_base (251)..(251): a, c, t, g, unknown or other
  misc_feature (251)..(251): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagccctcctcactcgagggcacaggactccgtgggctcagtctcgccctgactcacgcctcgctcacgtcggtccggtctccgtggactacggtccgtccaccactccgcctgccacgtacggaaccngcaagtcgtagttagtggtataccttaacttaacgtttcgtccttaccgtacggtaaccaactacctaccgaaccgacgaccgtaaaccgtacccgtaaaggtaccttaatttacgtttagtacgtacgttacgtaacctaaccgtaaccggtcccgggtcccggttacccggggttaccctacggtaccttccgtaccttccgtcggtacgaccttaccgtacgtcgtaccgtaccgtaaccgcccggtacccctacgtaccgtaccctacgttcccggtcgtaccggtaccgtaccggaggtaccgtagtaacgtctacggaacgtcgttaattaacgttacgttacgtacgttcgttacgttacttttactttacggttttacgttttccgttttacgtaccgttacgggtaaccggttcgggtaaccgtaccggttcctaccggttacgtacggtacaccggtacccgaaaccgccctaacgtccgtacg

SEQ ID NO: 35819 - DNA, 511 bp, Homo sapiens
  misc_feature: GYAE6OF01BRMM7.48.36.D03.1.454.CMB.1.raw
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgacgttggtggttataactatgtctcctggtaccaacagcacccaggcaaagcccccaaagtccatgatttangaggtcagtaagcggccctcaggggtccctgatcgcttctctggctccaagtctggcaacnccgcctccctgacccgtctctgggcctcgaggctgagatgaggtctgattattactgcaagtctcattactgacaggcagcaaactaagtgtaggtagttcgggcggaagggaccaagcgtacgaccgtcctaggtcacccgg

SEQ ID NO: 35820 - DNA, 682 bp, Homo sapiens
  misc_feature: GYAE6OF01DJCN8.48.36.D03.1.454.CMB.1.raw
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (318)..(318): a, c, t, g, unknown or other
  misc_feature (318)..(318): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcggtcaccatcgcctgcactggaaccngcagtgatattggtncttacaactttgtctcctggtaccaacatcacccaggacaaacgtccccaaggtcattatttatgtatntacactaagccggtcccgtcgggggtccctggactcgtaccttctccgtcggtcctcccgtaaaggttccgttacggaccgtaaccgtacccgggtccccttaccccgtcgaaccctagttcccttcgtcgggtacctacccgacgggtccttaggaaacgtacgtccgaacggtccgtagtacttttaagttaaccgttggtaccttgtttacttatttttacgtaacgtttttccgttttttcgtaccgtttcgggtaaaccgttcgggggtaacccgtacgggttacccgtaacccgtttaccggttacggtaccgtacccgaacccgtaaccggacccctaaacccccgtacgttacccg

SEQ ID NO: 35821 - DNA, 634 bp, Homo sapiens
  misc_feature: GYAE6OF01ED23E.48.36.D03.1.454.CMB.1.raw
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
tcagagtatacatacacgaccggtgctcgatttagctgcgtcacgatcgtctcgtttgggggggggtctcaggaggcagcactctcgggacgtctccaccatggcctgggctctgctcctcctcagcctctcactcgagggcacaggactcctagggcctcagtctgccctgactcagcctcgctcgaggtcgtccgggtctccgtggacagtcggtcaccagtccgcctgccacgtggaaccagcagtgatagttggtgcttaacaactttgtcttccgtaggtaccaactactaccacccgaggaccaaaccggttccccgaaggtctagtttagtttagtagtaatcgtacaacgtaacggccggtcccggtcgggggtccctagacgtcgtccttctcgtcgcctacacgtctcgacaccgacggcctccgngaccntcgtcgtggcctacgtggctagacgtntccgngctagtattatacgngtcgttctttnttactttttcctagtttttcctttttggttacgttacggtacgttacgggtaccggttcggtaccgtacccgtttcggtagggtccctaccgggaccccgtaacggcccccaaaccctcgtcgtacccgttaccc

SEQ ID NO: 35822 - DNA, 557 bp, Homo sapiens
  misc_feature: GYAE6OF01AC8PP.48.36.D03.1.454.CMB.1.raw
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (449)..(449): a, c, t, g, unknown or other
  misc_feature (449)..(449): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccggtctccgtggacagtcggtcaccatcgcctgcactggaaccngcagtgatattggtgcttactaactttgtctcctggtaccaacactcaccaggcaaacgtccccgaagtcattatttancgtatgtacactaacgcggcccgtcggggtcctgactcgtcttctctcggtctccaagtctggtcaacgccgtcctcctcgactctctcgtggtctcgagctgacgntcgngctgtattattactgtcttgttacttnttttacttacgtttctttttacgtcttacggaacgttcgggtaccgtagttacccgtccggttaccgtaggtccctacggacccgaaccgcccctaacccgcttaccg

SEQ ID NO: 35823 - DNA, 575 bp, Homo sapiens
  misc_feature: GYAE6OF01C83O5.48.36.D03.1.454.CMB.1.raw
  modified_base (360)..(360): a, c, t, g, unknown or other
  misc_feature (360)..(360): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtcccggtctcctggacagtcggtcaccatccgcctgcactggaaccagcagtgatattggtgtcttaactaactttgtctcctaggtaccaacatcaccaggacaacgtcccaaggtctattactttatgatgtacactaagccggtcccgtcggggtccctgactcgtcttcncgtgctacagtctgcacgccgtcctcctgaccntctcgtggcctcgngtcagaagntcgagtctagtatttaacttacgtcgtgttcgttactttacttttaccgttacggtttttcctttttggttaccgttaccggtacgttcgggtaccgtacggttcctacccggttccgtacggtccgaccgtacccgaaggacccccaacccgtctccg

SEQ ID NO: 35824 - DNA, 757 bp, Homo sapiens
  misc_feature: GYAE6OF01AKLCV.48.36.D03.1.454.CMB.1.raw
tcagagtatacatacacgaccggtgctcgatttagctgcgtcacgatctctcttgggggtggggtctcaggaggcagcactctcgggacgtctccaccatggcctgggctctgctcctcctcagcctcctcactcagggcacaggatccgtgggctcagtctcgccctgactcacgcctcgctcacgtcggtccgggtctccgtggactaggtccggtcaccatccgctgacctactcggaaccagcgagtgtattagttggtcgtaccttaactactttcggtccttccgtacggtaaccaactactacccaaccgacggaaccaaacccggtaccccgtaaggtactaagtttactttagtgtacttacgtaccaacgttaacgggcccggtcccggggttccggggtcctaggtacgtccgtccgtttccgttcgtacggtaccctaccgtaggtcgtaccggtaccaacccggtacccggtcctacccgtacgtacccgtacgttccgtcggttaccggtacctaccggtaacggtacgttaacggaacgtacgtacggtaggttaccgttagttaacttcgttaacgtcgttacgtttagttttacctttaagtttttccgtttaacgtttttcccgttttcggttaccgttacgggtacccggttacgggtaccggtaccgtaccgggttaccctcggttaccgtaccgtacccgtaacccggaccgttaaccccaccttcgtcgtacccg

SEQ ID NO: 35825 - DNA, 689 bp, Homo sapiens
  misc_feature: GYAE6OF01D4E3D.48.36.D03.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (465)..(465): a, c, t, g, unknown or other
  misc_feature (465)..(465): n is a, c, g, or t
  modified_base (674)..(674): a, c, t, g, unknown or other
  misc_feature (674)..(674): n is a, c, g, or t
tcagagtatacatacacgaccggtgctcgatttagctgcgtcacgatctctcgttgggggggggtctcaggaggcagcactctcgggacgtctccaccatggcctgggctctgctcctcctcagcctcctcactcagggcacaggatccgtgggctcagtctgccctgactcagcctcgctcgagtcgtccggtctcgtggacngtcggtcaccatcgcctgccacgtcggaaccngctagtgattagttggtagcttaactactttcgtacctccgtaggtaaccaactactccaccgaggaccaaaccgtccccgtaaggtctatttaagttatgtatctacacgtacgccggtacccggtcggggtcctgctcgtcttctcgtcgtcctacgtaacgtcgtcggacctaaccgtcccgggtacccttcccgtacgacctcttacgtccgtcggccttaccgnggtccgtaacgagtacgtacgtaggtcctttaggtaacttttaccgtaacgttcgttaccgtttcggtttaaccttttacgtttttaaccgtttacgttttttcccgttttcggttacgttaccgggtaaccggtcgggtaaacccggttcgttaccccgtacgttaccgtaggtcctaaccgggaccccgtacggtaccccaacccgnttcccgtcttacccg

SEQ ID NO: 35826 - DNA, 673 bp, Homo sapiens
  misc_feature: GYAE6OF01ESXXO.48.36.D03.1.454.CMB.1.raw
  modified_base (232)..(232): a, c, t, g, unknown or other
  misc_feature (232)..(232): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatccgtgggctcagtctgccctgactcagcctcgctcagtcgtccgggtctccgtggacagtcgtcaccatcgcctgcacgtggaaccngcagtgatattggtgacttactaactttgtcctctacggtaccaactactccacccgaggaccaaacgtacccgtaaggtctatttattagtagatgtacacgtaacggccggtacccgtccggggtcctgtactcgtcttcgtcgtcggtcctacgtacgtccgtacggaccgaaaccgacccgggtcccttacccgtacgaccctacttccgtccgtcgggtacctaccgaggtcctagaacgtacgtcgacgtcgtagttactttacgtacgtcgtcgttacgttacttacgttttacgtttacgtttttccgttttacgttaccgttacggtaacgttccggggtaaccgtacgggttcccgtacccggttacgtaccggtacctacccggaacccgtaacccgtacccctaaaccccgtcgtccgtaccgtacccg

SEQ ID NO: 35827 - DNA, 713 bp, Homo sapiens
  misc_feature: GYAE6OF01BBGF9.48.36.D03.1.454.CMB.1.raw
  modified_base (708)..(708): a, c, t, g, unknown or other
  misc_feature (708)..(708): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcggtcaccatccgcctgcacgtggaaccagcgtagtgattagttggtcgtcttaacgtaactttcgtccttaccgtacggtaaccctaaacgtactaccgaaccccgagggtaccaaaaccggtcccccgtaaagggtacctaagttttaactttaacgtaggtaacttcgtacgtaacgtaaacggcccggggtacccgtccggggggttcccctaggtaccgttccgtctttccgtccgtcggtccctacgtaacgttccgtcgtaccgaaccgtccggtcccctacccgtcgaccctcgttacccgttcggtacgggtcccttaccggacggtcctaaggaacgtactcggacgtccttagtacgtttactacgtcgtccgttcgtttacttaacttttcgtaacgtttttccgttttgtccgttacggtaacggtccggtaccgtacggtcctaccgttcgtacggtactaccggaccctaaccggcccctaaccgtntcccg

SEQ ID NO: 35828 - DNA, 651 bp, Homo sapiens
  misc_feature: GYAE6OF01CZ2GB.48.36.D03.1.454.CMB.1.raw
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatagttggtgcttactaactttgtctcctgtaccaacatccaccaggacaaacgtcccgaagtcatttatttatgatgtacaactaacggccggtccgtccggggtcctgatcgtcttctcgtcgctacagtcnggcaacnccggcctccgtcgacctactcctcgtcgggcctaccgacggtacagtaacgtacgttcgaggtctagttaacttacgtttactcggttacctttgtttaccgttaactttttaccgttaacgttttttcccgttttttacgttccggtttaaccgggtaccgttacgggggtacccgtaacgttaccgtacccggttaaccccgttacggttaccggttacccaaccggtaccccgtaaacggaccccccgtaaaccctccgttcggttaacccc

SEQ ID NO: 35829 - DNA, 750 bp, Homo sapiens
  misc_feature: GYAE6OF01CECWN.48.36.D03.1.454.CMB.1.raw
  modified_base (233)..(233): a, c, t, g, unknown or other
  misc_feature (233)..(233): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcgtcaccatcgcctgcacgtcggaaccngcagtgatagttggtgtacttaactaactttgtctccgtaggtaaccaatactccacccaggaccaaacgtccccaaggtctatttattatgtatcgtcaactaacggccggtcccgtcggggtcctgactcgtcttcgtactcggtctaccgaagttctacggaccaacgacccggtccctcccgtacgaacctacgttccgttcgtacgggtcctccggacggtcgtacggaaacgtacgtaccggtaaggtccttaaggttaactttacgtttaaccgtcgttaccgtttagtttaccttttaacgtttttacctttaaccggttttttcccgtttttttacgttacccgggttttaaaccggtaaaccgggttaccgggggttaaccccggtttaagggttacccccggtttaacccgggtttaccccggtttacggggttaaccccttaacccggggacccccgttaaaccgggtaacccccccttaaaccccccggttcgtttaaccccgg

SEQ ID NO: 35830 - DNA, 697 bp, Homo sapiens
  misc_feature: GYAE6OF01BM3JZ.48.36.D03.1.454.CMB.1.raw
  modified_base (237)..(237): a, c, t, g, unknown or other
  misc_feature (237)..(237): n is a, c, g, or t
  modified_base (324)..(324): a, c, t, g, unknown or other
  misc_feature (324)..(324): n is a, c, g, or t
  modified_base (477)..(477): a, c, t, g, unknown or other
  misc_feature (477)..(477): n is a, c, g, or t
tcagagtatacatacacgaccggtgctcgatttagctgcgtcacgatctctcgttgggggggtctcaggaggcagcactctcgggacgtctccaccatggcctgggctctgctcctcctcagccctcctcactcagggcacaggatccgtgggctcagtctgccctgactcagcctcgctcagtcgtccggtctcctaggacagtcggtcacctagtccgcctgccacgtggaaccngcagtgattagttggtgtacttataactttgtcctctacgtaccaacataccaccaggacaaacgtcccaaggtctaatttatttangtattacgtacaacgtaacggccggtcccggttcgggggtccctagtacgtccgtcttccgttcgtcgtcctaccgtagtcctggaccctaaacggtaccgtccctcctacgaccctatccgttcgtacggccttaccgaggtacagaacgtntaccgtaggtactacggttaatttaaccgttacgtcggtttaccttcggtttaccttaatttttaacccgttacgttttttccttttacggtaccggtttacgtaaccggttccgggtacccgttacgggttaccctaaccggtttcccggagttaccccggaacccgtacccgtaaacccggtacccccttaaaccgacctttccggtacccttacccg

SEQ ID NO: 35831 - DNA, 767 bp, Homo sapiens
  misc_feature: GYAE6OF01BJYLP.48.36.D03.1.454.CMB.1.raw
  modified_base (238)..(238): a, c, t, g, unknown or other
  misc_feature (238)..(238): n is a, c, g, or t
tcagagtatacatacacgaccggtgctcgatttagctgcgtcacgagtctctcgttggggggggcctcaggaggcagcactctcgggacgtctccaccatggcctgggctctgcctcctcctcagcctctcactcagggcacaggatcctggctcagtctgccctgactcagcctcgctcagtcgtccggtctccgtggacagtcggtacacctagtccgcctgctacgtcggaaccngcagtgatattggtgtacttactaactttgtacctccgtcggtaaccaactatccaacccaggacctaaacgtcccgaaggtcctatttattatgtatcgtacacgtaacgccggcccgtcggggtcctgactccgtacttcgtcgtggtacctaccgtaacgttccgtaggaccctaaccgaccggtaccctcccgtacgtaccctacgttccgttccggtcgggtacctacccggaaggtccgtacgtaaacggtacgtccgaacggtaccttagttaactttaacgttacgttcgttaccgtttacggtttaccgttaacgtttttaccgtttaaacgttttttcccgtttttacggttacccggtttaccgggtaaaccggtttaccggggtaaacccggttacgggttacccgttaacccccgggtttacggttaaccgggttaccccgtaacccgggtacccccgtaaacccggtacccccgttaaaacccccgtcgttacccggtaccccgtttaaaccccg

SEQ ID NO: 35832 - DNA, 628 bp, Homo sapiens
  misc_feature: GYAE6OF01DDC2U.48.36.D03.1.454.CMB.1.raw
  modified_base (246)..(246): a, c, t, g, unknown or other
  misc_feature (246)..(246): n is a, c, g, or t
  modified_base (482)..(482): a, c, t, g, unknown or other
  misc_feature (482)..(482): n is a, c, g, or t
  modified_base (617)..(617): a, c, t, g, unknown or other
  misc_feature (617)..(617): n is a, c, g, or t
tcagagtatacatacacgaccggtgctcgatttagctgcgtcacgatctctcgttgggggggggtctcaggaggcagcactctcgggacgtctccaccatggcctgggctctgcctcctcctcacgcctctcactcagggcacaggactccgtgggctcagtctcgcctgactcagcctcgctcgacggtcgtccgggtctccgtggacagtccgtacacctactcgctcggccacgtacgaaccngctagtgtattgtggtctacttactacttcgtccgtaccgtactaaccactccaccgacgaccgtaacgtacccgtagtactatttattacgtctagtacgtacgtacgtaacggtcgggtacccggttccgggtccgtacttcgtcccgttcgttcctcgtcgtcgtactaacggtcgtcgaccgaccgtacctaccgtccggactaccgtcttaccgtcggtacgtcggtaccncgtacgtacacgggtctacggtgtacgtataacgttctacgcggttctagttcgttctttagttcttttcgttagtcgtacgtacgtcgtaccggtactcggtactcgtacgctacgcccgtaccgtacactacnctcgtcttccg

SEQ ID NO: 35833 - DNA, 658 bp, Homo sapiens
  misc_feature: GYAE6OF01CG20F.48.36.D03.1.454.CMB.1.raw
tcagagtatacatacacgaccggtgctcgatttagctgcgtcacgatctctcgttggggggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcggtcacatcgcctgcacgtggaaccagcagtgattattggtgacttactaactttgtcctccgtaggtaccaactatccacccgaggacaaacgtccccgaaggtcctatttatttatgatgtacactaagccggtccgtcggggtcctgactcgcttctcgtcggctaccagtcgtacggaccaaccgaccggtccctcccgtacgacctactccgtccggtcgggtcctaccgtaggtactaggaagtacttcgaacggtcttagtatttacttacgtcgttacttggtttaccttagtttttaccgttaacgtttttcccgttttttagtaccgtttaccgggtaacgttccggggtaaccgtacggttcccgttaccggttccgtacggtaccaacccggtaccccgtaacggtacccccaaaccccgttcgttccgtacccgttacccg

SEQ ID NO: 35834 - DNA, 726 bp, Homo sapiens
  misc_feature: GYAE6OF01D3KNH.48.36.D03.1.454.CMB.1.raw
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatccgtgggctcagtctcgccctgactcacgcctcgcctcagtcggtcccgggtctccgtggactaggtccggtccaccatccgccgtcgcacgtaggaaccagcgagtgattagttggtcgtaccttaacgtaacttttcgtccttccgtacggtaacctaactactaccaacccgaggaccaaaccgtccccgtaaaggtctaatttatttatagtacgtacgtacgtaacgtaacggccggtcccggtccgggggtcctgtacgtcgtcttccgtcgttcgtacctaccgaaggttcgtacggacctaaccgaccgtccctcccgtagacctacgttcgtcggtcgggtccctaccgacgggtctacggtaagacgtccggtaaggtccgttagttaactttacgttaccgtacgttcgttcgtttacgttatttttaccgttacgttttttcgttttacgttaccggttacgggtacgttaccgggggtacccgttaaggttccctacccggttaccgttacggtacccgaaccggtaccccgaaacggtaccccctaaaccccgttgtaacccgg

SEQ ID NO: 35835 - DNA, 781 bp, Homo sapiens
  misc_feature: GYAE6OF01EGY62.48.36.D03.1.454.CMB.1.raw
  modified_base (234)..(234): a, c, t, g, unknown or other
  misc_feature (234)..(234): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcaatcagggcacaggatcctgggctcagtctgccctgactcagcctcgctcagtcgtccgggtctcctggacagtcggtcaccatcgcctgcacgtggaaccngcagtgtatattggtgtacttactaactttcgtctccgtacggtaccaactactaccaccgaggacaaacgtccccgaaggtctaatttatttatagtatcgtacaacgtaacgccggtacccgttcgggggtccctgtactcgtccttcgtcgtcggtacctaccgtaagttcgtacggaccaaccgtaccggtccccttaccctacggtaaccctacttcccgttaccggtcgggtacccttacccggtacgggtaccttaacgggaaacgtacgtaccggtaacgggttaccgtttagggttaacttttaacgtttaaccgttcggttaccgtttacggttttacccttttaacgtttttaaccgttttaaccggttttttccgttttttttccggttacccgttttaaccgggtaaaccggtttcccggggtaaccggttaccgggttaccccgttacccgggttacccggttaaaccggtacccgtaacccggtaaccccgtaaacccgggtaccccctaaacccccgttcgttaaccccgg

SEQ ID NO: 35836 - DNA, 665 bp, Homo sapiens
  misc_feature: GYAE6OF01D14IG.48.36.D03.1.454.CMB.1.raw
  modified_base (249)..(249): a, c, t, g, unknown or other
  misc_feature (249)..(249): n is a, c, g, or t
tcagagtatacatacacgaccggtgctcgatttagctgcgtcacgatctctcgttgggggggggtctcaggaggcagcactctcgggacgtctccaccatggcctgggctctgctcctcctcagcctcctcactcgagggcacaggactccgtgggctcgagtctcgcctgactcacgcctcgctcgagtcggtccggtctccgtggacacggtcgtacaccgtatccgcctgacaccgtacggaaccngctagtagagttagttggtcgtacttactacgtttcgtccttaccgtacgtaaccaactactccgaaccgaggaccaaaccgtacccgaagttactaatttattagagtactcgtactaacgtacggccgggtcccggtccggggtcctagtaccgttcgtccttacgtcgtcgtcctacgtagtcgtacgaccgtaccgtccgtccctccgcgtacctcgtcgtcgtacggtccaccgaggtacaacgagtcgtacgtagtcttagttaacttctacgttgtctttacgttactttacgttttacttacgtttttcgtttcgacgttaccggtacggtaccggtacgtcggtccgtaccgtcgtaacgtcccgaacggtaccccgaacgtaccccaaccgttcgtctccgttccg

SEQ ID NO: 35837 - DNA, 751 bp, Homo sapiens
  misc_feature: GYAE6OF01CRRG1.48.36.D03.1.454.CMB.1.raw
  modified_base (150)..(150): a, c, t, g, unknown or other
  misc_feature (150)..(150): n is a, c, g, or t
  modified_base (247)..(247): a, c, t, g, unknown or other
  misc_feature (247)..(247): n is a, c, g, or t
  modified_base (748)..(748): a, c, t, g, unknown or other
  misc_feature (748)..(748): n is a, c, g, or t
tcagagtatacatacacgaccggtgctcgatttagctgcgtcacgatctctcgttggggggggtctcaggaggcagcactctcgggacgtctccaccatggcctgggctctgctcctcctcagcctcctcactcagggcacaggatccgngggctcagtctgccctgacctcacgcctcgcctcgagtcgtccgggtctccgtggactcggtccggtcaccgtatccgcctgccgacgtcggaaccngacagtgatagttggtagtctaagtactttcgtactccgtagtaaccaacgtctaccgtaacccgagaacctaaaaccggtacccgtaaaggtaccttaagttttaaacgtttagtacggtacgttacgtaaccgtaaccggtaaccgggtacccgggtcccgggttccgggggtacccttaacggtacgttacccgttccgttccgtaccggtcggtacccttaccggtaaacgttccgggtaaccggtaacctaacccgggacccgggtttccccttaacccgggtcgttaaccccgttaccggttacccggtccgggttaccccgtaccggtagggtaccggtagggtaaacgggttggacggtacgtacgttagttaacttacgtacgttcggaacctagtacctaagtacttacggagtaccggagtactacgactaggtaagtcgtaggtaccgtgggacgtaacggactgtacggtccgaacggtctcggaccncgg

SEQ ID NO: 35838 - DNA, 690 bp, Homo sapiens
  misc_feature: GYAE6OF01EE1J3.48.36.D03.1.454.CMB.1.raw
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatccgtgggctcagtctgccctgactcagcctcgctcagtgtccgggtctcctggactagtcggtcaccatcgcctgcactggaaccagcagtnatagtggtacncttactacttcgtctctacgtaccaactactcctaccacggtacaaaccgtcccgaaggtcctaatttactttatgtactgtaccactaacggccggtacccggtcggggtccctgacttccgtacttcgtcgtcggtacctccgtaacgtctacggacaaccgtcgtccctcccgcgtacctacgtctccggtacggtcgtaccgacggtctaggaacgttacgtcgtacgggtacttggttaactttacgttaccgtagttccttacggttttaccttacgtttttaaccgtttaaccgtttttcccggttttttcggttaaccggttttaccggggttaaaccgttccggggtacggttaaccggtccggttaacccgtacggtttacccggtacgtaccgtaccccgtaacggtacccgtaccccgtaccgtacg

SEQ ID NO: 35839 - DNA, 652 bp, Homo sapiens
  misc_feature: GYAE6OF01A1TL3.48.36.D03.1.454.CMB.1.raw
  modified_base (487)..(487): a, c, t, g, unknown or other
  misc_feature (487)..(487): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcgagggcacaggatccgtgggctcagtctcgccctgactcacgcctcgctcagtcgtccgggtctccgtggacagtcggtcaccatccgcctgccacgtaggaaccagcgtagtcgattagttggtcgtacttaactaactttcgtccttaccgtacggtaacctaacgtactcccaacccgaggacctaaaccgtccccgaaggttcctaatttacttactgtacttcgtactacgtaacggtccggtcccggtcggggtccctggtactccgtcttctcgtcgtacctacgtacgtcgtcgacctaaccgccggtccctccgtacgacctcgtcgtcgtcggtcctccgngtctagacgtctcgagtctagttacttacttcgtcgttcgttacgtttactttactttacgttaaccgttttccgttttagtccgttaccggtacgttcgggtaccgtacgggttcctcccgtcgtacgtccgtacgtacccgaaccgtccctaccgtcgtcccg

SEQ ID NO: 35840 - DNA, 635 bp, Homo sapiens
  misc_feature: GYAE6OF01BLJAU.48.36.D03.1.454.CMB.1.raw
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacaggtccggtcaccatccgcctgcacgtggaaccngcagtnatatggtntcttactacttgtctccgtgtaccaactactcaccaggaccaaacgtccccgaaggtctaatttattatgtacttgtactacgtaacggcccggtcccggtccgggggtcctgtactccggtcttacctcgtcggtccttccgtaagtcgtcggactaaccggtaccggtccctacccgtcgacctactccgtcgtacgggcctccgaggtctacgaacgtctcgagcttacgttatttacgttacgtggtccttggttacttacgttttacgttaacgtttttccgttttagtccgttacggtaacgtcgggtaccgtcggtcctacccgttcgtacggtctaccgacccgtaaccggtacccctaaccgcttccgcttaacccg

SEQ ID NO: 35841 - DNA, 627 bp, Homo sapiens
  misc_feature: GYAE6OF01E4422.48.36.D03.1.454.CMB.1.raw
  modified_base (392)..(392): a, c, t, g, unknown or other
  misc_feature (392)..(392): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacactttgtctcctgtaccaacactcaccagcaaacgtccccaaggtctattattatgatgtacactaacggcggtcccgtccggggtccctgactcgcttctctgcctacaagtctggcaacgaccggcctccctcgaccnctctcgtcggctaccgagtctagaacgactcgagctgaatttcttaacgtcgtcttacgtttacttacttttaccgttaacgtttttccgtttttacgtaccgtttacggaaccggttacggggtaaccccggttagggttaccccgtaacccgggtttcccgtttaacgggttaccccgtaccggtacccccgtaaacccgggtacccccctaaaacccccgtcgtttacccgg

SEQ ID NO: 35842 - DNA, 609 bp, Homo sapiens
  misc_feature: GYAE6OF01EV6ZL.48.36.D03.1.454.CMB.1.raw
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
tcagagtatacatacacgaccggtgctcgatttagctgcgtcacgatctctcttggggggggtctcagggaggcagcactctcgggacgtctccaccatggcctgggctctgctcctcctcagcctcctcactcagggcacaggactcctgggctcagtctgccctgactcagcctcgctcgagtgtccgggtctcctggacagtcgtcaccntcgcctgcactggaaccngcagtgatattggtgcttacacttgtctctgaccacatcaccagacaacgtcccaaggtctattattatnatgtcactaacgccggtcccgtcgggggtccctgactcgtcttctcgtcggctaccgtaacgtctacggctaaccaccggtcccttccctcgtaaccgtctccgttacggtcgggcctacccgtaagggcccgttaaggaacgtactacgacggtcttaggtactttacgttacgtgttacttgtttaacgttacttttaccgttaacgtttttccttttacgttctttaacggtaacgttcgggaccgtcggtcctacgtccgttacgcacgtacccgaacggacccctaaccctctcgtctacccg

SEQ ID NO: 35843 - DNA, 824 bp, Homo sapiens
  misc_feature: GYAE6OF01BM1JF.48.36.D03.1.454.CMB.1.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagagtatacatacacgaccggtgctcgatttagctgcgtcacgatctctcttgggggctgggggtctcaggaggcagcactctcgggacgtctccaccatggcctgggctctgctcctcctcagcctcctcactcagggcacgaggactccgtgggctcagtctgccctgactcacgcctcgctcagtcgtccggtctcgtggacngtcgcacagtcgcctgcacgtacgaaccngcgtagtagtactagttggtctacttactacgtttcgtcctccgtacgtaccatactcaccgtagaccaaccgtacccgaagttactattacttagtacgtagttacgtacgtaaccggtaacggtccggggtacccggttacccgggggttacctacgggtaccttccggttccctttaccgttccggtacggtacccgttaccggtaaaccggttcccgtacgggtacccgtaaacccggtcccggttaccccgttacccgtaccgtaccgttacgtttccggtacccggttccggggtccctaccggttacggtaccgttaaacggtacggtactaccgggtacggttacccgttaaggtttacttaacgtttaccgtaccgtttccggttttattttaccgttttaaagtttttcccgtttaaccggtttttttctttaccgggtttacccggtttaaacggggtaccccgttaggggtacccgggttaacccgggttcccgttacccgggtttaccgtaacgggtacccctaaccgggtacccccgaacccggtacccctaaaccccgttcccggttacccg

SEQ ID NO: 35844 - DNA, 654 bp, Homo sapiens
  misc_feature: GYAE6OF01BMQNV.48.36.D03.1.454.CMB.1.raw
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcggtcaccatccgcctgcactggaaccagcagtgatagttggtgtcttactaactttgtcctcctggtaccaacactccaccaggacaaacgtccccaaggtctatttattactgatgtacaactaaggccggccggtcggggtccctgactcgtctttcctcgtcggtcctaccgtaagtcgtcggaccaaccgaccggtccctcccgtcgacctagtccgtcgtcggtcctaccgacggtctaggaacgtacgtcgacggtctagtaactttacttaccgtagtccttacgtttacttaactttttacgtaacgtttttccgtttttacgtccgtttaccgggtaaacgttcgggtaacccgtcggtacccttacccggttcccgttaacgggtacccgaacccgtaccccggtaaaccgtaccccaaaccccgttcgttccgtacccg

SEQ ID NO: 35845 - DNA, 728 bp, Homo sapiens
  misc_feature: GYAE6OF01E0TEP.48.36.D03.1.454.CMB.1.raw
tcagagtatacatacacgaccggtgctcgatttagctgcgtcacgatctctcttgggggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggacagtcggtcaccatcgcctgcactggaaccagcagtgatagttggtcgtacttactaactttgtcctccgtcggtaaccaacactccacccgaggaccaaacgtccccgaaggtctaatttattatgtatcgtactacgtaacgccggtcccgtcgggggtacctgtactcgtccttctcgtcggtcctacgtaacgtcgtacggaccaaccgtaccggtcccttcccgtacgtacctacgtccgttcggtaccgggtcctaccggacggtacctacgggaaacgtctacggacggtcttagtaactttacgttacgtcgtacttcgtttacttaactttttacgttaacgtttttccgttttttacggtaccgtttaccgggtaacggtttaccggggtaacccgttacggggttccctaaccccgggtttacccgttaacgggtacccgtaacccggtaacccccggtaaacccgggtacccctaaaaccccccgttacgtttacccggtccccgttaaaccccgg

SEQ ID NO: 35846 - DNA, 752 bp, Homo sapiens
  misc_feature: GYAE6OF01ECE53.48.36.D03.1.454.CMB.1.raw
tcagagtatacatacacgaccggtgctcgatttagctgcgtcacgatctctcttgggggggggtctcaggaggcagcactctcggggacgtctccaccatggcctgggctctgcctcctcctcagcctcctcactcagggcacaggatcctgggctcacgtctcgccctgactcacgccctcgctcaggtcgtccggggtctccgtggactaggtcggtaccacctatccgcctgcctacgtacggaaccagactagtgtacttagttgggtacgtaccttaactaacgttttcgtccttccgtacgtaaccaactactaccacccgacggaccaaccggtccccgtaaggtacttatttaatttagtacgtattcgtactaacgtacggtccggtcccggttccggggtcctagtactccgtcgttctcgtcgtacctacgtacgtctcggacaccgtccggtccctaccgtacgtacctcttcgtcggtcggtcctacgtacgggtaccgtacgtaacgtacgtacggtacggtcctagttaactttacgttaccgtgttcctttacgtttaccttttacgttttttaccgttaccgtttttttccgttttacggtttccgttaaccgggtaccggttaccggggtacccgttacgggttaccccgttacccggtttacggtaccgggtccaaccccgggtacccgtaaacccggacccctaaccccgttacgttccgtacccgtacccg

SEQ ID NO: 35847 - DNA, 835 bp, Homo sapiens
  misc_feature: GYAE6OF01B8KP4.48.36.D03.1.454.CMB.1.raw
  modified_base (634)..(634): a, c, t, g, unknown or other
  misc_feature (634)..(634): n is a, c, g, or t
  modified_base (654)..(654): a, c, t, g, unknown or other
  misc_feature (654)..(654): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatccgtgggctcagtctgccctgactcgacgcctcgctcaggttcggtccggggtctccgtgggactaggtcggtacaaccattccgcctggacctacgtcggaaccagctagttagaattagttgggtagtacctttaacgttaaacgttttcgttccttaccgttacggtaaaccaactactacccgtaacccgaacggaaccaaaacccggttacccccgaaagggtttacctaagtttttaatttaacgtacgggttaacgttcgttaaccgtaaacggttaaaccgggcccgggttaaccccggttccggggggttaacccttcggtaacgttcccgttcctttccgtacgtccggttacccgtaccgtaacggttccgtacggtaacccgtaaaccggtacccgggttacccctaccgttaccgaccctacgtttccgtaccgttcgggcctacggtcgtaccgtagaacgtacgtcggtacgtnttacgttagtttaaccgttntcggtttacttacgtttaccttttagtttaccgtttacgtttttcccgttttagttcccggttaacggtaccggtaaccggggttaccgttacggtacccgttaccgttaccggttacggtaccctaacccggacccgtaaaccggtcccccttaacccgtactccggtacccgttacccg

SEQ ID NO: 35848 - DNA, 764 bp, Homo sapiens
  misc_feature: GYAE6OF01E2C20.48.36.D03.1.454.CMB.1.raw
tcagagtatacatacacgaccggtgctcgatttagctgcgtcacgatctctcgttggggggctgggggtctcaggaggcagcactcgtcgggacgtctccacatggcctgggctctgcctcctcctcacgtccctcctcacgtcgagggcaacgaggtactccgtgggctacgacgttcctcgccctgacctcgacgtcctcgtctacgtacggttcggtccgggtctccgtaggacgtacggtccggtaccaccgtagttccgccgtgaccgtacggtacggaaacctagtacgtaggtgtaacgttaggttcgggtacttaaccttaaccgttaacgttttccggtaccttaccggtaaccggtaacccaactaccgtaccgaaccggtacggtaacccgtaaaaccggtacccgtaaggttacttaagttttaacttagtacggtacttacgtaccgaaccggtacgggtcccggggtacccggttaccggggtcctagtaccgttccgttacttcgtccggtacgtacctacggtaacgtcgtacggacctaacgccggtccctcgtacgacctcggttctccggtacgcctacggagtcgacgtacgcgttacgacgttctattacgtacttgtcgtcgtttcttaccgtttagtttaccgtttcgttttcgttacggttcgtaaccggtacggtacggtccgtaggttccctaacggttccgacgtccgtaccgaccgaacccgccctacgtcgtacc

SEQ ID NO: 35849 - DNA, 830 bp, Homo sapiens
  misc_feature: GYAE6OF01BI1LZ.48.36.D03.1.454.CMB.1.raw
  modified_base (774)..(774): a, c, t, g, unknown or other
  misc_feature (774)..(774): n is a, c, g, or t
tcagagtatacatacacgaccggtgctcgatttagctgcgtcacgatctctcttgggggctggggtctcaggaggcagcactctcgggacgtctccacatggcctgggctctgctcctctcagcctcctcactcagggcacgaggatccgtgggctcagtctcgccctagacctcacgtcctcgactcgtacgtcgtccgggtcctccgtggactacggttcggtccaccacgttcgcctcggactacgtacgggaaccgaggtactaacggtgtaagttacgtttacgggttaccgtacgtttaacccgttaacgtttttacggtccctttacccggtaacggttaacccctaaacttaccgttacccggaaccccgtacggtaacccgtaaaaccggttacccccgtaaagggtttaccttaacggttttactttaacgtcgtaacttaccggtaaccgaacgttaaaccgggtcccgggtaaccccgggttaccgggggttccctacgggttaccgtccggtttaactttcccgttacgtaccgggtcccgttaaccgtacggttaccgtacgggttaaccaaccggtcccgttcccgtacccgtacgaacccgttacttacccgtcggtcccgggtactaccggtaaggtcgttagaaacgtcgccgtaagtccgtattaactcgttactcgtacttcgtttacgttactttaccgtcgttttacgtttccgtacgggttccggtacgtccgggtaacttcccggttacncccggtttacgtacctaacggtacccgacccggtaacccgacccctgttcctaccg

SEQ ID NO: 35850 - DNA, 1030 bp, Homo sapiens
  misc_feature: GYAE6OF01C8QV4.48.36.D03.1.454.CMB.1.raw
tcagagtatacatacacgaccggtgctcgatttagctgcgtcacgatctctcgttggggggggtctcaggaggcagcactctcgggacgtctccaccatggcctgggctctgctcctcctcagcctctcactcagggcacaggatccgtgggctcagtctgccctgactcacgcctcgctcaggtcgtccgggtctcccgtaggactaggtcggtcaacccgtatccggccctgaccaccgtagggaaacccaggctaggtgaattaacgttggtagtacctttaactaaaccgttttcgtaccttacccgttacggttaaaccccaaaccacgttaccgaaaccccgaaaggggtaaccctaaaaaaccggttacccccccgtaaaagggttcccgtaaaactttttaactttttaagttaccggtaaagtttacggttaaaccgtaaccgttaaaacgggccccggggttaccccggttacccggggggggttaccccctttagggtaaacgttacccggttacccgttttacccgtcgttaccggggtaccctttaacccggtaaaacggtttcccggtacgggttaaccccgaaaaacccggttccccgggaccccttaaccccgtacggtaacccttaaaccgttcccgttaacggtcccggggttaacctaccggaaaccgggtccgtaacgggtaaacgtaacgttaccgtaacgggttaccgtttaagtaacgtttttaacgttaaccgttacggttacccgtttaacggtttttaccttaacgttttttaaccgttttaaaccgtttttttcccggttttttacgtttaccgggtttaaacccgggttaaaccgggtacggggggttaaaccccggttaaccgggtttacccggtaaaccccgggttttaccccggttaaacggggttaccccgtaaacccgggtaaacccccggtaaacccgggttaaaacccccctaaccccggtttaaaccttccccgtttaacccggtaaacccccg

SEQ ID NO: 35851 - DNA, 686 bp, Homo sapiens
  misc_feature: GYAE6OF01CVOW5.48.36.D03.1.454.CMB.1.raw
  modified_base (236)..(236): a, c, t, g, unknown or other
  misc_feature (236)..(236): n is a, c, g, or t
tcagagtatacatacacgaccggtgctcgatttagctgcgtcacgatctctcttggggctggggtctcaggaggcagcactctcgggacgtctccaccatggcctgggctctgctcctcctcagcctcctcactcagggcacaggatcctgggctcagtctgccctgactcagcctcgctcagtcgtcccggtctcctggacagtccggtcaccatccgcctgccacgtggaaccngcagtgtatagttggtgtcttaactaacgtttgtcctccgtacggtaccaactactccacccaggtccaaacgtccccgaaggtctatttacttatcgtatcgtactacgtaacgccggtcccgttaccgggggtccctaggtacttccgtactttcgtccgtcggtccttaccgtaacggttccgtacggaccctaaccggtacccgtccccttacccgtacgaaccctacgttcccgttaccggtacggtaccctccgacggtcgttacgaacgtactccgtacggtccttagttaactttacgttaccgtcggttacttacgtttaccttacgtttttacgttacgtttttcctttttcgtaccgtttaccggtacgtcgggtaccgtacggttcctacccgttcgtacgtcctaccggtacccacggacccctacccgtgtacccg

SEQ ID NO: 35852 - DNA, 786 bp, Homo sapiens
  misc_feature: GYAE6OF01ARU4V.48.36.D03.1.454.CMB.1.raw
  modified_base (270)..(270): a, c, t, g, unknown or other
  misc_feature (270)..(270): n is a, c, g, or t
tcagagtatacatacacgaccggtgctcgatttagctgcgtcacgatctctcgttgggggggtctcaggaggcagcactcgtcgggacgtcctccaccatcggccgtgggctctcgcctcctcctcgcgccctcctcactcgacggcacgaggactccgtcggcctacgtacgtctccgccctagactcgacgccgtcgctcgcgtcggtccggtctccgtggactcgtcggtaccacctactccgccgtcgaccgtacgtacgaaccgngacgtagtgtacgttagttcggtacgtaccgttactacgtttcgtctaccgtacgtaccacgtccaccgtaccgacgaacctaaccgtacccgaagtactagttatatgtaacgtatacgtaaccgtacggtccggtcccggttcggtcctagtccgttctcggtacctcggtcgtaaccacgtagtcgtacgacccgtacgaccggtccctaccgtaccgtaccgtacgtcgtcgtccggtaccgtaccgtacgtacgtagtaccccccccccccccccccccgtagtaccgtacgtacgtacgttacgttacgttacgttcgttacgttcgtttacgtttacgtttaccgttttaccgttttaccgttttaccggttaccggttaccggttaaccggttaccggtaaccggttaccggttacccggttacccggttaaccgtaccggtacccgtaacccgtaacccggtaacccgtaacccgtaacccgtaccgttaccgttacccgttacccg

SEQ ID NO: 35853 - DNA, 762 bp, Homo sapiens
  misc_feature: GYAE6OF01CQD4W.48.36.D03.1.454.CMB.1.raw
  modified_base (252)..(252): a, c, t, g, unknown or other
  misc_feature (252)..(252): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcgaggcacgaggactccgtgggctcagtctcgccctgactcacgcctcgcctcgaggtcggtccgggtcctccgtaggacacggtcggtccacctagtccggcctgccacgtacggaacngcgaggtcgtattacgttggtacgtacttaactaactttcgtaccttaccgttacggtaacccaactactaccaccggacggtaaccgtaaaccgtacccggtaaaggttactaagttttaacttagtacgtattaccgactaacgtacgggtacccgggtacccggttccggggtcctaggaccttcggtacttccgtcgtcgacctacgtacgttcgtacggaccaccgtccgtaccctacccgtagaaccctacgttcgccgggtcggaccgttacgaacggtcgttaagacggtacctacggtacggtaccttaggttaactttaccggttacgtttgtaccgtttttacggttaactttacgtttttaccgtttaaccgttttttcggttttcgtacccgggtacgggttaaccggtaccgggttacccggttacgtccggttaccgttcgggtaacgaccgtaccggtaacccgacgtaaccccacctacgtctacccgttccg

SEQ ID NO: 35854 - DNA, 786 bp, Homo sapiens
  misc_feature: GYAE6OF01CFLJ2.48.36.D03.1.454.CMB.1.raw
  modified_base (186)..(186): a, c, t, g, unknown or other
  misc_feature (186)..(186): n is a, c, g, or t
tcagagtatacatacacgaccggtgctcgatttagctgcgtcacgatctctcgttggggggggtctcaggaggcagcactctcgggacgtctccaccatggcctgggctctgctcctcctcacgcctcctcactcgagggcacgaggatccgtgggctcagtctgccctgactcagccgtcgctanacggttcgtccggtctccgtggactacggtccggtacacctacgtccgcctgacctacgtacggaaaccagcgtagtacgtattagttcggtgtacttaactaacgtttggtaccttcgtacgtaaccaacgtactaacccgaccgtaagaccgtaaacgtaccccgtaacggtacttaacgtttaagtttaacgcgttaacgttacgaccgtaacgtaacgggtcccggtacccggttacgggggtacctagtacttcgtaccttcgtacgtcgtactaaccgtaagtccgtacggtaacctaaccggccgtacctccgtacactacgtcgtacgtcggtacctacgagtacgagaacgtcgtacgacggtctttaagtacttttaactacgtcgttacttacgttttaccgttagttttaacccggtttaactttttccggttttaacgttacccgggtttaacggtaccgggttaaccggtaacgggttaccgttccccggttaaacggttccggtaaccgggttaacgtaaccccggtaaacccgtaaacccggtacccctaaaaccccgtggtttaacccgttccgttaaacccg

SEQ ID NO: 35855 - DNA, 991 bp, Homo sapiens
  misc_feature: GYAE6OF01C4MXE.48.36.D03.1.454.CMB.1.raw
  modified_base (977)..(977): a, c, t, g, unknown or other
  misc_feature (977)..(977): n is a, c, g, or t
tcagagtatacatacacgaccggtgctcgatttagctgcgtcacgatctctcgttggggggggtctcaggaggcagcactctcgggacgtctccaccatggcctgggctctgctcctctcacgtcctcctcactcgaggcacgaggactccgtgggctcgtacggtcccgtcccgtcgtacctcgacgtccgtccgtccgtacgtacggttcgggtcccggttcctccgtacggaccgtacggttccggtacctaaccgtaccgtccgtaccgttcgacccgtaacgtaaccgggtaacctacggtaccgtaagggtacgttaacgtttaacgggtttacgggttaccgtaaccgttttaaaccgtttaaacgtttttaccggttacccgtttaacccgttaaaccggggtttaaaccctaaaaccgttaacgtaccccggtaaaacccccggtaaacgggttaaacccgtaaaacccggtaaccccggtaaacgtttaccggttaaaacgtttaaccttttaacggttacggtacttaaccggttaacgtaaaccgggtttaaccggaccccgggttccccggggttacccgggttcccgtacggttaaccgttcccggttaccgttacccggttacgggtacccggttaccgtaacccgttacggtaccggtttaacgggaaccccgtaacccggtaccgggtcccctttacccggattaaccccgtacgttccggttaccggtaccgggttacccgtcggaaccgggtgtaacgtaacgtacggtaaccggtacggtactttaagttaacgttacgtacgttcggttactttacggttactttaccgtttactttacgttttacgtttcggtacgttaccggtaacgggttccggtaccggttcgtaaccgtacggttaccgtaggggtacccaacggtaccccgtacgtaacccccgttaacctcggtaaccncgttcccgtaccgg

SEQ ID NO: 35856 - DNA, 871 bp, Homo sapiens
  misc_feature: GYAE6OF01E0C1M.48.36.D03.1.454.CMB.1.raw
  modified_base (261)..(261): a, c, t, g, unknown or other
  misc_feature (261)..(261): n is a, c, g, or t
tcagagtatacatacacgaccggtgctcgatttagctgcgtcacgatctctcttgggggctggggtctcaggaggcagcactcgtcgggacgtctccaccatggcctgggctctgcctcctcctcagccctcctcactcgagggcacaggatccgtgggctcagtctcgccctagactcacgcctcggctcgaggttcggtcccgggtctccgtggaccaggtcgtccaaccagttccgcctgaccacgtacggaaaccgngtaccgtaagtaggattaagtttggggtacgtacctttaacttaacgtttttcgtaccgtcccggttaccggttaaccaaccggtaacttacccgaaccccggaaacgggtaaccctaaaaacccggttacccccgtaaaacgggttacccttaaacgtttttaaagttttaaacgtgggtaactttaccggttaccgaaaccggtaaaccggtccccgggggttacccccggttaaccggggggttccccgttaggtaaccttccggtccttccttaccggttcgggtaccctaccgttaaacggtccgttacggaacccgtaaaccgtccgggtaccccctcccgttaaccgtaaccgtcttacccgtcggtacgggttcccaccggtacgtacggtaagtaacgtcgtacgtgggtacttacggttaactttaacgtttcgtacgttcgtttacgttacctttaagttttaccgttacgttttttcgttttaccgttacggtttaccggtaaacggttacgggtaccggttacgtacccggttccgttaccgtaggtaccccgtaacgtaaccccgaacggaccccgtaaaccccgtgttaacccgg

SEQ ID NO: 35857 - DNA, 932 bp, Homo sapiens
  misc_feature: GYAE6OF01DSZ80.48.36.D03.1.454.CMB.1.raw
tcagagtatacatacacgaccggtgctcgatttagctgcgtcacgatctctcttggggggggtctcaggaggcagcactctcgggactctccaccatggcctgggctctgctcctcctcacgcctcctcactcgagggacacgaggactccgtggctacgagtctcgtccctgactcacgcctcgtctcgtacggtcggtccgggtctaccgtcggactacggtccgtccaaccgtacgtccggtctcggacctacgtaacggaacctacgcgtaggtagtaacgttaggttcgggtacctaccgtttaacttaacggtttcctacctaccgttacggtaaccctaactacctacccgtaaccggtacgtaaccgtaaacccggtaccccgttaaaggttaccttaacggttttaactttacgacgttacgttacgtacgaacggttaaccgggcccgggttaccggtcccggggttacctagtacggtaccttcttacgtcgtacgtaccttaccgtaacgttcgacggtacctaacggtacccgttccgtaaccctacggtacttaccgttccggtaacggtccggtacgtacccggtacgggtaccgttaacgaaccggtacggttaaccgtacgggttaaccgttagttaaacgttttacgtaacgtttccgggtttaacgtttaaccgtttaccgtttttaaaccggtttttaccgttttaccgggtttttttaacggtttacccgggttaaccggttaaccggggtaaccggttcccggggttaaaccgggtttacccgtacccccggggttaacccgttaccggggttaacccgggttaaacccggtaccccgtaaacccccggggttaacccctaaacccctaaccggtttacccggtccggtttaaccccctttaccccgggg

SEQ ID NO: 35858 - DNA, 696 bp, Homo sapiens
  misc_feature: GYAE6OF01CF4Y7.48.36.D03.1.454.CMB.1.raw
  modified_base (189)..(189): a, c, t, g, unknown or other
  misc_feature (189)..(189): n is a, c, g, or t
  modified_base (252)..(252): a, c, t, g, unknown or other
  misc_feature (252)..(252): n is a, c, g, or t
  modified_base (347)..(347): a, c, t, g, unknown or other
  misc_feature (347)..(347): n is a, c, g, or t
tcagagtatacatacacgaccggtgctcgatttagctgcgtcacgatctctcgttggggggggtctcaggaggcagcactctcgggacgtctccaccatggcctgggctctgctcctcctcagcctcctcactcgagggcacagggatccgtgggctcacgtctcgtccctgactcacgtcctcgctcnggtcggtccgggtctccgtggacgcgtccggtaccacctatccgcctcgaccacgtcgaaccngacagtgattgttggtctacttactacttcgtcctaccgtacgtaaccacactcccaccgagaccaaccgtcccgtaagtactattacgttgagnttacgactacggacgtccggtacccggttcgggtactacgtcgttccgtcctacgtcgtcgtaccgttacgacgtcgtagacccgacgtacccgtccgtccgtacgtaccgtactcgtcgtcggtaccgtcgacggtacgtaggacgtactacgtacgtacgttacgttattacgttacgttcgtcgttacgttactttacgtttacgtttcgttttaaaaaaccgtttcggttacgttacggtacggtaccgggtacgggtaccggttaccgtaccgttaccggtaccgtaccgtaccgtaccggtaacccgtacccgtaacccgtacccgtccgtaccgttacccgg

SEQ ID NO: 35859 - DNA, 714 bp, Homo sapiens
  misc_feature: GYAE6OF01CYY9L.48.36.D03.1.454.CMB.1.raw
  modified_base (491)..(491): a, c, t, g, unknown or other
  misc_feature (491)..(491): n is a, c, g, or t
tcagagtatacatacacgaccggtgctcgatttagctgcgtcacgatctctcgttggggggggtctcaggaggcagcactctcgggacgtctccaccatggcctgggctctgcctcctcctcagcctcctcactcgagggacacaggactccgtgggactcgagtctcgccctgactcgacgcctcgcttcagtcggtccgggtctccgtacgggacacggtcggtacaccgtatccgctgaccacgtcggaaccagactagtaggattagttggtacgtacttaactacgtttgtccttaccgtacgtaaccaacacgtaccaacccgaggtactaaaccggtacccaaaggttcctaagtttaatttagacgtatacgtactacgtaacggtcccggtccggttaccgggggtcctagacgttcgtccttcgtaccgtcgtacctacgtaacgtccgtacgactaacgaccgtccctacgtacgacctntccgtaggtcgtccaacgagtacgtagaagtactagccgggtattacgtacttaacgtacgttagtacttacgtttacttaagtttaccttaacgttttttcgtttacgttaccgttaaacgggtacgtaccggggtactaccggtaccttaaccggtacgttacgaccgtaaccggaacccgtaaccgggtaacccctaacccgtacttccgtccgtaaccg

SEQ ID NO: 35860 - DNA, 708 bp, Homo sapiens
  misc_feature: GYAE6OF01BLI1W.48.36.D03.1.454.CMB.1.raw
  modified_base (374)..(374): a, c, t, g, unknown or other
  misc_feature (374)..(374): n is a, c, g, or t
  modified_base (424)..(424): a, c, t, g, unknown or other
  misc_feature (424)..(424): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcgagggcacaggactccgtgggctcagtctcgccctgactcagcctcgctcaggtcggtccgggtctccgtggacacggtccggtccacctacgtccgccgtcgaccgtacgtacgggaaccagcgtaggtgtaattacgttggtacgtactttaactaacgtttcgtccttaccgtacggtaaccaactacgtaccaaccgacgaacctaaacgtccccgaaggtctaactttattangtactcgtacacgtaacgccggtccgtcgggtcctagactcgtccgttcncgtgtcctacgtaacgtcgtacgacaaccgccggtccctaccgtacgacctacgttcctcggtcgggtcctacggacggtactacggagtactcgtacggtacttagtaactttacgtcgttacgtcgtttacgtttaccttacgttttttaaccgtacgtttttttccggtttacggtaccgttttacggaaaccgggtttcgggaacccggttacgtacccttaacccgggtacgttacgacccgtaccgacccgtaaccggaccctaaccgtcggttaccg

SEQ ID NO: 35861 - DNA, 810 bp, Homo sapiens
  misc_feature: GYAE6OF01AZQIZ.48.36.D03.1.454.CMB.1.raw
  modified_base (461)..(461): a, c, t, g, unknown or other
  misc_feature (461)..(461): n is a, c, g, or t
  modified_base (700)..(700): a, c, t, g, unknown or other
  misc_feature (700)..(700): n is a, c, g, or t
tcagagtatacatacacgaccggtgctcgatttagctgcgtcacgagtacgtctcgttggggctgggtctcaggacgcacgcactcgtcgggacgtcgtcccaccagtggccctcgggctctcgctcctcctcgacgcctcctcgtacgtcgagggcaccgagactccgtcgggacgtactacgtcctggccctagactccacgtccgtcgcgtcgtaggttcggtccgtcggtacctacccgtaggtaccgacggttccgtacctacccgtaagttcccggccgtagacctacggtacgggaacccacggtacgtacggtgtaacttacggtttcgggtacgttaccgtttaacgtaccgtttagtacccgttacccggttacggttaaacccgaaccgtccgtaaccgacccgtaacggaacctaaacccgttcccgtaaaggttcttactttaacgtntacggtagtacgtaccctaaacggtccgggtccgtacccttacgggttaagggtttacccgtaacgttccggttaccggttccgttccggacgttacccgtaccggtaaccgttcgtacccggtaaccgaccgtcccggtacccaccgtaacgaccctacgttccgttcccggttaccggcctacccggtaacggtaccgtacgggtaacggtacgcccggtacgttacgtaccgttanaccgtcgtccgtattcgtaactagtacgtacgtaagtccgtaagtcgtacgtaccgtacgtgtacggtcgtacggttaacgtcggggacgacggtaacgcgtccgtacgg

SEQ ID NO: 35862 - DNA, 677 bp, Homo sapiens
  misc_feature: GYAE6OF01A69UC.48.36.D03.1.454.CMB.1.raw
  modified_base (282)..(282): a, c, t, g, unknown or other
  misc_feature (282)..(282): n is a, c, g, or t
  modified_base (316)..(316): a, c, t, g, unknown or other
  misc_feature (316)..(316): n is a, c, g, or t
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcacgcctcgctcagtcgtccgggtctccgtggacagtccggtcaccatcgcctgcactggaaccaggcagtgatattgtgtcttactaactttgtcctcctacggtaccaacntaccaccagacaacgtcccaagtctattatttangtactgtacaacgttaacggcccggtcccggtacgggtcctagtactcgtcttctcgtgtcctacgtagtcgtcgacaaccgaccggtcccttaccgaccgacctacttaccgtcgtcgggtcctaaccgcggtcgtagaacgttcctacggtcgtacgttgtaactttacgtacgtagtccgtttactttacgtttacgtttttacttaaccggttttttccgtttttacgtccggtttaaccggtaccggttaccgggtacccggttaaccgggttaccccttacccgggtccggttaaggtaccccgtacggtaacccccggaacggtaacccccctaaccccgtgttccgtaccccg

SEQ ID NO: 35863 - DNA, 681 bp, Homo sapiens
  misc_feature: GYAE6OF01AEAI3.48.36.D03.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
tcagagtatacatacacgaccggtgctcgatttagctgcgtcacgatctctcttggggggggtctcaggaggcagcactctcgggacgtctccaccatggcctgggctctgctcctcctcagccctcctcactcagggcacaggactcctgggctcagtctgccctgactcagccctcgctcaggtgtccgggtctccnggacagtcgtcacntcgctgcacgtagaaccngctagtagtatattggtcgtcttactaactttcgtccttcccgttcggttaaccaactactacccaacccgacggaaccaaaccgtaccccgaaggttctaattttaactttactgtattcgtactaaccgtacggcccgggtaccccggttccgggggtaccctggtactccggtcttccgttcgtcgtcctccacgtcgtacggcacgtaccgcctccgtactaccgtctcgtcgtcggtctccgagtcagaactcgtacgagtcgtacgtatttacgtaccgtgtcgttcttacttactttacgttttaacgttttcgttttcgttaccgttacggtacggttaccgggtacggtcccgttacgtacccggttacggttaccggtacccgtaacggaaccccggtaccgtaacccccgtaacccgttactaccgttccgttaccccg

SEQ ID NO: 35864 - DNA, 648 bp, Homo sapiens
  misc_feature: GYAE6OF01ARA8Z.48.36.D03.1.454.CMB.1.raw
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattcggtgcttacaactttgtctctggtaccaacatcaccaggcaaacgtccccaaggtcattatttatgatgtcactaagcggtccctcggggtccctgactccgcttctcgtcggcctccgaagtcgtggacaacgccggtccctccctgacctactcctcgtgggtcctccgagggtcctaggaacgtactaccgacggtcttacggtaacttttacgtttaaccgtcgtaccgtttcgtttacttacttttttaccgtaaacggtttttccctttttttaggtacccgttttacgggtaaccgttcggggtaacccggttacggttacccgtacccggttcccgttaacggttcccgtaaccggtaccccgaaacgggtccccctaaaccccgtacttacccgg

SEQ ID NO: 35865 - DNA, 874 bp, Homo sapiens
  misc_feature: GYAE6OF01ED0TS.48.36.D03.1.454.CMB.1.raw
tcagagtatacatacacgaccggtgctcgatttagctgcgtcacgatctctcttgggggctggggtctcaggaggcagcactctcgggacgtctccaccatggcctggctctgctcctcctcagcctcctcactcagggcacaggatcctgggctcagtctcgccctgactcacgcctcgctcagtcgtccggtctcctggacagtcggtcaccatcgcctgctacgtacggaaccagactagtagtattaagttggtacgtaccttaaccgtaaccgttttcgttacccgttacccgttacggttaaaccctaaccgtaacttacccgaaccccgtaacgggaacccgtaaaaccggttacccccggtaaacgggttaccttaacttttaacgtttttaacgttacgttaacgttaccggttaaccgtaaaccggtaaaccggtccccgggggtaccccggtttacccggggggggttcccctacgggttaaccgttcccgggttaccctttccgttaccgttaccggtacccgtttaacccgtaacggttacccgttaccgggtaaccctaaaccgggtaacccccggtccccgttaccccgttaacggtaaccccttaccgttacccgtttaccggttcggggtacccttaccggtaacggttaccgttaggtaaacgtacgttaccggtacggttacgttagttaacgtttaactacgttacggttcttacgtttactttaacttttaacgttacgttttccgttttagttaccgttaccgggtaacgttcgggtaaccggtacggttccgtaccgttaccgtacgtacccgtaccgtaacccgtaccgacccctacccgtggttacccg

SEQ ID NO: 35866 - DNA, 758 bp, Homo sapiens
  misc_feature: GYAE6OF01EXZJT.48.36.D03.1.454.CMB.1.raw
tcagagtatacatacacgaccggtgctcgatttagctgcgtcacgatctctcgttggggggggtctcaggaggcagcactcgtcgggacgtcctccaccatggcctgggctctgcctcctcctcagtccctcctctacgtcggggcacgaggactccgtgggctcgagttctacgtccctgactcacgtcctcgctacgagtcgtccggtctcctaggaccgtacggtccggacaacgtcgtccgcctagacacgtacggacctagtcgtagtagagttagttcggtactacgttaaccgtatttcgtaccgtaccgtacgtaaccaactacgtaccaacccggtaacgaacctaaaccgtaccccgtaaaggtttacctaacttttaagttagtacgtaacttcgtaaccgttaaccggaccggtacccgggtccggtacccggggttacctaaggtccgtaccttccgttacgtccggtctaccgtacgtaacgttccgacggtaacccacggtacccggttccctaccgtaccgtaccgttacgtccgtccggttacgtaccgtacgtaccggtcgtaacgaacgtacgaccggtacgtacgttaatttaaccgttacttacggtcgttaccggtacttaccgtagtacctaggttccgacggtacgtacgacggttacgttaccggtggttccggggtacggtacgggacggtcgacgtaagccgtacgtcgtaccgcgtacccgtagtaccgg

SEQ ID NO: 35867 - DNA, 698 bp, Homo sapiens
  misc_feature: GYAE6OF01AT3H5.48.36.D03.1.454.CMB.1.raw
  modified_base (657)..(657): a, c, t, g, unknown or other
  misc_feature (657)..(657): n is a, c, g, or t
  modified_base (662)..(662): a, c, t, g, unknown or other
  misc_feature (662)..(662): n is a, c, g, or t
tcagagtatacatacacgaccggtgctcgatttagctgcgtcacgatctctcttggggggggtctcaggaggcagcactctcgggacgtctccaccatggcctgggctctgcctcctcctcacgtccctcctcactcgacgggcacgaggtactccgtggtctcgacgtcgtcgccctagactcgacgtcctcgcctacgtacggtcggtccggtctccgtacggacgtacggtccggacctacgacgtccgccgtcgcacgtacgaaccgcgacgtagtagtattgtcggtctaccttaactacgtttcgtacctcgtacgtaacctactacctaccaaccgtacgaaccgtaaccgtacccgtaagtacttatttacttagtagttactcgtaaccaacgtacgggcccgggttacccggtccggggttacctacggtccgttacgttccttacgtcgtcgtaccgtacctaggtaccgtacggaaccgaacccggtccgttaccccgtacgaccgtaccttcgtacggttcggccgtaccgtcgtacggtacgtaggactcgtacgtacgttacgtgttaactacgttctcgtacttcttacttactttcgtttacgttttcgttactcgtacgacggttcgacgtcgtccgtnttcgngtcccacgtacccgacgtacccatctcgtactcccg

SEQ ID NO: 35868 - DNA, 768 bp, Homo sapiens
  misc_feature: GYAE6OF01BT08G.48.36.D03.1.454.CMB.1.raw
  modified_base (225)..(225): a, c, t, g, unknown or other
  misc_feature (225)..(225): n is a, c, g, or t
tcagagtatacatacacgaccggtgctcgatttagctgcgtcacgatctctcgttgggggggtctcaggaggcagcactctcgggacgtctccaccatggcctgggctctgctcctcctcacgcctctcactcagggcacgaggactccgtgggcctcgagtctcgccctgactcgcgcctcgactcgtacgtcggtccggtctccgtggactcgtcgtacacgngtcgctagctacgtacggaaccagcgtagtgtaattagttggtacgtacttactaactttcgttacctcgtacgtaacctaactacgtaccgaacccgacggaacctaaaccgtacccgtaacggttactacgtttaatttagtacgtacgtacgtaccgtaacggtaacgggacccggtacccgggttccgggggttacctagttaccggttcttccgttccgtcggtaccggtcctaaccggtacgtccgttaacggaccgtaacggtcccggtcccttaccgtacgtaaccctacgttcggttaccgggtcggtacccgtacgtacgggtacgttaacgaacgtacttcgggacgttacgtaaggttacgtttaacgtcgtacgtttacttcgtttaacgtttacttttacggtttaaccgtttttccgttttacggtacgttacgggtaccgtacgggtaccgtccgttaccgtaccgtacgtaacggtcccgtaccggaacccgtaccgtacccaaaccggtctccgtccgttacccg

SEQ ID NO: 35869 - DNA, 955 bp, Homo sapiens
  misc_feature: GYAE6OF01BWEBN.48.36.D03.1.454.CMB.1.raw
tcagagtatacatacacgaccggtgctcgatttagctgcgtcacgatctctcttgggggctggggtctcaggaggcagcactctcgggactctccacatggcctgggctctgctcctcctcagtccctcctcactcgagggcacgaggtactccgtgggctcagtctcgccctgactcacgtcctcgctactacggtcgtccgggtctccgtacggactacggttccggtacacccgtacgtccggtcctacggtccgtaaccgttaccgggaaaccctagtacccggtaaggttacgtaaacgtttaacggtttcggggtaccttacccgttttaacgttaaaccgttttccggttaccgtttaccccggtaggttaaaccccgtaaaccgtacctacccggaaaccccggtaggtaaacccgttaaacccgggttacccccgaaagggtttacctttaacggtttaaacgtttttacgtacgggttaacttacggttaacccgtaaaaccggttaccgggtaccccgggggtttaaccccgggttcccggggggttaacccccgttaggttaaccccgttccgggtttacccttttacccggttaaccggtcccggttacccgttaaacccgtttacggggttaccctaacggggaaccctaaccgggtaacccccggttcccttaaccccgtacgtaaccccgttacttaccccggttaccgggtcggtacccgtaccggtaggtaaccggttaacggtaacgtccgttaacgggtacgtacgttaacgttactttaacggttcctacggttcggtttactttaccggttaccttttacgttacggttttttccttacggttaccggttaccggtaacggtaccggttccggtaacgtcccgtcgttacccgtgtaccgtccgaaacccgtcctacccgtacctcgtacccg

SEQ ID NO: 35870 - DNA, 849 bp, Homo sapiens
  misc_feature: GYAE6OF01BD280.48.36.D03.1.454.CMB.1.raw
tcagagtatacatacacgaccggtgctcgatttagctgcgtcacgatctctcgttgggggggggtctcagggaggcagcactcgtcgggacgtctccaccatggcctgggctctgctcctcctcacgcctcctcactcgagggcacgaggactccgtgggctcacggtctcgcctgtacctcacgcctcgctacgaggttcggtccgggtcctccgtaggacagtacacgtccaccgtactcctcctgaccacgtacggaaccgagtcgaggtggtacgttcgggtagttaactactagttccggtctaccgtacgtaacaacgtacgaccaccggaaggaaccaaaaccgtcccctaaaggtctaaggtacgttaagttacgtaggtaacggtcgtaaagggtaccgacccgggtcccgtaacgggtacccggggtcctaagtaccgttaccgtcgtttaccgtacgttaccggtacccgtaaccgttaacggttaccgtacggaacccttaacccggtaccgggttacccttacccgggttacgtaccccggtttaccggtccggttaccggtacccgtacggtaacgtccgggtaacggtacggtaacggttacggacgttaccgttaaggttaaaccgttttacggtaaccgtcgggtaactaaccggttaaccgttacggttaacgtaacgggttacccgaggaaccggggtaacctaaacggtacggtaaaaccgttacggggtcggttaccgggtttaagggtccgggaaacgggtaaacgggtaaaccctgggaaccgggtttaaaccggacccgtttaaccggggtaaccgtaacccggg

SEQ ID NO: 35871 - DNA, 761 bp, Homo sapiens
  misc_feature: GYAE6OF01EJACJ.48.36.D03.1.454.CMB.1.raw
  modified_base (175)..(175): a, c, t, g, unknown or other
  misc_feature (175)..(175): n is a, c, g, or t
  modified_base (258)..(258): a, c, t, g, unknown or other
  misc_feature (258)..(258): n is a, c, g, or t
  modified_base (633)..(633): a, c, t, g, unknown or other
  misc_feature (633)..(633): n is a, c, g, or t
tcagagtatacatacacgaccggtgctcgatttagctgcgtcacgatctctcttgggggctggggtctcaggaggcagcactctcgggacgtctccaccatggcctgggctctgctcctctcagcctctcactcagggcacgaggatccgtgggctacagtctcgccctgactcngtcctcgctcaggtcgtccgggtcctccgtaggactacggtccggtccaaccgtctccgccgtgaccgtacgtacggaaaccngacgagtgtagttagttggtcgtacttaactactttcgtccttaccgtacggtaacctaactacctaccgaacccggtacggaaccgttaaaccggtacccggtaacggttacttacgttttaagtttactagtacgttcgttaaccgaacggttaccgggccccggggtacccgggttccgggggtaccctaggtccgttacgtcctttaccgtcgtcggtacctccggtaacggtcgtacggaacccgacgtacccgggtccttcccgaaccgtacctacttccggtcggtaccggtccgtacggacggttagaccgtaacgtagcgtacgtacttaggtttacttaacgttacgttcggttacttacgtttntttaaccgttttagtttccgttttcgtttaccgtacgttaccgggtaccggttacgggtaccgttacggtacccgttcgtaaccggtcgtaccgaaccggtacccacccgtaccctccgtgtaccccg

SEQ ID NO: 35872 - DNA, 611 bp, Homo sapiens
  misc_feature: GYAE6OF01B9IZ3.48.36.D03.1.454.CMB.1.raw
  modified_base (390)..(390): a, c, t, g, unknown or other
  misc_feature (390)..(390): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcggtcaccatccgcctgcactcggaaccagcagtgatagttggtgtaccttactaacgtttgtccttccgtcggtaccaacactaccgacccgacggaccaaacgtccccaaggtctatttatttatgatcgtacacgtaacgccggtcccgtcggggtcctgactcgtcttctctgctacagtcngaccaacgccgtcctccgtacgacctcgtctcgtcggcctacgcgtactagaacgatacgacgtcttagtactttacgttacgtcgtcttacgtttacttagtttttacgttacgtttttccgtttttcgtacggtttcggtaacgttcggggtaccgtacggttacctaccgtaccgttacgtccgacgtacccgaacggacccctacccgacgttaccg

SEQ ID NO: 35873 - DNA, 975 bp, Homo sapiens
  misc_feature: GYAE6OF01A419V.48.36.D03.1.454.CMB.1.raw
tcagagtatacatacacgaccggtgctcgatttagctgcgtcacgatctctcgttggggggggtctcaggaggcagcactcgtcgggacgtctccaccatggcctgggctctgctcctcctcagcctcctcgactcgagggcaacgacggacttccgtggtctacgtagtcctcgtcctgacctcgacgccgtcgactacgtacggtcggttcccggtacctcgtacggtacgtacggttccgtaccgtaacctacgttaccgtcccgtacggtaccgtacgttaaccgggaacctacggtacgtaacggttaggtaactttaacgggtttccggtacgttaaccgtttaacccgtttaaccgttttaccggtacccgtttacccggtttaaccggtaaaacccgtaaaccgttaccggttaacccccgaaaccggttaaacccggggtaaaccccgttaaaccgggtacccccggttaaacgggttttaccctttaagtttttaacggttaccgtttaacggtaccgttacggttaaacccgtaacgggttaccggtcccgggtaccccgggtttcgggggtaccgtacggtttcgtacccgttccgtttccgtaccgtcggtccttaacggtaccgtcgttaccgactaacccggtcggtaccctccgtacgtaacccgtcgttccgtaccggtacgaccctcggtaacggtagtaccggtaactacggtaccgttacggtctttaaacgggtttcttaacggtttctcggttaaccgttttcttaccgttttaaccgtttagtttttaccccgttttccgggtttacggttccggtaaccggttaccgggttaccccgtagggtttacccggtaaccccttccggggttaaccgttacggttaccccggtaaacccaccgggtaaccctttaaacccccggtagtttcccttaacggttcccgttaaccccg

SEQ ID NO: 35874 - DNA, 760 bp, Homo sapiens
  misc_feature: GYAE6OF01B21E3.48.36.D03.1.454.CMB.1.raw
  modified_base (348)..(348): a, c, t, g, unknown or other
  misc_feature (348)..(348): n is a, c, g, or t
  modified_base (550)..(550): a, c, t, g, unknown or other
  misc_feature (550)..(550): n is a, c, g, or t
tcagagtatacatacacgaccggtgctcgatttagctgcgtcacgatctctcgttgggggggggtctcaggaggcagcactcgtcgggaccgtctccaaccatggcctgggctctgctcctcctcaccctcctcactcgacgggcacgacgggtccgtcgggcccagtcgtcgccctgactcacgtccctccctccggccggtccggtcctccgtcggaactagtcgacgtccaacctacttcctccgtcgaccgtaacgtacggaaacccacggacgtacggttcggtacggtttgggttaacggttaacttaacttagttcgttcctccggtacggtaaccaaacncgacccaaccggaggaacctaaaccccgacccctaaaagtctaagttacgttaacgtttagcggttaacggtaccgtaaggtaacggcccggtacccgtacgggtaccgggttcctaggtacgtccgtctttcgcgtccgtaccgtacgtacgtcgtacgacgtaccgccgtcctccgtacgccgtcgtcgtcgtacgtcgnggacgtagacggctacggacgtcttaagttatacgtgacgtcacgtcatattagcgacgacgaacactaacgtaagttacgtcgggtacggtacggttaccgggaaccgggtacgggtaccgaacggttaccggtaccggttaacccggttaccggtaccggtaaccggttaacccggaacccggttacccggtcccggttaacccccgg

SEQ ID NO: 35875 - DNA, 610 bp, Homo sapiens
  misc_feature: GYAE6OF01AVOVF.48.36.D03.1.454.CMB.1.raw
  modified_base (433)..(433): a, c, t, g, unknown or other
  misc_feature (433)..(433): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcggtcaccatcgcctgcactggaaccagcagtgatattggtgtcttactactttgtcctccgtaggtaccaactctccacccgagaccaaacgtccccaaggtctattattatgtatgtacacgtaacgccggcccgtacggggtcctgactcgcttctcgtcgctcgaacgtcgtcgacaaccgcggtcctcccgtgacctatcgtccgtcggctccgagtctgaacgntacacgtctagtacttcttacgtcgtacttcgtttacgttattttacgttaacgttttccgtttttggtaccttaccgggtacgttacggggtacccgtagttacccggtaccgtcgttacggtacccacgtaccccgtaacccggtaccctaaccccgcgttcccgtcgttacccg

SEQ ID NO: 35876 - DNA, 823 bp, Homo sapiens
  misc_feature: GYAE6OF01DL02O.48.36.D03.1.454.CMB.1.raw
  modified_base (184)..(184): a, c, t, g, unknown or other
  misc_feature (184)..(184): n is a, c, g, or t
  modified_base (566)..(566): a, c, t, g, unknown or other
  misc_feature (566)..(566): n is a, c, g, or t
  modified_base (607)..(607): a, c, t, g, unknown or other
  misc_feature (607)..(607): n is a, c, g, or t
tcagagtatacatacacgaccggtgctcgatttagctgcgtcacgatctcgtcgttggggggggtctcaggaggcagcactctcgggacgtctccacgatggcctgggctctcgcctcctctcacgtcctctccactcgagggacacacggtactccgtggctcagtctcgcctgactcagccncgcgtcacggtcgtccgggttctaccgtggacctacggttaccggtactacccaagtccgtacctcggacctaccggtacgaaacccgtggtaacctaggttacggtaaatttaggttcgggttaccgttaaccgttttaacctaaaaccggtttttcgtacccgttacggtaaccggttaacctaaacgtacctaacccgtaacccgaacggaaccgtaaaaccgttaacccggtaaaggtttacttaacttttaacggttagtctaacggtcttaaccacggttacgcccgggttacccggtacggggttcccagtactcgtccttctacgtcgacgtcctaagcgtcggaacaaacgccggtaccctcgtacaaccgtntctcggtaacgtcgtcgacggtacaacggtaacgacgtacnggttaacctagttaactttactacggcgttacttacgtttaacgttttacttacgttttaacggttttcggttttaacgtacggttaaaccggaccggtttaaaccgggtaaccggtaccggttttcccgaaccggttttaccacggggtaaaccctaccggaaacccggtaccgtaaccccgaaaacccgttttcgaccggttcccttaacccgg

SEQ ID NO: 35877 - DNA, 851 bp, Homo sapiens
  misc_feature: GYAE6OF01CBKNT.48.36.D03.1.454.CMB.1.raw
  modified_base (197)..(197): a, c, t, g, unknown or other
  misc_feature (197)..(197): n is a, c, g, or t
  modified_base (819)..(819): a, c, t, g, unknown or other
  misc_feature (819)..(819): n is a, c, g, or t
tcagagtatacatacacgaccggtgctcgatttagctgcgtcacgatctctcgttgggggggtctcaggaggcagcactcgtcgggacgtctccaccagtggcctgggctctcgccttcctcctcacgcctcctcactcgaggccacgaggtctccgtggctcgacgtctcgtccctgacctcacgccgtcgctcgngtcgtccggtctccgaggctacgtccgtccaacctagtccgcgtggacctacggtacggaaccacggtaccgtaggtcgtaacgttacgttcggtacgtacctttaacgtaacgttttccgttaccgttccgttaacgttaaccaacgtactaaccgaaccgtacggaaccgttaaacccgtcccgtaacggttccttaactttacgttaacgtcgtacgttaaccgttacgtaacgtaccggtcccggttcccggttccgggtaccttacgtacgttcccggttcttccggtactccggttcctaaccggttacgttccgtaacgtaacccgtaacccgtacccgttacccgttcccgtaaccgggttaaacccttccggttccgttaccggggtaacccggtcccggttacgtaaccggtacgtaacgtaacgtcgttcggtaacttcgtaacgtttaacgttcgtaacgttcgttctaccttttacgttaccgtttatttacccgttttcgtttaccgttacggtttaccggaacgttccgggtaaccgtttccgggtaaccgttcccggtttaacggccgttaccccgtaacggtaaccccgtacccggttaaacccncccgggttaaaccttccggttccctacccggg

SEQ ID NO: 35878 - DNA, 893 bp, Homo sapiens
  misc_feature: GYAE6OF01C8N36.48.36.D03.1.454.CMB.1.raw
  modified_base (112)..(112): a, c, t, g, unknown or other
  misc_feature (112)..(112): n is a, c, g, or t
tcagagtatacatacacgaccggtgctcgatttagctgcgtcacgatctctcgttggggggggtctcaggaggcagcactctcgggacgtctccaccatggcctgggctctnctcctcctcagcctctcactcgagggcacgaggtactccgtgggctcagtctcgccctgacctcacgtcctcgtctcgaggtcggttccgggtcctccggtggactacggttccggtaccaacctgttcccggcctacggacctacgtacggaacctaggactagttagtattacgttcgggtactactttaacgttaaccgttttcggtaccttacccgttacggtaaacccctaaacgtaccgttaccccgaacccggtaacgggtaaaccctaaaaccggttacccccgtaaagggttacctttaaacgttttagttttaacgtacggttaacgtttacggttaaacccgtaaaccggttaaccggggtccccggggttaccccgggtttacccgggggggtttacccttacggttaacccggttccgttacccggtttttacccgtcgggttacccgtaccgttaaccgtaccggttaccggttaacgggaccctaaacccggtacccggttcccctaccgtaccgtacccttaacgttccgtaccgggttcccgaccgtacggtacggtcgtaacggtaaccgtcgtaccgtaggttaccgttaacgttaacttttacggtcttacggttcgtttacgttttacctttacgtttacgtttaccgttttttccgtttaggtaccggttacggtacggtaccggtcgtaaccgtcctaccgggttactacggaccgtacccgacgtaacccgaccctaccgtacgtcctacgttcccg

SEQ ID NO: 35879 - DNA, 810 bp, Homo sapiens
  misc_feature: GYAE6OF01BJMIS.48.36.D03.1.454.CMB.1.raw
tcagagtatacatacacgaccggtgctcgatttagctgcgtcacgatctctcttggggggggtctcaggaggcagcactctcgggacgtctccaccatggcctgggctctgctcctcctcagccctcctcactcgagggcacgaggactccgtagggctcgagttctcgtccctgacctcgacgtcctcgctcgaggttcggtccggttactccgtacggacgtacggtccggtacacctacgtccgtcctcgtaccgtaaccgtacggaaccacgtacgtagtacgtacgttaggttcggtaccgttaccttaaccgttaacgttttcgtaccgttaccgtaccggtaacctaacgtaccgtacccgaacccggtaacggtaaccctaaacccggttaccccggtaacggttacctttaaggttttaactttacggttacgtaacgtttacggtaacctaaccggtaaccggtccccgggttccccgggttacgggggttaccctaggtaccgttccgttccttacgtccgtacggtacctacgtacgtcgcggtaaccaccggtaccgtccgtacctacgtacctagttccgtcgtaccggctacggaacggtctaacggtacgtacgtccgtagttcgtagttacttacgtctcgttcgtttacgttacgtttaacgtttctttacggttttcctttaggtacccgttacgggtaccggtacgggtacccttacggtcccgtccggttaccggtcgtacacccggtaacccgtaccgtacccctaaccttcgtaccgtccgtacccg

SEQ ID NO: 35880 - DNA, 522 bp, Homo sapiens
  misc_feature: GYAE6OF02INCCS.48.36.D03.1.454.CMB.1.raw
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcgcctcggggtccctgatcgcttctctggctcaagtctggcaacacggcctccctgaccatctctgggctccgaggctgaagatcaggctgattatactgctgttctattttctaagtttcctttttgtctttacggacgttgggaccgtaggtcctaccgtccgtaggtcctacgacccaacggcccaacccctactgtacc

SEQ ID NO: 35881 - DNA, 528 bp, Homo sapiens
  misc_feature: GYAE6OF02HMD0Z.48.36.D03.1.454.CMB.1.raw
  modified_base (232)..(232): a, c, t, g, unknown or other
  misc_feature (232)..(232): n is a, c, g, or t
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtgcttacaactttgtctcctggtaccaacatcacccaggcaaagtccccaaggtccattatttatgatgtcactaagcggccctcgggggtccctgactcgcttctctggctccaagtctggcaacncggcctcctgaccatctctgggcctccgagctgaanatcaggctgattattactgtctgttctattttctaacttttcctttttgtctttacggaacttcgggaccgtaggtcctaccgttcctaggtcacgcccaacggccctaacccgctaccg

SEQ ID NO: 35882 - DNA, 516 bp, Homo sapiens
  misc_feature: GYAE6OF02HZQ5M.48.36.D03.1.454.CMB.1.raw
  modified_base (506)..(506): a, c, t, g, unknown or other
  misc_feature (506)..(506): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccacatcacccaggcaaagtccccaaggtcattatttatgatgtcactaagcggccctcgggggtccctgatcgcttctctggctccaagtctggcaacgacgcctccctgaccatctctgggctccaggcctgaagatcaggctgattattactgctgttctattttcaagttttcctttttgtcttcgtaacttgggaccgtaggtcaccgtcctaggtcagcccaaggcccaaccccntcgtctaccg

SEQ ID NO: 35883 - DNA, 509 bp, Homo sapiens
  misc_feature: GYAE6OF02JIMPK.48.36.D03.1.454.CMB.1.raw
  modified_base (227)..(227): a, c, t, g, unknown or other
  misc_feature (227)..(227): n is a, c, g, or t
  modified_base (465)..(465): a, c, t, g, unknown or other
  misc_feature (465)..(465): n is a, c, g, or t
tcagagtatacatacacgaccggtgctcgatttagctgcgtcacgatctctcttggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtgcttacaactttgtctcctggtaccaacatcacccaggcaaagtccccaaggtcattattatgatgtcactaagcggccctcgggggtccctgatcgcttctctggctccaagtctggcaacacggcctccctgaccatctctgggctccaggctgaagatcaggctgattattactgctgttctattttcaagtttcctttttgtcttcggaactgggaccgnggtcaccgtctaggtcagcccaaggcccaacccactcgtctacg

SEQ ID NO: 35884 - DNA, 492 bp, Homo sapiens
  misc_feature: GYAE6OF02GRZ1C.48.36.D03.1.454.CMB.1.raw
  modified_base (399)..(399): a, c, t, g, unknown or other
  misc_feature (399)..(399): n is a, c, g, or t
  modified_base (455)..(455): a, c, t, g, unknown or other
  misc_feature (455)..(455): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattattatgatgtcactaagcggcctcgggggtcctgatcgcttctctggctccaagtctggcaacacggcctccctgaccatctctgggctcaggctgaagntcaggctgattatactgcttgttctattttcaagtttcttttgtcttcgatggacnggtcacgtctagtcagcccagcccaacccactgctac

SEQ ID NO: 35885 - DNA, 541 bp, Homo sapiens
  misc_feature: GYAE6OF02HE6M5.48.36.D03.1.454.CMB.1.raw
  modified_base (406)..(406): a, c, t, g, unknown or other
  misc_feature (406)..(406): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtcctgatcgcttctctgctccaagtctggcaacacggcctcctgaccatctcgtgggcctccaggctgaagntcgagtctgattatactgcttgttctattttctaagttttccttttttagtcctttacggtacgtcgggtaaccgtaggttcctacccggttccgtaggtcccacgcccgtaacggccccaacccctacttaccg

SEQ ID NO: 35886 - DNA, 515 bp, Homo sapiens
  misc_feature: GYAE6OF02GSHIW.48.36.D03.1.454.CMB.1.raw
  modified_base (505)..(505): a, c, t, g, unknown or other
  misc_feature (505)..(505): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctcaagtctggcaacacggccctccctgaccatctctgggctccaggctgaagatcaggctgatttattactgcttgttctattttcaagttttcctttttgtctttcggactgggtaccgaggtcaccgtcctaggtcagcccaggcccaacccnctcgtctacc

SEQ ID NO: 35887 - DNA, 571 bp, Homo sapiens
  misc_feature: GYAE6OF02FPGBH.48.36.D03.1.454.CMB.1.raw
  modified_base (367)..(367): a, c, t, g, unknown or other
  misc_feature (367)..(367): n is a, c, g, or t
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaacttttgtctcctggtaccaacatcacccaggcaaagtccccaaggtcattattatgatgtcactaagcggccctcggggtccctgatcgcttctctggctccaagtctggcaacncggcctccctcgaccactctctcgggtctccgaggctgaagactcacgctgtattattacgtgtacgtgttctattttacttaacgttttcctttttcgttcttacggtacgttcgggtaccggtacggtacctaccggggggttacccttacggttaccgacggtacccgaaccggtaccctaaccccgtacctacgtacccg

SEQ ID NO: 35888 - DNA, 508 bp, Homo sapiens
  misc_feature: GYAE6OF02GTO1R.48.36.D03.1.454.CMB.1.raw
tcagagtatacatacacgaccggtgctcgatttagctgcgtcacgatctctcttggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggcctcgggggtccctgatcgcttctctggctcaagtctggcaacacggcctccctgaccatctctgggctccaggctgaagatcaggctgattattactgctgttcattttcaagtttcctttttgtcttcggtaacttgggaccgaggttcaccgttcctaggtcagcccaggcccaacccactgctac

SEQ ID NO: 35889 - DNA, 669 bp, Homo sapiens
  misc_feature: GYAE6OF02IQ955.48.36.D03.1.454.CMB.1.raw
  modified_base (179)..(179): a, c, t, g, unknown or other
  misc_feature (179)..(179): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (263)..(263): a, c, t, g, unknown or other
  misc_feature (263)..(263): n is a, c, g, or t
  modified_base (304)..(304): a, c, t, g, unknown or other
  misc_feature (304)..(304): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcaggcacaggatcctgggctcagtctgccctgactcagcctcgctacngtgtccgggtctcctggacagtcgtcaccatcgctgcactggaaccngcagtnatatggtgctacacttgtctcgtgtaccaanatcaccaggacaaacgtccccgaaggtccaatttactttancgtatgtacactaagcggccctcggggtcctgatcgcttctcgtggctaccgaagttccgtggactaaacgcccggtcctaccctacggtaccaacttcgtccgtcggtccgtccgaggccttaggaacgtactacgtacgcgttactaagtttaccgttacgttacggtccttacgtttaccgttaactttttaccgttaaacgttttttcccgttttttcggtttaccgtttacggttaaccgttacgggtaacccggttacggttaaccggtacccgttacccggttaacggttacccgtacggaacccccgttaaccggtaccccgtaaaccccgtaaccgttccggtacctttaccccgg

SEQ ID NO: 35890 - DNA, 524 bp, Homo sapiens
  misc_feature: GYAE6OF02GRH2T.48.36.D03.1.454.CMB.1.raw
  modified_base (517)..(517): a, c, t, g, unknown or other
  misc_feature (517)..(517): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctgctcaagtctggcaacacggcctccctgaccatctctgggcctccaggctgaagatcaggctgattattactgcttgttctattttctaagtttccttttttgtcctttcgggacttggggacctaggtcctaccgttcctaggtcacgcccaaggcccaaccccncttaccg

SEQ ID NO: 35891 - DNA, 539 bp, Homo sapiens
  misc_feature: GYAE6OF02F37EZ.48.36.D03.1.454.CMB.1.raw
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgactcgcttctctggctccaagtctggcaacacgcctccctgaccatctctgggcctccgaggcctagaagatcaggctgtattattactgcttgttctattttctaacgttttcctttttgttcttcggtaactgggtaccgtaggtcctaccgttccgtaggtccacgacccgaacggaccccaaccccactcgtcctaccg

SEQ ID NO: 35892 - DNA, 512 bp, Homo sapiens
  misc_feature: GYAE6OF02GU744.48.36.D03.1.454.CMB.1.raw
  modified_base (406)..(406): a, c, t, g, unknown or other
  misc_feature (406)..(406): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccacatcacccaggcaaagtccccaaggtcattatttatgatgtcactaagcggccctcgggggtccctgatcgcttctctggctccaagtctggcacacggcctcctgaccatctctcgggctccaggctgaacgntcaggctgattattactgctgttctattttcaagttttcctttttgtctttcggactgggtaccgtaggtccaccgtcctaggtcacgcccaaggcccacccatcg

SEQ ID NO: 35893 - DNA, 556 bp, Homo sapiens
  misc_feature: GYAE6OF02HOT4J.48.36.D03.1.454.CMB.1.raw
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcggtcaccatcgcctgcactggaaccagcagtgatattggtgcttacaactttgtctctggtaccaacatcacccaggacaaagtccccaaggtcattatttatgatgtcactaagcgcccgtcggggtcctgatcgcttctctgctcagtctgcacncgcctccngaccatctcgtcggcctcgagctagaagatcaggtctagtattatactgtcttgttactacgttttcgtaacttttcctttttgtctttaccggtaacgttcggggtaaccgtacggttacctaacccggttccgttagggtcctacggaccccgtaacggtacccctaaccccctagttaccg

SEQ ID NO: 35894 - DNA, 543 bp, Homo sapiens
  misc_feature: GYAE6OF02HO5FB.48.36.D03.1.454.CMB.1.raw
  modified_base (403)..(403): a, c, t, g, unknown or other
  misc_feature (403)..(403): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaacgcggcctcggggtcctgatcgcttctctggctcagtctggcaacacggcctccctcgaccatctctcgggctccgaggctagaagntcgacggtctgtattattactgtcttgttctattttctaacgttttcctttttgtctttcgtaacgttcgggaccgtagggtcctaccgtcctaggtcctagaccccgaacggacccctaaccccgacttcgtcctaccg

SEQ ID NO: 35895 - DNA, 636 bp, Homo sapiens
  misc_feature: GYAE6OF02H8OGJ.48.36.D03.1.454.CMB.1.raw
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcaccagcaaagtccccaaggtcattattatgatgtactactaagcggacccgtcgggggtccctgatcgcttctctggctcaagtctggcaacncggcctccngtacccatctcgtgggcctccgaaggctagaaacgactcaaggccttagtaactttaacttacgttgtcgttcgtttaccttactttttacgttaaacgtttttccctttttttacgtaccgttttaccggtaaccggtttacggggtaacccggttacgggttaccgtaaccccggtttccgttaaccggttaccgtaccggtaccccgtaaaccgggtaccccctaaacccccgtacgtttccggtacccttaacccg

SEQ ID NO: 35896 - DNA, 554 bp, Homo sapiens
  misc_feature: GYAE6OF02GIV86.48.36.D03.1.454.CMB.1.raw
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccagacaaagtccccaaggtcattatttatgatgtcactaagcggcctcgggggtccctgatcgcttcnctgctcaagtctgcacncgcctcctgaccatctctgggctccaggctgaagctcaggctgattattacgtgcttgtttctattttctaagttttccttttttagtcgtttacggaacgttcgggaacccgtaggttccctaccggttaccgtaggtccgacggtaccccaacgggtacccccaaccccgtacttacgtccttaaccccg

SEQ ID NO: 35897 - DNA, 537 bp, Homo sapiens
  misc_feature: GYAE6OF02I0AYN.48.36.D03.1.454.CMB.1.raw
  modified_base (233)..(233): a, c, t, g, unknown or other
  misc_feature (233)..(233): n is a, c, g, or t
  modified_base (385)..(385): a, c, t, g, unknown or other
  misc_feature (385)..(385): n is a, c, g, or t
  modified_base (445)..(445): a, c, t, g, unknown or other
  misc_feature (445)..(445): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcacgtggaaccngcagtgatattggtgcttacaactttgtctctggtaccaacatcaccaggcaacgtccccaaggtccattatttatgatgtcactaagccggccctcgggggtccctgactcgtcttctctcggtctccaagtctggcaacgcgtcctcccngaccatcctctcgggctcccgagcttacgaatacgtgaggctagattattctgctgcttnatgtcgcagacctaacttagttaacttcggttccttacggtaacctaggtaacggaaccctagggttacccaccggttcccgtaggtacccg

SEQ ID NO: 35898 - DNA, 514 bp, Homo sapiens
  misc_feature: GYAE6OF02FXHC6.48.36.D03.1.454.CMB.1.raw
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctcctgaccatctctgggcctccaggctgaagatcaggctgattattactgcttgtcttattttctaagtttcctttttgtcttcggacttggaccgaggtcaccgtcctaggtcacgcccaaggcccaacccatcgtctaccg

SEQ ID NO: 35899 - DNA, 571 bp, Homo sapiens
  misc_feature: GYAE6OF02HEUSD.48.36.D03.1.454.CMB.1.raw
  modified_base (232)..(232): a, c, t, g, unknown or other
  misc_feature (232)..(232): n is a, c, g, or t
  modified_base (364)..(364): a, c, t, g, unknown or other
  misc_feature (364)..(364): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtgcttacaactttgtcttcctggtaccaacatcacccaggcaaacgtcccaaggtcattatttatgatgtcactaagcgcctcggggtcctgactcgcttctctgctcaagtctgcacncgccctcctgaccatctcgtcggcctccgaggcttagagtactcgaggtctgatttagttactgtcttgttctacgtttttcaaacgtttttcctttttagtccgtttacggtacgttacgggtaccgttaacggttcctaacccggttccgttaggttaccctacggtaccccgtaacgggacccctaaccccgtacgttacccgg

SEQ ID NO: 35900 - DNA, 679 bp, Homo sapiens
  misc_feature: GYAE6OF02IBK3P.48.36.D03.1.454.CMB.1.raw
  modified_base (229)..(229): a, c, t, g, unknown or other
  misc_feature (229)..(229): n is a, c, g, or t
tcagagtatacatacacgaccggtgctcgatttagctgcgtcacgatctctcttgggggggtctcagggaggcagcactctcgggacgtctccaccatggcctgggctctgctcctcctcagcctcctcactcagggcacaggatcctgggctcagtctgccctgactcagcctcgctcagtcgtccggtctcctggacagtcgtcaccatccgctgcactcggaaccngcagtgattagttggtgtacttaactaactttgtcctccgtaggtaaccaactataccaccaggacctaaacgtaccccgaaggtctagtttatttatagtattgtacaacgtaacgccggtcccgtcgggggtccctgactccgcttcctcgtcgccttccaagttccgtgaccaacgaccggtccctcctagaccctacttctcgtggtccctcgacggtctaaggaatacgtcgaggccttaggtaacttacgttacgttcggtcctttcggtttacttaacgtttttaccgttaaacgttttttcccgtttttaggtacctttaccgggtaaccgttccggggtaaccgttaccgggtacccgttacccggttacggttaccggtaccgaccggtaaccccgtaacggtaccccctaaccccgttacgttaccgtaccttaacccg

SEQ ID NO: 35901 - DNA, 515 bp, Homo sapiens
  misc_feature: GYAE6OF02GJVZO.48.36.D03.1.454.CMB.1.raw
  modified_base (369)..(369): a, c, t, g, unknown or other
  misc_feature (369)..(369): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgagtcagtaagcggccctcaggggtccctgatcgcttctctggctccaagtctggcaacncggcctcctgaccgtctctcgggctccgaggctgaggattggacggctgatttacttactgctagctcatatgcaggcagacaatatggtagtagttcggacggacggaccaaggcctaggacccgttcgtacggtcagtacccgg

SEQ ID NO: 35902 - DNA, 533 bp, Homo sapiens
  misc_feature: GYAE6OF02HAKUP.48.36.D03.1.454.CMB.1.raw
  modified_base (232)..(232): a, c, t, g, unknown or other
  misc_feature (232)..(232): n is a, c, g, or t
  modified_base (404)..(404): a, c, t, g, unknown or other
  misc_feature (404)..(404): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtgcttacaactttgtctcctggtaccaacatcaccaggcaaagtccccaaggtcattactttatgatgtcactaagcggccctcggggtccctgatcgcttctctggctcagtctggcacacggcctccctgacccatctctgggctccaggctagaanctcgagtctgtattactatgctgttctattttcacgttttccttttgtcttacggacgttcgggaaccgtaggtacctaccgttccttaggttccgacgtcccgaacggcccctaacccgtaccttccg

SEQ ID NO: 35903 - DNA, 549 bp, Homo sapiens
  misc_feature: GYAE6OF02GC1W4.48.36.D03.1.454.CMB.1.raw
  modified_base (534)..(534): a, c, t, g, unknown or other
  misc_feature (534)..(534): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcatatttatgatgtcactaagcggcctcgggggtccctgatcgcttctctggctccaagtctggcaacacgcctccctgaccatctcgtcggctccgagtctagaagactacgacgtcgtagtattattacgtgtcgttgtcttatttctaacgtttttcttttcgttcgtttacgtacgtcgggtaccgtaggtcctaccgttccgtagtaccgacgacccgaacggaccctaacccncgtacgtcctacccg

SEQ ID NO: 35904 - DNA, 551 bp, Homo sapiens
  misc_feature: GYAE6OF02I6IWB.48.36.D03.1.454.CMB.1.raw
  modified_base (355)..(355): a, c, t, g, unknown or other
  misc_feature (355)..(355): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattattatgatgtcactaagcggcctcggggtcctgatcgcttctctggctcaagtcnggcaacacgcctccctcgaccatctcgtggcctcgacgctgaacgatcgaggctgtattacttactgtcttgttctaattttctaacgttttcctttttacgtcttacggtaaccgttgggaccggtacggtccgtacccgttccgtaacggtcctacggccctaacggccctaaccccgtactcgtacctacccg

SEQ ID NO: 35905 - DNA, 563 bp, Homo sapiens
  misc_feature: GYAE6OF02FLKIR.48.36.D03.1.454.CMB.1.raw
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcgtcaccatcgcctgcactggaaccagcagtgatattggtgcttacaactttgtctcctggtaccaacatcacccaggacaaacgtccccaaggtcatttatttatgatgtcactaacgcggccgtcgggggtccctgactcgcttctctgctcaagtctggacaacgacgcctccctgaccatctcgtcgggcctccgaggctagaagatcgaggtctgtattattacgtgtcttgtttactattttacgtaacgttttcctttttagtcgtttacggacgttacgggtaccgtacggttccaccggttccgtaggtccaaccggcccgaacggacccaaccccgacttcgtacctaccg

SEQ ID NO: 35906 - DNA, 778 bp, Homo sapiens
  misc_feature: GYAE6OF02I6LIX.48.36.D03.1.454.CMB.1.raw
  modified_base (768)..(768): a, c, t, g, unknown or other
  misc_feature (768)..(768): n is a, c, g, or t
tcagagtatacatacacgaccggtgctcgatttagctgcgtcacgatctctcttggggggggtctcaggaggcagcacctcgtcgggacgtctccaccatggcctgggctctgctcctcctcacgcctcctcactcgacggcacgaggtacttccggtggcctcgacgttcgtcgccctcgtactcgaccgtccgtccgtcttacgacggttccgggttcccgggtccttccggtagggaacctacgggttccggtaccacctacgtccggccttcgacctacggtacggaacccaggcctaaggtcgtaattaggttcggtagtaccttaacttacgtttcgtccttccgtacggtaaccaaacacgacgacgacggaaccaaccgaccccaacgtcagttacgttaattacgtagtacttcgtacaaccgtaacggcccgtacccgtacgggtaccgggttccctggtacccgttcgttccttccgttcggtcgttcctaccgtaaggtcctacgggaacccaccggtcccggtaccccttccggtacctaccctacttccgttacggtccggtacctaccggtacgtaccgtaagtaaacgtacggtacggtacgtccgtttaaggtttactttttccgttaccgtggtcccttcgtaccgtttaatacgttacgttcgacctacgaaccttactttaagttccgtttggttacccgttaggtaaccgtacggaaccgtacgtaaccggtcctaaccgttaccgnggtaaccccg

SEQ ID NO: 35907 - DNA, 636 bp, Homo sapiens
  misc_feature: GYAE6OF02F0700.48.36.D03.1.454.CMB.1.raw
  modified_base (230)..(230): a, c, t, g, unknown or other
  misc_feature (230)..(230): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcggtcaccatcgcctgcactggaaccngcagtgatattggtgcttacaactttgtctcctggtaccaacatcacccaggacaacgtccccaaggtcattatttatgatgtcactaagcggccgtcggggtccctgactcgtcttctcgtcggctccgaagtctcggacaacgaccgcctccctagacctatctcgtcgggtcctccgaggcctaggaagtacgtcgacggtctagtactttattacgtcgtcgttgtttaccttatttttaccgttaacgttttttcccgttttttcgtaccgtttaccgggtaacgttcggggtaaccgtacgggtttcccgtacccggtttaccggttacggttaccgtaacccggtacccgtaaccgggtacccccctaaccccgtaccgttaccggtcccttaaccccg

SEQ ID NO: 35908 - DNA, 571 bp, Homo sapiens
  misc_feature: GYAE6OF02G6ZND.48.36.D03.1.454.CMB.1.raw
  modified_base (365)..(365): a, c, t, g, unknown or other
  misc_feature (365)..(365): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcaccaggcaaagtccccaaggtcattattatgatgtcactaagcggccctcgggggtccctgatcgcttctctggctcaagtctgcacncggcctccctgaccatctcgtcgggctccaggctaggaagactcgacgggtctggtatttaacttactagtcttgttctactttttcgtaacgttttcccttttttagtcctttacgggtaacttcggggtaaccgtaggttaccctaccgttccgttaggtaccgtacggacccgtaacggcccctaaccccgtacgttacccgg

SEQ ID NO: 35909 - DNA, 491 bp, Homo sapiens
  misc_feature: GYAE6OF02G62US.48.36.D03.1.454.CMB.1.raw
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (485)..(485): a, c, t, g, unknown or other
  misc_feature (485)..(485): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacaggtcggtcaccatccgcctgcactggaaccagcagtgatattggtgcttactaactttgtcttctggtaccaacatccacccaggcaaacgtccccaaggtctattatttatgtatgtcactaagccggtccgtcggggtccctgactcgcttctctgctcagtcngcacgcgcctcctnaccntctcnggctcngcaganatcgagctgattntactgcttntcatntgcagcacgtctacgngttgggtcgtcggcggaggacagctcggacctccgtagtacngtaccg

SEQ ID NO: 35910 - DNA, 563 bp, Homo sapiens
  misc_feature: GYAE6OF02HL8U4.48.36.D03.1.454.CMB.1.raw
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcaccaggcaaagtccccaaggtcattatttatgatgtcactaagcggcccgtcgggggtccctgactcgcttctctggctcaagtctgcaacacggcctccctgaccatctcgtcgggctccgaggctgaagtactcgaggtctgtatttattactgtcttgttctattttactaagttttcctttttagtccgtttacggtaacgttcgggtaccgtacggttccaaccggttccgtaacggtcctacggacccgtaacggcccaaccccgtacgtccgtacctacccg

SEQ ID NO: 35911 - DNA, 608 bp, Homo sapiens
  misc_feature: GYAE6OF02HGK5F.48.36.D03.1.454.CMB.1.raw
  modified_base (229)..(229): a, c, t, g, unknown or other
  misc_feature (229)..(229): n is a, c, g, or t
  modified_base (303)..(304): a, c, t, g, unknown or other
  misc_feature (303)..(304): n is a, c, g, or t
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgctgcactggaaccngcagtgatattggtgcttacaatttcgtctcctgtacaacactcacccagacaacgtcccaagtcattacttannatgtcactaacgcgccgtcgggtcctgactcgtcttcgtctcggtcctacaagtcgtacggtacaacgaccggtccctcccgtacacccgtactccgtcggtcggcctccgaggtacgtacggaacgtacttcgaacggtcttaggtactttaagttactgtacgttcgtttacttaacgtttttacgttaacgtttttccgtttttagtaccgtttaccggtacgtcgggtaaccgtcggtccctaccgttccgtacggtccgaccgtcccggaacggacccctaacccgtacgttgtacccg

SEQ ID NO: 35912 - DNA, 658 bp, Homo sapiens
  misc_feature: GYAE6OF02IC9W5.48.36.D03.1.454.CMB.1.raw
  modified_base (232)..(232): a, c, t, g, unknown or other
  misc_feature (232)..(232): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtgcttacaactttgtctctggtaccaacatccaccaggacaacgtccccaaggtctatttatttatgatgtacacgtaacggccggtacccggtccgggggtcctgacgttccgtctttctcgtcggcctaccgtaagtcctgaccgtaacgaccggtccctccctacgaccctactccttcgtcgggtcctccgtagtaccgtagtaacgtcgtcgacggtctagtactttagttacgtgtacgtttgttcttaactttttacgtaacgtttttcctttttttacggtaccgttttaccgggtaaacggtttccggggtaaccgttaccgggttaccgtaccccggtttacgtaccgggttaccaaccggtacccccgtaaccggtacccctaacccccgtacgttacccgg

SEQ ID NO: 35913 - DNA, 592 bp, Homo sapiens
  misc_feature: GYAE6OF02GLFR1.48.36.D03.1.454.CMB.1.raw
  modified_base (232)..(232): a, c, t, g, unknown or other
  misc_feature (232)..(232): n is a, c, g, or t
  modified_base (585)..(585): a, c, t, g, unknown or other
  misc_feature (585)..(585): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtgcttactaactttgtctcctggtaccacactcaccaggcaaacgtcccaaggtcattattatgatgtcactaagccggcccgtcggggtccctgactcgtcttctcgtcgtctccagtctcgacacgacgtccctccgtacgacctactcctcgtcgggtaccctcccgagggtcctagaacgtcgtacgtacgggtccttagtactttacttaccgtgtcgttcgttcttattttacgttacgttttcctttttcgtacgtttaccggtaacgttcgggaccgtacggttaccgtaccgttacgtacggtcaccggtacccgtacggaccctaccctntacccgg

SEQ ID NO: 35914 - DNA, 686 bp, Homo sapiens
  misc_feature: GYAE6OF02FMYHN.48.36.D03.1.454.CMB.1.raw
  modified_base (255)..(255): a, c, t, g, unknown or other
  misc_feature (255)..(255): n is a, c, g, or t
tcagagtatacatacacgaccggtgctcgatttagctgcgtcacgagtacgtctcttggggggggtctcaggtaggccagcgaactactcgggacgtcctccaccatggcctgggctctgctcctcctcagcctcctcactcagggcacaggatcctgggctcacgtcctcgccctgaccttcacgtccctcggcctcacggtcgtcccgggtctcccgtggacaggtccggtcaccatcgctgcactggaaccngcagtgaatacgtcggtctacttactacttcgtcctccgtacgtaccaactctaccaccgacgaccaaaccgtacccgaacgtctacttagttagtacgtactacgtacaacgtacggtccggtccggtccggggtcctacggtacgtcgtcttcgtacgtcgtcctacgtacgtcgtacgacctaaccgaccgtaccctaccgtacgacctacgtccgtaccgtcggtaccgtaccgtacggtcgtaacggtaacgtacgtacggtacgtctagtacgttacgtacgtcgtacttacgttacttactttaccgtttaccgttttccgtttacgtaccgttacggtaacgtacggtaccgtacggtccgtaccgtacggtacgtaccgacgtacccgtaccgtacccgtaacccgtcgttaccgtcctccg

SEQ ID NO: 35915 - DNA, 559 bp, Homo sapiens
  misc_feature: GYAE6OF02FK3Q8.48.36.D03.1.454.CMB.1.raw
  modified_base (376)..(376): a, c, t, g, unknown or other
  misc_feature (376)..(376): n is a, c, g, or t
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcggtcaccatccgcctgcactggaaccagcagtgatattggtgcttacaactttgtctctggtaccaacatccacccaggacaaacgtccccaaggtcatttattatgatgtcaactaagcggccctcggggtccctgatcgctctctggctcagtctggcacacgcctccngacatctcgtggcctccgagctagaagtactcgaggctagatttacttacgtgtcttgttctactttttacgtaacgtttttcctttttgtaccgtttcggtacgtcgggtaaccgtcggtcctacccggttcgtacggttcgaccgtacccgaacggaccccaaccccgtatcgttaacccg

SEQ ID NO: 35916 - DNA, 593 bp, Homo sapiens
  misc_feature: GYAE6OF02HID58.48.36.D03.1.454.CMB.1.raw
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcggtcaccatcgcctgcactggaaccagcagtgatattggtgtcttaactaactttcgtctcctggtaccaacactccacccaggaccaaacgtccccgaaggtctaatttatttatgatgtactaactaacgccggtcccgtcggggtccctgactcgtcttctctcgctcagtcgtcgcaacgccggccctcctcgacctctctcgcggtcctccgagtctagaacgctacgacgtctagtattacttacgtgtacttgtttaccttattttaccttacgttttcctttttcgtccgtttacggtaaccgttcgggaccgtaggttaccctaccgttaccgttaggtcccgtaccgacccgtaacggcccctaacccgtattaccg

SEQ ID NO: 35917 - DNA, 645 bp, Homo sapiens
  misc_feature: GYAE6OF02I0VBK.48.36.D03.1.454.CMB.1.raw
  modified_base (230)..(230): a, c, t, g, unknown or other
  misc_feature (230)..(230): n is a, c, g, or t
tcagagtatacatacacgaccggtgctcgatttagctgcgtcacgatctctcttgggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtgcttacaactttgctctggtaccaacatcaccaggacaacgtccccaaggtcattattatgatgtacactaacgcggtcccgtcggggtcctgactcgcttctcgtcgcctcgaagtcgtgaccaaccgacggtccctccctacgaccctactcgtcgtcgggtcctccgagtctagaaggtacttacgaggtcctgtaactttactttacgtcgtacgttacgtttacttacgtttttacgttaacgtttttcccgtttttttggtaccgtttacggtaaccgggttcgggtaacccggttacggtaccccgttaccggttacccgttaacgggttaccgacccggtaaccccggtaaccggaacccctaacccccgtacgttacctacccgttaccccg

SEQ ID NO: 35918 - DNA, 567 bp, Homo sapiens
  misc_feature: GYAE6OF02FZYA0.48.36.D03.1.454.CMB.1.raw
  modified_base (371)..(371): a, c, t, g, unknown or other
  misc_feature (371)..(371): n is a, c, g, or t
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcggtcaccatcgcctgcactggaaccagcagtgatattggtgcttacaacttttgtctcctggtaccaacatcacccaggacaacgtccccaaggtcattatttatgatgtcactaagcggcccgtcggggtccctgactcgctttctcgtgctcagtctggcaacncggcctccctgaccatctcgtcgggcctccgaggctagaagtatacgaggtctgaactttattaccgtgtccttgttcttatttttctaacgttttccttttttgtccgtttacggtacgtcgggtaccgtacggtcctacccggttccgtacggtccgacgacccgaacggcccctaacccctacgttctacccg

SEQ ID NO: 35919 - DNA, 773 bp, Homo sapiens
  misc_feature: GYAE6OF02GS456.48.36.D03.1.454.CMB.1.raw
  modified_base (246)..(246): a, c, t, g, unknown or other
  misc_feature (246)..(246): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctcgccctgactcagcctcgctcagtcgtccggtctcctggacagtcgtcaccatcgcctgcactaggaaccagcagtgatagttggtntacttactacttcgtctcctagtaccaactactacacccgagacaacgtaccccgaaggtctagttattatgtatcgtactaacgtacggccgtccggtaccggggtcctggtacctcgtacttcgtcgtcggtctaccgtaacgtccgtcgaccgaaccgtaccggtccctacccgtacgaccctacgttaccgtccggttacggtcccttacccgggtacgtaccgttaacggaaacggttacgtcccggtaacgggttaccttaagtttaaccttttaacggtttaaccgttcggtttaccgttttaccgttttaccgtttaaacgttttttttaccggttaaacccgttttttttccgtttttttcggttaacccggttttacccggtaaacgggtttacccggggttaaccggttacccggttacccgttaacccggtttacccgttaacgggttaccgaacccgtacccccggtaaccggacccccctaaacccggtccggtttaccgaccccgttacccg

SEQ ID NO: 35920 - DNA, 613 bp, Homo sapiens
  misc_feature: GYAE6OF02IV7SB.48.36.D03.1.454.CMB.1.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (380)..(380): a, c, t, g, unknown or other
  misc_feature (380)..(380): n is a, c, g, or t
  modified_base (513)..(513): a, c, t, g, unknown or other
  misc_feature (513)..(513): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtnatattggtgcttacaactttgtctcctggtaccaactatccacccaggacaaacgtaccccaaggtcatttatttatgtatgtacactaacgccggtcccgtcggggtccctggactccgtcttctcgtcggtactcctaagtcnggaccaaccgccggccctcccgtacgacccagtcctcgtggcctccgagtcgagaacgtctcgacgtactagtactttacgttactcgtcttcgtttacttacgttttaccttaacgttttttcccgtttttntcccgtttacggtaaccggtcgggtaccgttacggtcctaccgttccgtacggtccgaccgacccgtaacggccccaaaccccgtcgtacgtcctacccg

SEQ ID NO: 35921 - DNA, 861 bp, Homo sapiens
  misc_feature: GYAE6OF02H5SF4.48.36.D03.1.454.CMB.1.raw
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcacgcctcgctcagtcgtccgggtctcctggacagtcggtcaccatcgctgcactcggaaccagcagtgattagttggtgtacttaactaacttttcgtactccgttacggtaaccaactacttaccaacccgacggaaccaaaaccgttacccccgaaaggtaccttaattttaactttacgtagtaacttcggtaacctaaacgtaaacggccgggtaccccggttaccgggggggttaccccttagggtaacgttccggttacctttaccgtcgttacggtaccttacccgtaaagttccgtacggacctaaaccgtacccgggtcccttacccgtacggtaaccctacgttcccgtaccggttacggggtaccctacccggtaacgggtcgttaaacggaaacggttacgttaccggtaacgggtaccgttaagtaaacttttaaacgtttaaccgttcgttaccgttttcgttttaaccgtttaacgttttttaaccgttttaacgtttttttcccgtttttttaacggacccgtttttaaccgggtaaccgggttacggggtaacccggtttaacgggtacccgttaacccggttaccggtaaccgggtttaccacccgggtaccccgtaaaccgggtaccccccttaaaacccccggtacgtttacccggttacccttaaccccgg

SEQ ID NO: 35922 - DNA, 575 bp, Homo sapiens
  misc_feature: GYAE6OF02FQMXR.48.36.D03.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcacgtggaaccngcagtgatattggtncttacaactttgtctcctggtaccaacatcacccaggcaaacgtccccaaggtcattatttatgatgtcactaagccggccgtcggggtccctgactcgtcttctctgcctccgaagtcgtagcaaccgcggccctccctgaccctatccgtctcgggcctccgaggtcctaggaagtactcgacggtctgtactttacttacgtgtcttgttctattttacttacgttttcctttttgtctttcggaacgtcggtaccgtacggttcctaccgttccgtacggttccacggtacccgacggtaaccccaccctacgttcgtcctacccg

SEQ ID NO: 35923 - DNA, 662 bp, Homo sapiens
  misc_feature: GYAE6OF02II3LH.48.36.D03.1.454.CMB.1.raw
  modified_base (234)..(234): a, c, t, g, unknown or other
  misc_feature (234)..(234): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatccgtgggctcagtctgccctgactcacgcctcgctcgagtgtccgggtctcctggacagtcgtcaccatccgcctgcacgtcggaaccngcagtgactagttggcgtcttaactactttcgtccttccgtacggtaaccaactctacccaccgaggacctaaaccggtccccgaaggttctatttacttagtgtatcgtactacgtaacggccggtccggtccgggggtacctgacgtcgtccttctcgtcggacctacgtagtcgcgacaccgtacgtcctacctcgtacctattcgtcgtcggtcctccggagtccgtagaacgtctacgtcggtccttaaggtactttaacgtacgttcgtaccgttacgtttcgttaacgttttccgttaaccggtttttttcctttaggttcccggttaccggtacggtcggtaaccggttcggtccgttacccgtcggtacgtaccgaccgtaccctacggtacccctaacccgtgttaccgccgttaccg

SEQ ID NO: 35924 - DNA, 660 bp, Homo sapiens
  misc_feature: GYAE6OF02FMH0U.48.36.D03.1.454.CMB.1.raw
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcgtcaccatcgcctgcactggaaccagcagtgatattggtgtcttaactaactttgtcctcctggtaccaacactcaccaggacaaacgtcccaaggtctattattatgatgtacactaacgccggtcccgtcggggtcctgactcgcttctcgtcgtctctagtctcgacaaccgccgtccctaccctacgacctactcctcgtcgggtcctccgacggtcttaggaacgtactccgtaacggtctaagttactttaacgttacgttcgttactttcggtttacctttaacgtttttaccttaaacggttttttcccgtttttttacgtacccgttttaccgggtaaccgtcgggttaacccggttaccggttacccgtaacccggttacccgttacgggttacctaacccggtaccccgtaaaccggtaccccctaaccccgtacgttacccg

SEQ ID NO: 35925 - DNA, 562 bp, Homo sapiens
  misc_feature: GYAE6OF02HCW6W.48.36.D03.1.454.CMB.1.raw
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (435)..(435): a, c, t, g, unknown or other
  misc_feature (435)..(435): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatccgcctgcactggaaccngcagtgatattggtgcttacaactttntctcctgtaccacatcaccaggcaaacgtccccaaggtcattattatgatgtcactaagccggtccgtcggggtcctgactcgcttctctggcctcagtctgcaacgccgcctcctcgacctactctcgtcggtcctccgaggctaggaacgactacgaggtctagtactttattacngtcgttgttcttatttacttacgttttccgtttttcgtcgtttcggaacgttcgggaccgttcggtcctaccggtccgttaggtacctacgtacccaacggtacccctaacccgacttcgcctaccg

SEQ ID NO: 35926 - DNA, 743 bp, Homo sapiens
  misc_feature: GYAE6OF02H22JQ.48.36.D03.1.454.CMB.1.raw
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctctcactcagggcacaggatcctggctcagtctgtcctgactcagcctcgctcagtcgtccggtctccgtggacagtcggtcacntcgcctgcactcggaaccngcagtgattagttggtgtacttaacaacttttcgtccttccgtaggtaacccaaactacttaccgacccgacggacctaaaaccggttacccccgaaagggttaccttaagttttaatttacgttacggtacttacggttaccgtaaccgttaaacggtcccggggtccccggtttccgggggggtccccttacggtaacgttccggttcctttccgttcgttcggtccttacccgtaaaggttcccgtacggtacccgtaaaccgtacccgggtaccctcccgtacgaccctacttccctccggtcgggtccctaccggacggtcgttaagaacgtactacggacggttctagtactttacttacgtcgttcgttacgtttactttagttttaccgttaacgtttttcctttttacggtccgttaggtaccgttcgggtaccgtacggtcctaccgttcgtacggtaccgaccgtacccgaccggacccctaacccgtcgtaccgtacctaccg

SEQ ID NO: 35927 - DNA, 631 bp, Homo sapiens
  misc_feature: GYAE6OF02HF2O7.48.36.D03.1.454.CMB.1.raw
  modified_base (233)..(233): a, c, t, g, unknown or other
  misc_feature (233)..(233): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatccgtgggctcagtctgccctgactcagcctcgctcagtcgtccgggtctccgtggacagtcggtcaccatcgcctgcacgtggaaccngcagtgatattggtgcttactaactttgtctcctgtaccaacatcaccagacaaacgtccccaaggtctatttatttatgtatgtcactaacgccggtcccgtcggggtccctgactcgtcttctcgtggcctcctaagtctggacaaccgaccggtcctcccgtagtacccatccgtcgtcgggtacctccgacggtcgtacgaagtacgtacgtacggtacgttcgtatttaacgttacgtcggtctttacgttacttacgttttacgtttaacgttttccgttttttacgtccgtttacggaccgttcggggtaccgtacggttccgtacccggttcgtacggtacctaccgacccgaaacggtccccgaaacccctcgttaccgtcccgtaccg

SEQ ID NO: 35928 - DNA, 527 bp, Homo sapiens
  misc_feature: GYAE6OF02FWELW.48.36.D03.1.454.CMB.1.raw
  modified_base (228)..(228): a, c, t, g, unknown or other
  misc_feature (228)..(228): n is a, c, g, or t
  modified_base (362)..(362): a, c, t, g, unknown or other
  misc_feature (362)..(362): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggcaccatcgcctgcactggaaccngcagtgatattggtgcttacaactttgtctcctggtaccaacatccaccaggcaagtccccaaggtcattatttatgatgtcactaagcggcctcggggtccctgatcgcttctctggctcaagtctggcaacnccggcctccctagaccactctctcgggcctccgaggtctgaagactcgaggtctgactttattacgtgccttgtcttattttctaacgttttctttttagtcttacgtacgttcggaccgagttccaccgttcgtagtccacgccacggcccaaccgactcgctc

SEQ ID NO: 35929 - DNA, 761 bp, Homo sapiens
  misc_feature: GYAE6OF02IV72E.48.36.D03.1.454.CMB.1.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgctgcactggaaccngcagtgatattggtcncttactaacttttgtcttccgtaggtaccaactactccacccaggaccaaacgtccccaaggtcaatttatttatgtatgtactaacgtaacgccggtcccgtcggggtccctgactccgcttctcgtcggtcctaccgtaagttccgtacggtaaccaaccgtacccgggtcccttaccccgtagtaaccctacgttacccttccggtacgggtccttacccggtaggtcccgttaaggaaacggttaacttccggtaacgggttacctttagggttaaacttttaacgtttaaccgtggttccgtttacgttttaccgtttaacttttttacccgttaacgttttttttcccgttttttggttaacccgtttacggggtaaacccggtttcggggtaaaccgtttccggggttaacccttaccccgggttaaccgttacgggttaccctaaccgggttaccccgtaaacgggtacccccttaaacccccgtaggttacccgtacccgttaacccg

SEQ ID NO: 35930 - DNA, 692 bp, Homo sapiens
  misc_feature: GYAE6OF02FP377.48.36.D03.1.454.CMB.1.raw
  modified_base (237)..(237): a, c, t, g, unknown or other
  misc_feature (237)..(237): n is a, c, g, or t
  modified_base (338)..(338): a, c, t, g, unknown or other
  misc_feature (338)..(338): n is a, c, g, or t
  modified_base (459)..(459): a, c, t, g, unknown or other
  misc_feature (459)..(459): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcggtccacctatcgcctgccaacgtcggaaccngcagtgatattggtactcttactaacgttgtcctccgtacggtaccaactactcacccgtaggacctaaacgtccccgtaaggtcctaattacttttaagngtacttgtacctaaccgtaacggccggtccccgtccgggggtccctaggtactccggtccttcgtcgtcggtacctccgtaagtccgtggacctaacgaccggtccctccgtacgaccctntccgtcgtcggcctccgacggtctagaacgtctacgtacgtcttatactttacgtacgtcgtacgttcgtttacgttattttactttaacgttttcctttttacggtaccgtttacgggtaaccgttacgggtaccggtaacggttccctaccggttacccggttacggtcccgtaaccggacccgtaaacggtcccccgtaaaccccgtcgttaccgtaccgtttaaccccg

SEQ ID NO: 35931 - DNA, 649 bp, Homo sapiens
  misc_feature: GYAE6OF02HZX6G.48.36.D03.1.454.CMB.1.raw
  modified_base (231)..(231): a, c, t, g, unknown or other
  misc_feature (231)..(231): n is a, c, g, or t
tcagagtatacatacacgaccggtgctcgatttagctgcgtcacgatctctcttgggggggggtctcaggaggcagcactctcgggacgtctccaccatggcctgggctctgctcctcctcagcctctcactcagggcacaggatcctgggctcagtctcgccctgactcagcctcgctcagtcgtccgggtctcctggacagtcggtcaccatcgcctgcactggaaccngcagtgatattggtgcttacaactttgtctcctggtaccaacactcacccaggcaaacgtccccaaggtcattactttatgtatgtcactaagccggtccctcgggggtccctgactcgtcttctctcggctccaagtctggccaacgccggtcctcccgtacgacctacgttctccgtcgggtaccttacccgaggtccgtaggtaaacgtactcgacgggtccttagtactttaactttacgtcgtacgttacgtttccttaacgttttactaaccgtttttccttttttacgttcgttaccgggttaacgttacggggtcccgtaacggtccgtacccggttaccgtaggttacccgacggtacccccgtaacggtaccccctaaacccccgtaccgttcggtacccttaacccg

SEQ ID NO: 35932 - DNA, 855 bp, Homo sapiens
  misc_feature: GYAE6OF02I44Y3.48.36.D03.1.454.CMB.1.raw
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctggctcagtctcgccctgactcagtcctcggctacgagtggttcccgggtctcgtgggactaggtccggtacacctatccgcctgacctaccgtagggaaacccggtaccaggttcgtaagttacgttgggttcgtacctttaaacctaaccgttttggtaccttaccgttcgggttaacccaaactactcccaaccgacggtacgaaaccgtacccccgaaggttctaactttagtttacgtagtattcgtccgtaacgttaacggcccggtacccggttccgggggttccctacggtacgttcccggtacttttccgtacggttcgtaccgttaaccgtaaccgttcgtaccggtaccaaaccggtaccggtcccctacccgtccgaacccgtaacgtttccgttcggtaccgggtacctccggtaacggtaccggttagaaaccggttactaccggttacggtacgttaacggttacctttacggtttaacgtcggttacctttcggtttacccttttaagtttttaccgttaaccggtttttttccgtttttttaccgtaccgggttttaaccggttacccggtaccgggggttaacccgttccgggttaacccgtaccggtttaaccgttaacccggttccgtaaccccggaccgtaacccgttaacccgaaccccgtttacctacgggttacccctacccgg

SEQ ID NO: 35933 - DNA, 580 bp, Homo sapiens
  misc_feature: GYAE6OF02FFGG7.48.36.D03.1.454.CMB.1.raw
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
  modified_base (376)..(376): a, c, t, g, unknown or other
  misc_feature (376)..(376): n is a, c, g, or t
tcagagtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcggtcaccatcgcctgcactggaaccngcagtgatattggtgcttacaactttgtctctggtaccaacatcacccaggccaaaagtcccccaaggtcagttatttangatgtcactaagcggtcccgtacgggggtccctgacgtcgctttctctcggctcaagtctggcaacncggcctcctgaccatctctcgggcctccgagggcctgaagtactacgacggacctggtaactttagttaactgctttcgttcttattttcgttaacgttttccttttttagtcgtttccggaacgtttgggaccgtaggttccaccgtccgttaggtccacggtaccctaacgggaccccaaccctacggtacttcctaacccg

SEQ ID NO: 35934 - DNA, 711 bp, Homo sapiens
  misc_feature: GYAE6OF02HMZIH.48.36.D03.1.454.CMB.1.raw
  modified_base (257)..(257): a, c, t, g, unknown or other
  misc_feature (257)..(257): n is a, c, g, or t
  modified_base (586)..(586): a, c, t, g, unknown or other
  misc_feature (586)..(586): n is a, c, g, or t
tcagagtatacatacacgaccggtgctcgatttagctgcgtcacgatctctcgttggggggggtctcaggaggcagcactctcgggacgtctccaccatggcctgggctctgctcctcctcagcctcctcactcagggcacaggatccgtgggctcagtctcgccctgactcacgcctcgctcgagtcgtccgggtctccgtggacagtcggtacaccatccgctgcacgtacggaaccagcagtgtatattgggtntacgttaactaacgttttcgtccttaccgttacggtaaccctaactactacccgaacccgtaaggaaccgtaaaaccggtaccccgtaaggtacctaacttttaactttagttagtattacggttactaaacgttaacggtccggaccccgggttccggggttcccgtaggtacgttccggttctttccgttacgtcggtaccttaccgtaagtttccgacgggtacctaaaccgtcccggtccctccgtacgtacctaccgttcggttacgtccggtcaccgtcgtacgtacgagtacgtaccgacgtacttcgtatttacgtacgtntccttattacgttactttacgttaccttttcgtttactcgttacgtacgtacggtaccgttcggtccgtaccgttacgtcggtaccgtaccgaccgtaccgtacccgacccgtcgtctctacccg

SEQ ID NO: 35935 - DNA, 516 bp, Homo sapiens
  misc_feature: GYAE6OF02H9I1E.48.36.D03.1.454.CMB.1.raw
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
  modified_base (510)..(510): a, c, t, g, unknown or other
  misc_feature (510)..(510): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcacgtggaaccgcagtgatattggtgcttacactttgtctctggtacacatcaccaggcaacgtcccaagtcatttattatcgatctcactaagcgccgtccggggtcctgactcgcttcnctgctcatctgcacacgctcctgaccactctcgcggtctccgacgctagacgtancgaggctgtattacttactgcttgttctagttttctaagttttctttgttcgttcgtactgggtaccgtcggtactacccgttctaggtcctacgccgtaacggccctaccgngttacg

SEQ ID NO: 35936 - DNA, 715 bp, Homo sapiens
  misc_feature: GYAE6OF02F4VY1.48.36.D03.1.454.CMB.1.raw
  modified_base (201)..(201): a, c, t, g, unknown or other
  misc_feature (201)..(201): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatccgtgggctcagtctgccctgactcagcctcgctcagtcgtccggtctcctggacngtcggtcaccatccgcctgcacgtacggaaccagcagtgtaattagttggtcgtaccttaactaactttgtcctccgtacggtaaccaacactaccacccgaggacctaaacgtaccccgaaggtctattattatgtatcgtacacgtacgccgtccggtccgggtcctgactcgtcttctcgtcgtctaccgtagtctacggacaaccgtccgtcctacccgtacgaccctacgttcctacggtcgggtcccttaccggacggtaccgtaggaaacgtacgtacggtacggtcgttaagttaactttaccgttacgtacgttaccgtttagtttactttaaccgtttttaccgtttaaccgtttttccctttttgggttaccgttaaccgggtacggttaccggggtacccggtacggttacccgtaacccggttccggttaacgggtccctaacccggtaccccgaaccggtaacccccctaacccggtaccgttaccgtacccttaacccg

SEQ ID NO: 35937 - DNA, 590 bp, Homo sapiens
  misc_feature: GYAE6OF02FSWYC.48.36.D03.1.454.CMB.1.raw
tcagagtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagttcgtccgggtctcctggacagtcggtcaccatccgcctgcacgtcggaacccagcagtgatattggtgcttactaactttgtctcctgtaccacatcacccagacaacgtcccaggtcattatttatgatgctactaagcggtcccgtccggggtcccgtgtactcgtctttcctcgtcgtcctcgaacgtcgtcggcaacgaccgtccctcccgtcgtaccactctcgtcggtcctccgacggtcgtagtaacgactcgacggtcgtagtacttacgttactgtacgttcgttcttacttttacgttacgttttcctttttgttccgtttacgtacgtcgggtacgtcggtctaccgtccgtagttccgacgtaccgtaaccgtacccaacccgtacctcgtaccc

SEQ ID NO: 35938 - DNA, 648 bp, Homo sapiens
  misc_feature: GYAE6OF02G26M1.48.36.D03.1.454.CMB.1.raw
  modified_base (231)..(231): a, c, t, g, unknown or other
  misc_feature (231)..(231): n is a, c, g, or t
  modified_base (408)..(408): a, c, t, g, unknown or other
  misc_feature (408)..(408): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcggtcaccatccgcctgcactggaaccngcagtgattagttggtcgtcttactaactttcgtcttcctacggtaaccaactactaccacccgaggacctaaacgtaccccgtaaggtcctaagtttatttatcgtaatcgtactacgtaacggtccggtcccggtccggggtccctgacgtcgtcttctcgtgcctacgtagtcncggccacgccgtcctccgtcacctactcctcggtcggtcctccgaggtcctagaacgtacgtacgacggtctacgtatttacgtacgtgtacgttcgtttacttacgttttacgtttacgtttttccgttttagttcccgttacggttacggtacgggtaccgttacggtcccgtaccgttaccggtacgtaccgaccgtaacccgtacggtaccccaacccgtctaccggtcctacccg

SEQ ID NO: 35939 - DNA, 729 bp, Homo sapiens
  misc_feature: GYAE6OF02JT95S.48.36.D03.1.454.CMB.1.raw
  modified_base (137)..(137): a, c, t, g, unknown or other
  misc_feature (137)..(137): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagagtatacatacacgaccggtgctcgatttagctgcgtcacgagtctctcttgggggggtctcgaggaggcagcactctcgggacgtctccaccatcggcctgggctctgctcctcctcagcctctacactcgnggaccacgaggctccgtgggctcgacgtctcgaccctgacctcgagccctcgctacaggttcgtaccgggtcctaccgtggacctaggtccggtcaaccncgttcncctgacctcgtacggaccagctgtacgatagtgtacgtcgtactaacttcgtaccgtcgtacggtacctaacctactaccgtacccgacggacctaacgtaccccgaacggtacctaacgtttacttacgtacgtagttacgtacgaaccgttacggaccgggtcccgtaccgggggtccctacgtacgtccgtctccgttacgtcgtcctacgtaacgtcgtacgaccgtacgccgtccgacgtacgcctacgtcgacgtcggctcgacgtcgtagacgtagtaccgtgaccgtattacgttacgtaacgttcgttacgttcgtaacctttcgttttaaccgttacgtttttacccggttttattccgggttaccgtttacggaccgggtttaccgaccgttaccggtttaccctcgggttaacgttcccgtaacggttccccgaacggttaccccaacccggtttctaaccgtcgttaaccccg

SEQ ID NO: 35940 - DNA, 702 bp, Homo sapiens
  misc_feature: GYAE6OF02JFANJ.48.36.D03.1.454.CMB.1.raw
  modified_base (237)..(237): a, c, t, g, unknown or other
  misc_feature (237)..(237): n is a, c, g, or t
  modified_base (559)..(559): a, c, t, g, unknown or other
  misc_feature (559)..(559): n is a, c, g, or t
  modified_base (579)..(579): a, c, t, g, unknown or other
  misc_feature (579)..(579): n is a, c, g, or t
tcagagtatacatacacgaccggtgctcgatttagctgcgtcacgatctctcttgggggggggtctcaggaggcagcactctcgggacgtctccaccatggcctgggctctgctcctcctcagcctcctcactcgagggcacaggatcctgggctcagtctgccctgactcagcctcgctcagtcgtccgggtctcctggacaggtcgtcaccatccgcctcgcacgtacggaaccngcagtgattagttggtcgtacttaactaacgttttcgtccttccgtacggtaaccctaaactactaccgaaccccaagggaccctaaaacggtacccccgaaggttcctaatttactttaacgtgtaacttcgtacctaacgtaacggggtcccggtaccccggttccgggggttccctaggtaccttccggttctttctaccgtcggtaccgtacgtaacgtcgtacggaacaaccggtaacccgtcctacccgtaacgtaccctactccgttccgtcggacctcgagggtcctacggaagttacacgtacgtctaagttntttaactacgtcgtacgttnttcttactttcgttacgtttttctttcgttacgttcggttacgacgggtacgtacggttcctaccgttaccggtacgtcgtaaccgtccccgaacgtaccccacccgtacgtcctacgtaccc

SEQ ID NO: 35941 - DNA, 975 bp, Homo sapiens
  misc_feature: GYAE6OF02IK85W.48.36.D03.1.454.CMB.1.raw
  modified_base (234)..(234): a, c, t, g, unknown or other
  misc_feature (234)..(234): n is a, c, g, or t
tcagagtatacatacacgaccggtgctcgatttagctgcgtcacgatctctcttgggggggggtctcaggaggcagcactctcgggacgtctccaccatggcctgggctctgctcctcctcagcctcctcactcagggcacaggatcctgggctcagtctcgcctgactcacgcctcgctcagtcgtccggtctccgtggacagtcggtcaccactcgctcgctactcggaacngcagtgtatattcggtgtacttaactaacgtttcgtccttccgtacgtaacctaactactacctaacccgacgggtaacctaaaaccggttaccccgtaaagggtaccttaacgttttaaactttacgtacggtaacgttacgtaccgttaaacggtaaaccggtccgggttaccccgggttaccgggggttcccgttacggtaaccgtttcccggttaccgttttccgtacccggtttacggtacccttaccgtaacggtttacccggttacgggtaaccccggtaaaccgggaccccgggtttacccctttaccccggtttaacgaaaccccgtttaccgtttacccggtcggggttaccgggtacccttacccgggaacgggttaccgttaaacgggtaaacgttaccggttacggtaacgggttaccttaacgggtttaaaccgtttaacgttttaaccgtccggtttaccgttttaccgggtttttaacctttaaacggttttttttaaccccgtttaacccgtttttttttacccggtttttttacggttacccgggttttaaaccgggttaaccggggtttacccgggggtttaaaccggtccgggttttaacccccgttaacccgggtttaccggttaaccgggttaacccgtaacccggttaacccccggtaaaacccggttacccccctaaaaccccggtttccggtttacccgtacccctttaaccccgg

SEQ ID NO: 35942 - DNA, 691 bp, Homo sapiens
  misc_feature: GYAE6OF02HD7MK.48.36.D03.1.454.CMB.1.raw
  modified_base (246)..(246): a, c, t, g, unknown or other
  misc_feature (246)..(246): n is a, c, g, or t
  modified_base (404)..(404): a, c, t, g, unknown or other
  misc_feature (404)..(404): n is a, c, g, or t
tcagagtatacatacacgaccggtgctcgatttagctgcgtcacgatctctcgttgggggggggtctcaggaggcagcactctcgggacgtctccaccatggcctgggctctgctcctcctcacgcctcctcactcgagggcacgaggactccgtgggctcgagtctcgcctgactcacgcctcgctcgagtcggtccggtctccgtggacacgtcgtacacactcgctcgctacgtacggaaccngcgtagtagtattacgttggtactacttaactacgtttgtcctcgtacggtaaccaactacgtaccgaccgaggaacctaaaccggtacccgtaaggtactatttaattacgtagtacgtcgtactaacgtacggtccggtaccgggtccgggtaccncgtacgttcgtcgttaccgtcgtacggtccttaccgtaagtccgtacggaccgtaaccgtccggtaccctaccgtacgtacgtacgttccgtacggtccggtactccgtacggtcgtacgtacgcttcggagtcgtagttaacttacgtacgtcgtcttacgttcgttatttacgtacgtttttcgtttcgtaccgtacggttacggtaccgacggtttccgtactacccggttgtaaccggacgtaccgaccgtaaccgacccctaacgtcttaccggaccttccg

SEQ ID NO: 35943 - DNA, 817 bp, Homo sapiens
  misc_feature: GYAE6OF02ITP7V.48.36.D03.1.454.CMB.1.raw
  modified_base (106)..(106): a, c, t, g, unknown or other
  misc_feature (106)..(106): n is a, c, g, or t
  modified_base (125)..(125): a, c, t, g, unknown or other
  misc_feature (125)..(125): n is a, c, g, or t
  modified_base (166)..(166): a, c, t, g, unknown or other
  misc_feature (166)..(166): n is a, c, g, or t
tcagagtatacatacacgaccggtgctcgatttagctgcgtcacgatctctcgttggggggggtctcaggaggcagcactctcgggacgtctccaccatcggtcgnggctcgcgtcctcctcctncgtccctcctacactacggcggacacgaggtaccttccggnggtcctacgcgttcgccgtccgtacgtcctacgccgtcccgtcgtacctcggtacggttcccggggttacccggttccttccgggtacggtaaccgtcgggtttccgtaccccaccgcgttaccggcccttacggtaccgaaaccggttccgggaaaccctgggtacctaagttaggtacgttacgttcgggttactaacctttacgttaccgtttccgtaccgttaccgtacgtacctaccacctcgaaccgtacgaccgtaacgtaccctaagttctattacgttatacgactagtaccgcggtaccgtcggggacccttggggacctcgtacttcgcgttcacgtcgactccgagtcctacggccgtacctaacccgtgtccctacgtccgtactccggtacgtcccggtaggacctacggtacgtacggtaccgtacgttacttacgggtactttaggtaccttgtttacctgtttaccctaggtttttccctttaagtttcccttttaggttaccgtttttcgggtacctttcggggtaaccctcggggttaccttaccgggttccgttaaccgggtccctaccggggtaccctaaccggtaccctaacccgggttccctaaccgtaccgttcgttccctaacccg

SEQ ID NO: 35944 - DNA, 740 bp, Homo sapiens
  misc_feature: GYAE6OF02GMGXE.48.36.D03.1.454.CMB.1.raw
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggacagtcggtacaccagtccgcctgccacgtaggaaccagcagtgattagttggtcgtacttaactaacttttcgtcctccttacggtaacctaacactccaacccaggtacctaaaccgtccccgaaggttactagtttaactttacgtgtaagttcgtactaacgtaacggtccgggtaccccggtccgggggtccctagtactccgtccgttctcgtcggtacctccgaagttccgtaggacctaacccgtaccggtcccttacccgtacgtacctactccgttccggtcgggtacctccgtacggtacgtacgaagtacgtaccgaacggtcttaacgttactttaccgttacgttcggtacttaccggtttactttacgtttaacccgtttagtttttacccgttttaggttacccgttacgggttacgtccggggttaaccgtacgggttaacccgtaccggtttaccggtacgttacccgtacggaaccccgttacgggaaccccctaacccgtcgttacccggtacttaccccgg

SEQ ID NO: 35945 - DNA, 741 bp, Homo sapiens
  misc_feature: GYAE6OF02FGJHP.48.36.D03.1.454.CMB.1.raw
  modified_base (734)..(734): a, c, t, g, unknown or other
  misc_feature (734)..(734): n is a, c, g, or t
tcagagtatacatacacgaccggtgctcgatttagctgcgtcacgatctctcttggggctgggtctcaggaggcagcactctcgggacgtctccaccatggcctggctctgctcctcctcagccctcctcactcaggcacaggatccgtggctcagtctgccctagactcacgccctcgctcgacgtgtcccgggtcttccgtacggacctacggttccggaccaaccgtacgttccgacccttgacccgtacgttacgggaaccccaggtcctaggtacgaattacgttggtcgtaccttactaacctttcgtccttaccgtacggtaccctaacgtactacctacccgacggtacctaaaccgtccccgtaaggtccttaagtttatttagtacgacttcgtacctaacgtacggtccggtcccgttcggggtccctgtaccgttcgctttcgtcgtcggccttaccgaacgttccgtacggaccaaccgtaccgtcccgtacccgtacgacccgtaaccttcccgtaccgtcggtacccgtaccgtacggtaccgtaggaactacgtaccgtaacgtccgttaggttaactttacgtacgttcgttaccttcgtttaccttaacgttttaccttacgtttttccgtttacgttccgttacgtacgtaccggtacggtaccgtaccgtaccgtagtaccgaccgtaccgaccgtaaccggaccctacccgtntacccgg

SEQ ID NO: 35946 - DNA, 750 bp, Homo sapiens
  misc_feature: GYAE6OF02HP3QG.48.36.D03.1.454.CMB.1.raw
  modified_base (622)..(622): a, c, t, g, unknown or other
  misc_feature (622)..(622): n is a, c, g, or t
tcagagtatacatacacgaccggtgctcgatttagctgcgtcacgatcgtctcttgggggctggggtctcaggaggcagcactctcgggacgtctccaccatggcctgggctctgctcctctcagcctctcactcagggcacaggactccgtgggctcagtcctcgccctgactcacgcctcgcctcagtcgtccggtcctcgcgactcgtcgtaccacctctccgtctcgactacggtacgacacgcgtacgtatagtcgttggctacttaactcgtttcgtcctcgtacgtaaccaacgtcctaacccaccggtacgtaaaccgtaaaccccggtaccgtaacggttacttaacgttttattacgtagttactccgttaactaacggtaccggtcccggtacccggtttccgggtaccctacggtccgtccggttaccttccggtaccggtccgtaccgtaccgtaccggttcgtaacccgaccgtaaccgtcccgtaaccccgttccgtaacccgtaccgttaccgtccggttaccgggtcccgttaccgtacccggtaggttacgaacggttactaccggttacggtaacgtcgtacttaacgtttacgttaccgttnttacgttcgtttacgtttactttaccggtttctttttacgttcggttaacgttccggtacgtaccgggtcgtcgttaaccgtccgtacgttccgacgtaccgtccgaacctacccgtacctacgtccg

SEQ ID NO: 35947 - DNA, 684 bp, Homo sapiens
  misc_feature: GYAE6OF02IY2J4.48.36.D03.1.454.CMB.1.raw
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
tcagagtatacatacacgaccggtgctcgatttagctgcgtcacgatctctcttggggtggggtctcaggaggcagcactctcgggacgtctccaccatggcctgggctctgctcctcctcagcctcctcactcgagggcacaggactccgtgggctcagtctcgccctgacctcacgcctcgctcngtcgtccggtctccnggacagtcgtcaccatcgcctgccactacggaaccagcngtgtattagttggtntcttaacgtacgtttcgtcctccgttacggtaccaactctaccacccacggaccgtaaacgtcccgaaggtactaactttacgttactgtactcggtaccaacgtaacggtccggtccccggttcgggtccctaggtactccggtctttcgtcgtcgtacctaccgtagtccgtacggccaacgtccggcccttcccgtagacctactcgtccgtggacctaccggcgtcgtagtacgacgtacgagtcttagtacttacttacgtcgtcgtttacgtttactttactttaccgtttacgtttttcttttaccggcgttttaaccggtacgggttaccggtaccggttacgtttcccgtaaccggttaacgtcccggtaccgaaccggtccccgtaaccggacccctaaccttaccgtccgtaacccg

SEQ ID NO: 35948 - DNA, 805 bp, Homo sapiens
  misc_feature: GYAE6OF02HUW4G.48.36.D03.1.454.CMB.1.raw
  modified_base (258)..(258): a, c, t, g, unknown or other
  misc_feature (258)..(258): n is a, c, g, or t
tcagagtatacatacacgaccggtgctcgatttagctgcgtcacgatctctcgttgggggggggtctcagggaggcagcactctcgggacgtctccaccatggcctgggctctgctcctctcagcctctcactcagggcacaggatccgtgggctcagtctcgccctgactcagccctcgctcaggttcggttcccggggtctccgtagggacctaggttccggtacaccattcccggcctggccacgtacggaaccngcagtgatattggcgtacttaactacgtttcgcttccgtacggtaaccaactactaccaacccgacggaccaaaccggttaccccgaaagggtcctaattttaacgtttagtacgtagttcgtaactaacgtaacggcccgggtacccggttaccgggggttaccctggtacgttccgtccgtttcgttacgtcggtaccttaccgtaacggtccggtaccggaccgtaacccggtacccggtacccttacccgtaccggtaacccgtactttccggtccggtacgggttcccgtaaccggcgggtaacgtacggaaagttacggtaaccgtacgggttcttaacggttattttacgttacggttcgttacgtttacgttttacttacggtttttaacctttacgtttttttcccgttttagtcccggtttacggttacgttaccggggtacgtaccggtttccgttacccggttacggttacgaccgttaacccggacccggttaaccggtaaccccctacccgtacttcccggtaccttacccgg

SEQ ID NO: 35949 - DNA, 682 bp, Homo sapiens
  misc_feature: GYAE6OF02GKHYS.48.36.D03.1.454.CMB.1.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
tcagagtatacatacacgaccggtgctcgatttagctgcgtcacgatctctcttgggggggggtctcaggaggcagcactctcgggacgtctccaccatggcctgggctctgctcctcctcagcctcctcactcagggcacaggatccgtgggctcagtctcgccctgactcacgcctcgctcacgtcgtccgggtctccgtaggactagtcggtcacactcgcctgcactggaaccngcagtnatattggtgacttactaactttcgtctccgtacgtaaccaactactaccacccgaggaccaaacgtaccccgtaaggtctaatttattatagtactcgtacaactaacggcccggtccggtccgggggtcctacgtactcgtccttactcgtcggtcctaccgtaacgttcgtacggaaccaaccgtaccggtccctaccgtcgaaccctacgttccgtcggtcgggtccgtacccggacggtccgtacgtaacgtacgtaccggtaggtctacgttaacttaccttacgtccgttcttacgtttacgtttcttttaaccgttaacgtttttccttttcgttacgttaccggtaccgtcgggtaactacggtcctaacgttccgtacggtactaccggacccggtaccgacccctaacccgtctaccggtactacccg

SEQ ID NO: 35950 - DNA, 860 bp, Homo sapiens
  misc_feature: GYAE6OF02F05MS.48.36.D03.1.454.CMB.1.raw
  modified_base (705)..(705): a, c, t, g, unknown or other
  misc_feature (705)..(705): n is a, c, g, or t
tcagagtatacatacacgaccggtgctcgatttagctgcgtcacgatctctcgttggggggggtctcaggaggcagcactctcgggacgtctccaccatggcctgggctctgctcctcctcagcctcctcactcagggcacaggatccgtgggctcaggtctcgccctgactcacgcctcgctcagttcggtccggtctccgtaggacgtacggtccggtaccaccgtagtccggtccttggaccgtaacgttaacggaaaccgacgtaccgtaaggttacgtagtttaacggtttgggtacgtaccttttaaaccgttaacgtttttccgttacccgttaccccgggttaacctaaacctaaccgttacccgaaccccgtaaccgggtaaaccgtaaaacccggttaacccccgtaaggtttaccgttaaacttttacgttttaaacgttaggttaacttacggtaacctaacgtaaccgggtaccccggggttacccgggttccgggggttacccgttacgtaacgttaccggtttccgtttacctcggttaccggccttaaccgtacggttaccgtcggaccgtaaaccgtacccgtcccgtccaaccggtacctcttaccgttcgtcggtacctcggacggtacgttacgaacgtacttcggaacgttcttaagttacttacgtttaacgcgtttacgttntttaccgtttaacttttcggtttaacctttttcgttttcgttaccggttacgttaccgggacgggtacgttacggtaccgtaccggttaacgttcggtaaccctacgtacccgaccgtaaccccaaccgttaccgtcggttaccaccgtttcccg

SEQ ID NO: 35951 - DNA, 768 bp, Homo sapiens
  misc_feature: GYAE6OF02FOO0W.48.36.D03.1.454.CMB.1.raw
tcagagtatacatacacgaccggtgctcgatttagctgcgtcacgatctctcttgggggctggggtctcaggaggcagcactctcgggacgtctccaccatggcctgggctctgcctcctcctcgagccctcctacactcgagggcacaggacttccgtagggctacgagttccgtcgccctgtacctcgacgtccctcgtctacaggttccggtcccgggttcctaccgtgggacctacggttaccggtccaacccgtagtcccggtaccgtagcctacgtacgggaaaccctggacctaggtagtaacgttagttcggtcgtaccttaacgttaaccgtttcgttccttaccggttaccggtaaaccctaacgtacctacccgaaccggtacggtaaccaaaccggttcccgtaaacggtacttaacgtttaattataacggtcgttacgtacctaacgtacggtcccgtacccggttaccggggccttacgacgtccgtccgttgccgtacgtacctcgtacgtcgtcgaaccgtacccgtaccgtcccgtacccgacgtactaccgtcgtccggtccggtccgttcgacgttcgtacgtacgtctacgtcgtacgtacgttattacttacggtctacgttccgttactttacctttgttaccgtttttcgttcgttaccgttacggtcggtacggtaccggtacgtaccgtaccgttacgtacggttaccgaccgtacccgtaccgacccgtacctacgtaccg

SEQ ID NO: 35952 - DNA, 757 bp, Homo sapiens
  misc_feature: GYAE6OF02F52MP.48.36.D03.1.454.CMB.1.raw
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
tcagagtatacatacacgaccggtgctcgatttagctgcgtcacgatctctcgttggggggggtctcaggaggcagcactctcgggacgtctccaccatggcctgggctctgctcctcctcagcctcctcactcagggcacaggatcctgggctcagtctcgccctgactcacgcctcgctcgagtcgtccgggtctccgtggacngtcggtccaccatcgctgccactcggaaccngctagtgtatagttggtctacttaactacgttttcgtccttccgtacggtaacccaacgtactacccgtaacccggaacggtacctaaaacccgggttaccccgtaaagggttaccttaacgttttaattttacgtacggtattaccggtactaaccgtaaccgggcccggtaccccgggttccggggtaccctggtaccgttcgtaccgtttctcggtacgtccttaccgaagttcgtacggactaaccgtccggtccctacccgtagtaccctagttcctccggtcggccttaccggcggtaccgtagtaacgtacgtacgtacgtacggtttattactttaacctacgttggttacctttcgtttaacgtttacctttttacgtttaccgtttttaccgtttttcggttaccgtaaccgggtaccggttacgggtaaccggtaccggttactcccggttaaccgttggtacctaccggaccctccggtaaccccacccggtacgtctacccgttccg

SEQ ID NO: 35953 - DNA, 773 bp, Homo sapiens
  misc_feature: GYAE6OF02I43MT.48.36.D03.1.454.CMB.1.raw
  modified_base (240)..(240): a, c, t, g, unknown or other
  misc_feature (240)..(240): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggactccgtgggctcagtctgccctgactcacgcctcgctcgaggtcgtccgggtctccgtggacaggtcggtcaccatcgcctgcacgtacggaaccngctagtgacttattgggtactcttaactaacttttcgtccttaccgttcggtaaccctaacgtactaccacccgtaagggaccctaaacggttacccccgtaagggttacctaacttttaacgtttacgtacgtaagttccgtacctaaccggttaaacggtcccggggtacccccggttccgggggggttacccccttcgggtaacgtttccggttcccgtttaccgtttcccgtggtaccccttaccgtaacggttccggtacggaccctaaccgggtcccggtaccccttacccgttacggaaccccttacgttccgtacccggtcgggtccctaccggtacgggtacgtagtaacggtacgttccgacgggttccttaacgtaactttacgttacgtcgttactttccgttactttactttaccgttacgtttttccgtttcgttcgttacggttacgtcgggtacgtcggtccgtaccgttccgtaggttccacgtccgaacgcccctaaccgtcgttcctcctaccg

SEQ ID NO: 35954 - DNA, 693 bp, Homo sapiens
  misc_feature: GYAE6OF02J2O8R.48.36.D03.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (336)..(336): a, c, t, g, unknown or other
  misc_feature (336)..(336): n is a, c, g, or t
  modified_base (652)..(652): a, c, t, g, unknown or other
  misc_feature (652)..(652): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcgagggcacaggactccgtgggctcagtctcgccctgactcagcctcgctcagtggtccgggtctcctggacacggtcgtaccaccngtccgcctgcncgtcggaaccctgcagtgagtcttgggtctcttactacctttgtctccgtacgtacaactctcaccaggaccaacgtacccctaaggtcctatttactttagngtatcgtactacgtaacggtccggcccggttacggggtccctagtaccgttcgtcccgtttcgtcgtcgtccgtacccgtaggttccgcgtaccgtaacccggtaccggccccttaccccgtacgtacccgtacttccgttccggtccgggaccgttaccggcggtaccgtacggtaatacgtccggacggtctacggttaacttcgttaacgtcgttactttcggttactttaccgtttacttttacggttttccgttttcggtaccggttcgtaccggtttaccgggtaaccgtcggttccaccggtttaccgngttaccgcccgtaaccggacccgtacccgaccgttctaccg

SEQ ID NO: 35955 - DNA, 852 bp, Homo sapiens
  misc_feature: GYAE6OF02IFJ09.48.36.D03.1.454.CMB.1.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagagtatacatacacgaccggtgctcgatttagctgcgtcacgatctctcttgggggctggggtctcaggaggcagcactctcgggacgtctccacatggcctgggctctgctcctcctcagcctcctcactcgagggcacgaggactccgtgggctcagttctcgccctgacctcacgtcctcgctcagttcggtccggtctccgtggactagtcgtccacntcgctgcagtacggaaccnggtactagtagtacgttagttcggtacgtacctttaaccttaacgtttccggttccttaccgttacggtaacctaacctacgtaccccacccggtaacgggtaaccgtaaacccggtaccccggtaaaggttccttaacgttttaacgttttaacgttacgtacgtttacgtaacccgtaaacggttaacgggtccccgggtaccccgggtttaccccggggggttacctttaaccgggtaccgttcccgttaccggtttttacccgtcccggttacgggtaaccccttaccggttaaacgggtttcccgtaaccgggtaccgtaaacccgggtacccggtccccgtttacccgtaaccgttacccgtaaccgtttcccggttacggtccgggttaccgtacccggtacggtaccttaacggtaacgtacgtaccgtagttacgtaacgttacttaacgttacgtcgtacgttcgttaacttacgttttactttacgtttttccgtttagttaccgttcggttaccggtacggtccggtaccgttaccgtccgttacggtacgtaccgtaaccgtacccgtaccggaaccccgttaccgtagtacccg

SEQ ID NO: 35956 - DNA, 798 bp, Homo sapiens
  misc_feature: GYAE6OF02GJ1WD.48.36.D03.1.454.CMB.1.raw
  modified_base (230)..(230): a, c, t, g, unknown or other
  misc_feature (230)..(230): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcggtcaccatcgctgcactcggaaccngcagtagattagttggtcgtcttaactaacttttcgtccttaccgttacggtaaccaactactaccgacccgaacggacctaaaaccggttccccaaaggttcctaaagtttaacttttagtacgggtaacggttaccaagggttaaccggtcccggggtaccccttacgggtaaccgggggttccccgtaggtaaccgtcggtccctttcgttccgtcgggtacccttaccgtaaacgtccgtaccgggtaccgaaccgtaccgggtcccttaccccgtcggtacccggttcgttccggtacggggtcccttaccgaacggggtcgtacgggaacgggtacctgggtaaccggtcgttacggttaacgttttactacccggttggacctacgtaccgtactacgtaattcgggaacgtacggaccgtacgaaccgtaacgttaacggtttacggggttacggttaacgggttacccggggggaaccggttaacggggaaacccggtaacggttcccggttaaccgggttaaccccggtttaccggtacggggttccgaaaccccggg

SEQ ID NO: 35957 - DNA, 708 bp, Homo sapiens
  misc_feature: GYAE6OF02IDV7Q.48.36.D03.1.454.CMB.1.raw
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
tcagagtatacatacacgaccggtgctcgatttagctgcgtcacgatctctcttggggggggtctcaggaggcagcactctcgggacgtctccaccatggcctgggctctgctgctgttcatcctcctcactcaggacacagggtcctgggcccagtctgccctgactcagcctgcctccatgtctcggtctactagacagtcgatccaccgtctcctgcacgtacggaaccngcagtgagttggttggtcgttatgtaccttgtacctccgtaggtaaccaaccaaccgacccgagacccaaaaccgaccccctaaacttcttagtatttangacgtactacgaacgtaacgccgtacccgtacgacggtaccgtttacgtaacgtccgtctttccgtacgtcggtaccctaccgtaagtccgtacggaccgaacccgtcccggtcccttaccgtacgtaacctaaccgtttccgtccggtacggtccctaccggacggtcgtaggacggtagtacggacgtcgttagttaacgtttaacgttaaccgtggtaccgtacgtcctagtattacgcgacgacgtacgaaccgtacaaaccgttaggtacggttaccggttaacgggttacccggggaacgggtaaccggggtaaccgtaacggttcccggttaacccggtacccggttacccggtacggtaacccccgg

SEQ ID NO: 35958 - DNA, 818 bp, Homo sapiens
  misc_feature: GYAE6OF02JI966.48.36.D03.1.454.CMB.1.raw
tcagagtatacatacacgaccggtgctcgatttagctgcgtcacgatctctcgttggggggggtctcaggaggcagcactctcgggacgtctccaccatggcctgggctctgctcctcctcacgcctcctcactcgagggcacaggactccgtgggctcagtctcgcctgtacctcacgccgtccgcctcgtacggtcgttcccggggtcctccgttcggaacgacggtcggtaccacctagttccgcctcgaaccgtaccgtacgggaaccacgtcgtaggtacgtaagttacgttcggtacgtaaccttacgttaacgttttccgtacgttccggttaaccgtaacctaaactcgttaccccgaacccggtaacggaaccgtaaaccggttacccccggtaaaggttaccttaaacgttttaactttaccgttaaggtacgttacgttaaccttaaacgggttaaccggtcccgggttaccccgggttcgggggttacccctaggtacccgttacgttcccgttcgtccggttcggtacctaaccgtacgtccgagtaacccgccgtacccggtcctaaccgtcgtaaaccctcgttacccggtcgttccgggtacgtaccgtacggtcgtaacgtaacgttcgtaccgtacggtcgttagtaacctttgtacgttcgtcgtttatacggtttacttacgtttaaccgtttttcgttttacggtaccgttaccgtacgtaccgggtacgttccgtaccgttacgtacggtaccgtacaccggttacctacggaccctacggctttaccgacttccg

SEQ ID NO: 35959 - DNA, 690 bp, Homo sapiens
  misc_feature: GYAE6OF02IW66K.48.36.D03.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
tcagagtatacatacacgaccggtgctcgatttagctgcgtcacgatctctcttggggtggggtctcaggaggcagcactcgtcgggacgtctccaccatggcctgggctctgctcctcctcacgcctctcactcacgggcacgaggactccgtgggctcgagtcctcgccctgactcgagcctcgctcagtcgtccggtctcgtggacngtcggcaccgagtccgctgacacgtacggaaccngcagtgattgtgtcgtacttaactacttgtcctaccgtagtaacctacactaccaccgagaccaaacgtcccgaaggtactagttattagtagattcgtacacgtaacggtccggccggttccgggtcctacgtacgtcctcttcgtcgtcggtcctacgtacgttcgacgtaccgtaaccgccggtaccctccgtacgtaaccgtcttccgtaccgttcggaccctccggtacggtacgtaacgtaacgtaccgtacgtacgtacgttattactttaacgtagttcgttacgttcgtttactttacgtttacgtttttaccgttttacgttttttacgtaccgttaacgggttaccggtacggtaccggtaccggttaccgttaccgtacggttaccgtacgtaacccgtaccggaaccctaacccggtacctacgtacgtaccg

SEQ ID NO: 35960 - DNA, 656 bp, Homo sapiens
  misc_feature: GYAE6OF02F383Z.48.36.D03.1.454.CMB.1.raw
  modified_base (231)..(231): a, c, t, g, unknown or other
  misc_feature (231)..(231): n is a, c, g, or t
tcagagtatacatacacgaccggtgctcgatttagctgcgtcacgatctctcttgggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtgacagtcggtcaccatcgcctgcactggaaccngcagtgatattggtgtcttaacaactttgtctccgtaggtaccaacatccacccaggacaaacgtaccccaaggtctatttatttactgtatgtacactaagccggtaccgtccgggggtcctgactcgcttctcgtcggcctactagtcgtcgacaaccgaccggcctcccgtagaccacttccgtcgtcggtcctccgaacggctaggacgtacgtacgtaggtactagtaactttacgttaccgttgtaccgtttagttacctttaacttttactttaaccgttttccttttttacggtcctttacgggtaaccggttacgggtaccgtaccggttacctaccggttaccgttaacggtaccgtaaccggtacccgtaaacccggtacccctaaccccgtacttaccggtacccttaacccg

SEQ ID NO: 35961 - DNA, 675 bp, Homo sapiens
  misc_feature: GYAE6OF02JMXMB.48.36.D03.1.454.CMB.1.raw
  modified_base (259)..(259): a, c, t, g, unknown or other
  misc_feature (259)..(259): n is a, c, g, or t
  modified_base (477)..(477): a, c, t, g, unknown or other
  misc_feature (477)..(477): n is a, c, g, or t
  modified_base (642)..(642): a, c, t, g, unknown or other
  misc_feature (642)..(642): n is a, c, g, or t
  modified_base (667)..(667): a, c, t, g, unknown or other
  misc_feature (667)..(667): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggactccgtgggcctcagttctcggccctagactcacgcctcgcctcaggttcggtccgggtctccgtggactaggtccgtcaccactccgtaccgtgtactacgtcggaaaccncgtcgtacgtacgtagttcggttcggtactacgttaacctaacgtttcgtccttaccgtacggtaccactatcccaaccgaggtactaaccgtcccgtaaggtctatttacttagcgtagttcacctacgtaacgccggtccgtacggggttccagttctacgtcgttcacggtcgcttccgtacgcgtacgctaaccgcgtaccctccgagaccctntccggtgttccggcttaccgacggtacacgtagtaccgtcgtaccgtcgtagttactacgttacgtcgtttacgtcgtttacgttaacgtttcgttaccttttcgttacggttccgttacggttaccgtccgggtacctccggttacaccggtacgttcggtacncccggtaccaccgtaccctaaccgnttaacccg

SEQ ID NO: 35962 - DNA, 736 bp, Homo sapiens
  misc_feature: GYAE6OF02GDNRF.48.36.D03.1.454.CMB.1.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcgagggcacaggatccgtgggctcagtctcgccctgactcacgcctcgctcaggtcgtccgggtctctggactaggtcggtcaccngtcgcctgcacgtacggaaccngcgagtcgattagttggtgtactttaacctaacgttttcgtccgttccgtacggtaaccaactactacccaaccgaggtacctaaacgttccccgaaaggtctagtttaatttacgtnacgttgtacctaacgtacggtcccggccggttccgggggtcctagtactccgtcttntccgtaggcctacgacgttcgttacggaccgtaaccgccggttccctccgtaccgtaccgtactaccggtccgttaccgggtcccttaccggtacggtaccgtacggtaaacgtacgtaccggtacgggtctttaacgtactttacttaccgtagtccgtttgttttacctttagttttaccgtttacgtttttctttttacgttaccggtttacgttaaccggtcgggtaccgtacggttacccggttaccgttaccggtacggttacccgtacgtacccgtaaccggtccctaacccgtacgtaccggttcttacccgg

SEQ ID NO: 35963 - DNA, 764 bp, Homo sapiens
  misc_feature: GYAE6OF02IL6QW.48.36.D03.1.454.CMB.1.raw
tcagagtatacatacacgaccggtgctcgatttagctgcgtcacgatctctcttgggggctggggtctcaggaggcagcactctcgggacgtctccaccatggcctgggctctgcctcctcctcagcctctcactcgaggcacaggactccgtggctacgagtctcgccctgactcacgtcctcgactcgtaggttcggtccgggtcctccgtaggacaggttccggcaaccgtgtccgccgtcgccgtacgtacggaaccgagcgtaagtacgtattacgtggtacgtacttaacgttacgtttcgtccgtaccgttacgtaacaacgtactaccgaaccgtacgaacgtaaccgtacccgtaacggtactaacgtttacttagtgtacgtcgtactacgtaacggtccggtaccggtcgggtacctacgacgttccgtaccgttcgtcgtacggttaccgaccgttaacgtcggttaccgaaccgttaaccgggaccgtttaccccggtacccgtaaccgtaacccgtacgtttaccgtttccgggacggttaccgtccgggtaaccggtagttaaaccgggtaacgttaacgtccggtaaacggtccgttaaacgttaacgtttaacgttacgtcgttaccgttaagttcggttactacggttcgacgttacggacgtaccgtacgttacggttcgttacgggttcggacggtaccgggtaacgccgtaacggttaccgcggtaccgttcggtccgtaacg

SEQ ID NO: 35964 - DNA, 647 bp, Homo sapiens
  misc_feature: GYAE6OF02H62HI.48.36.D03.1.454.CMB.1.raw
  modified_base (234)..(234): a, c, t, g, unknown or other
  misc_feature (234)..(234): n is a, c, g, or t
tcagagtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcgtcaccatcgcctgcacgtcggaaccngcagtgatatggtgacttacaactttgtctctagtaccaactatccaccagacaaacgtcccgaaggtctatttattatgatgtacacgtaacgccggtaccgtccggggtcctagactcgtcgttactcgtcggtacctaccgtaagttcgtacgacctaaccgtaccggcccttacccgtacggacctaactccgttacgtcggtacctaccgtacggcgttaacgtaacgacgtaccgtacggtacgtagtactttaacttacgtcgtacttcggtttacttattttaccgttaagtttttcccgttttagttccgttacggtaacgtaccgggtacgtaccggttacgtacccgttaccgttaggacccgtacgtacccgtaaccggaaccctaccccgtagttacccg

SEQ ID NO: 35965 - DNA, 905 bp, Homo sapiens
  misc_feature: GYAE6OF02HDPKC.48.36.D03.1.454.CMB.1.raw
  modified_base (283)..(283): a, c, t, g, unknown or other
  misc_feature (283)..(283): n is a, c, g, or t
  modified_base (737)..(737): a, c, t, g, unknown or other
  misc_feature (737)..(737): n is a, c, g, or t
tcagagtatacatacacgaccggtgctcgatttagctgcgtcacgatctctcttggggggggtctcaggagcagcactcgtcgggacgtctccaccatggcctgggctctgctcctcctcagccttcctcaactcgagggcacaggatccgtgggctcagttctacgcccgtgactcacgtccgtccgctctacggttcgttccggggtccttaccgtagggaaccgtaggttccggttccaaacctacgttccgccttaggactaccggtaacggaaaccgngacgtagtgtaattagttcggtacgttaccttaacgttacttttacgttccgttaccgttacggttaacccaacttaccgtacctaacccggtaacggaaccgtaaaccgtaccccggtaaaccgggtactttaacgttttaacgttttaacgtacgttacgttacgttacctaaccggttaaccggtcccgggtaccccggtttcccgggggttaccttacgggtacccgtttcttccgttacccgtttcgggttaccgtaccgttaccgtttaacgtaccggtttacggaacccggtaaccgttacccggtacccgttaccccgtttacgaaccgttaacggttcccgtttcgttacggggttcctaaccgggtacgttacggttaacgaaacgttcgttaaccgacggttaccttaacggttacttttacgttaccgttgtacccggtttnttttaccgtttacggtttttacctttacgttttttccggtttttacgtaccgttttacgggaccgtttacgggtccctttacgggtcccgttaccgttaacgtaccggtaccgtaccctaccggttaaccgaacccccgtacggttccgtttacgaccctttaaccgg

SEQ ID NO: 35966 - DNA, 681 bp, Homo sapiens
  misc_feature: GYAE6OF02GT52Y.48.36.D03.1.454.CMB.1.raw
  modified_base (200)..(200): a, c, t, g, unknown or other
  misc_feature (200)..(200): n is a, c, g, or t
  modified_base (249)..(249): a, c, t, g, unknown or other
  misc_feature (249)..(249): n is a, c, g, or t
tcagagtatacatacacgaccggtgctcgatttagctgcgtcacgagtctctcttggggggggtctcaggaggcagcactctcgggacgtctcaccatggcctgggctctgctcctcctcagcctcctcactcagggcacaggatcctgggctcagtctgccctgactcagcctcgctcagtgtccgggtctcctggacngtcggtcaccatcgcctgcacgtacggaaccagccagtgaatattggtnccttacaacttttgtctccgtggtaccaactatccaccaggacaacgtcccaaggttcatttattatgtatcgtctactacgccgtccgtacggggtccctgacgttcgtcttctacgtcgtaccgtacctaagtcgtacggacctaaccgacccggtcccttcccgtacgtacccgtacttccttcggtacgggtccctaccgacgggtcttaacggaaacggtacttaccgagggtcttaacggtacttttaacgttacttcgtacgtttcgttttaccttagtttttaccgttacgttttttaccttttcggttaccgtttacggaaccggttacgggtaccgtaccgggtttccaacccggttccgtaacgttaccgaccggtaacccgacggtaacccccacccgtttacgtccgtaccttacccgg

SEQ ID NO: 35967 - DNA, 768 bp, Homo sapiens
  misc_feature: GYAE6OF02HVXTF.48.36.D03.1.454.CMB.1.raw
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
  modified_base (378)..(378): a, c, t, g, unknown or other
  misc_feature (378)..(378): n is a, c, g, or t
tcagagtatacatacacgaccggtgctcgatttagctgcgtcacgatctctcttggggtggggtctcaggaggcagcactctcgggacgtctccaccatcggcctgggctctgcctcctcctcacgcctcctcactcgacggcacgacggtacttccgtgggctacgtggtctccgcccgtagacctcgacgtcctcgctcgtacgttcggtccggtctccgtggactcggtcgcaacnctcgctgcacgtacgaccagctagngtattagtcgtacgtacttacgttacgttcgtccgtacttcggtaaccaagttactacccgtaaccgcgtaaaccgaaccgtaccccgtaaaggttacctaattttatacggtnttaaccgacgtacctaaacgggaccgggaccgggttcccggttaaacccgggtccgtgtaaccggttccgtaccgtttagtccggtacgttaccctaaccgtcgtttacggcgaaacccgtccggacccgtccgtacccgtaacgtaccgttcgtcgtaccgtcggtaccgtagtccggtactacgtaaacgtcggtacgttacgtcgtacgttcttaacgttccggtacttcgttacgttaccttacgtttaccgtttaccgtttttcgtttaccgttaaccgttacggttaccggtacggtacccggtacggtttaccggtacgttcccggtaccgtaccggtacccgtacccgacgttacccccgtaattacccggtcttaacccgg

SEQ ID NO: 35968 - DNA, 634 bp, Homo sapiens
  misc_feature: GYAE6OF02FUTZ9.48.36.D03.1.454.CMB.1.raw
  modified_base (246)..(246): a, c, t, g, unknown or other
  misc_feature (246)..(246): n is a, c, g, or t
  modified_base (370)..(370): a, c, t, g, unknown or other
  misc_feature (370)..(370): n is a, c, g, or t
  modified_base (523)..(523): a, c, t, g, unknown or other
  misc_feature (523)..(523): n is a, c, g, or t
tcagagtatacatacacgaccggtgctcgatttagctgcgtcacgatctctcttggggggggtctcaggaggcagcactctcgggacgtctccaccatggcctgggctctgctcctcctcagcctcctcactcagggcacaggactcctgggctcagtctcgccctgactcagcctcgctcagtcggtcccgggtctccgtggactaggtcggtaccaccatccgcctgccgtacgtacggaaccngccgagtgattagttggtcgtcttaacctaacgttttcgttccttcccgttggtacccaaactactccgaacccgtaggtaccgaaacgttccccgaaggttcctagtttaatttatgtagttntactacgtaaggtccggtaccgtccgggggtccctgactcgtcttctcgtggtcctactagtctcggctaaaccgcggccctcccgtacgtaccagttcctacgtcgggtacctcgcggtcagtacgtacgtgacgtcgtacgtattacttcngtcttgtttcttagtttcgttacgtttccttttgtcgttcgtacgtcggtacgtcggtcaccgtcgtagtccgaccgtccgaccgtcccaacccgtcttccgacttacccg

SEQ ID NO: 35969 - DNA, 899 bp, Homo sapiens
  misc_feature: GYAE6OF02HNMI7.48.36.D03.1.454.CMB.1.raw
  modified_base (215)..(215): a, c, t, g, unknown or other
  misc_feature (215)..(215): n is a, c, g, or t
tcagagtatacatacacgaccggtgctcgatttagctgcgtcacgatctctcgttggggggggtctcaggaggcagcactctcgggacgtctccaccatggcctgggctctgctcctctcagcctcctcactcgagggcacgaggatccgtgggcttcgagttcgtcgcccgtgactcacgtcctcgctacagttcgtccgggtctccgtggacnggtcgtcacctacgtcgctgcctacgtcggaccagacgtagtacattagttacggtgtaccttaacgttaaccgtttgttaccgttaccgtacggtaacccaaacgtacttaccgaacccgtacggacctaaaaccgtaccccggaaaggttaccttaacgtttagtttaacgtgttacgttacgttacgaacgttaaccggccggttaaccccggtttcggggggtacccttaggtacgtcccgtttcgtcccgttacgttacggacccgttaccgtaacgttaccggtcggtaaaaccgtacccgggtacggttacccccgttacctaccggttaaccctaccggttaccggtcggttaacccggggccttaacccgggtacgggttaccgttaaacgggtaacttaaccggtaccggtacgggttaacccgttagttaaaccgttttaccgttagttaccgtacccgttttagggttttaaccttaacgtttttttaacccggttaacgtttttttcccgttttttaaaggttcccggtttaacggtaaccggggtttacggtaacccggggttaccggtttccccggaaccggtttttacccggaacgggtaccgttaacccgacccgggttaaacccgaccccgttaacccggttacgtcccgttaccgttaaccccgg

SEQ ID NO: 35970 - DNA, 727 bp, Homo sapiens
  misc_feature: GYAE6OF02HY85B.48.36.D03.1.454.CMB.1.raw
  modified_base (265)..(265): a, c, t, g, unknown or other
  misc_feature (265)..(265): n is a, c, g, or t
  modified_base (720)..(720): a, c, t, g, unknown or other
  misc_feature (720)..(720): n is a, c, g, or t
tcagagtatacatacacgaccggtgctcgatttagctgcgtcacgatctctcttggggggggtctcaggaggcagcactctcgggacgtctccaccatggcctggctctgctcctcctcagcctctcactcagggcaccgtaggagtccgtgggctacgagttcgcgcccgttgacttcgacgcctgaccttcgaggttcggtcccgggttctccgtggacctaggtccggtcaaccacgtcgaccgtgctaacgtacggaaccnggacaggtcgtagtagttcggtatccgttaacaacgttttcgtccttaccgttacggtaaccaacgtataccgaacccgagggtactaaaaccggtaccccgtaaggttcctaaattttacttaagttacgtacgttagtcaaaccggttagccgggtacccgtccgggggttaccctacgtacgttcgtactttctacggtcggtactaccgtaacttcgtacgggacaaaccggtccggtacctccgtacctaccgtacttaccgtcgtaccgggacgttaccgacgtaccgaggtaaacacgtcgaacgtcgtagtacttacgtactggtactttacgttactacctttagttaccttttcgtttcgttacgttacgtccggtagtaccgtacggacggtacctaggtacgtacctacggtacgaccgtcccgtaaaccgtccgttaccgtntaacccg

SEQ ID NO: 35971 - DNA, 767 bp, Homo sapiens
  misc_feature: GYAE6OF02JG8A4.48.36.D03.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
tcagagtatacatacacgaccggtgctcgatttagctgcgtcacgatctctcttggggggggtctcaggaggcagcactctcgggacgtctccaccatggcctgggcctctgctcctcctcagccctctcactcgaggccacgaggatccgtgggctcgagtcctcgccctgacctcacgcctcgctcgacgtcggtccggtctccgnggacctaggtcgtacacatccgcctgctacgtcgaccngcgagtcgatagtgtcgtacttactacgttcgtcctcgtacgtaaccactacgtcctacccgaggtaacctaacggtaccccgtaaggtcctaagtttacgtttacgacgtactcgtaacctacgtaaccggtccggtaccggtccggggtacctacgtacgttcgtccttccgtcgtcgtaccgtacgttaacgtcgtaacggacctaacccggccgttacccgtcctaccgtacctccgtcgtcggtcggtcctacggagtaccgagtaacgtgccgtagtcgtagtttacgtaacgtttcgacggttaccttacgtttaccgtttacgttttaccgtttaccggtttttacccgttttcggttacccgggttaccggttaaccggtcccggggttaaacccggttccggttaacccggtttacccggtttacggttaaccccgggttacccgaacccggttaacccgtaacccggtacccctaaacccggttcccgttaccggtttaaccccgtccgg

SEQ ID NO: 35972 - DNA, 822 bp, Homo sapiens
  misc_feature: GYAE6OF02FT9G1.48.36.D03.1.454.CMB.1.raw
  modified_base (697)..(697): a, c, t, g, unknown or other
  misc_feature (697)..(697): n is a, c, g, or t
tcagagtatacatacacgaccggtgctcgatttagctgcgtcacgatctctcttgggggctggggtctcaggaggcagcactctcgggacgtctccacatggcctgggctctgctcctcctcagcctcctcactcgagggcacgaggactccgtgggctcagtcctcgtccctgactcagcctcgctcgagtcgtccggtctccgtggactacggtccggtcaccgtactccggcctcgcaccgtcggaacctggacgagtgtacttacggtttgggtacgttaccttaacgttaacgttttcggtacccgttaccgttacgggtaaacccctaacgtacttaccccgaaccccgaacgggacctaaaaaccgggttccccccgtaaaaggggtttccccttaaagtttttaacgttttaaacgtcggttaacgtttcggttaacccctaaaccggttaaacggggccccggggttacccccgggtttaccgggggggttccccttacgggtaccgttccggttccgtttccgttaccgtcggggtaacctaccgttaagggtccgtacgggttaaccaccgggtacccgtaccccgttcccgtagtaaccctacgttccggttacgtccgggtcccgtacgtcgggtacttacggaacgtcgtacgaggttccttaggtaactttagtacccgttntaccgttgtacgttacgtactcggaccgtagcctacgtaccgttacggttccggttaggggttcccggtagggacgggtacgtacctcgggtacctacccgggtacttaccgggtaacctcccgg

SEQ ID NO: 35973 - DNA, 719 bp, Homo sapiens
  misc_feature: GYAE6OF02HZ2DC.48.36.D03.1.454.CMB.1.raw
  modified_base (556)..(556): a, c, t, g, unknown or other
  misc_feature (556)..(556): n is a, c, g, or t
tcagagtatacatacacgaccggtgctcgatttagctgcgtcacgatctctcgttggggggggtctcaggaggcagcactctcgggacgtctccacatggcctgggctctgctcctcctcagtcctctcactcgacgggcacgaggactccgtgggactcgacgtctcgccctgactcacggcctacgctacgaggttccggtccgggtactccgtacggactacggtcggtacacctagtccgcgtcgacgtaacgtacggaaccgtcggactaggtccgttaattcgtacgggttctaccgttaacgtacgtttcgtccttccggtagtaacccatccgtacgaaccctagaaccgtaacgttcccgtaaggtcttagttaacttacgagtacgtacgtacgtaacctacggggtcccgtacggtccggtctacgtataccgtcgttccgtcgtacgtaccgttacgacgttcgaacgtaccgtacgacccggttcctaccgtacggtaaccctcggttacgtccggtacgttccgacggacgtgttaaccggntaaccgtagtacgggtcttaacgtacttaccgtacgtcggttactacgttcgttaaacgttcgtttacgttttcgttcgtaacgttaccggcggtacgtccggttacgccgtacgtcgtacgtccgacgtaccgccgtaccgtaaccgtctaccgtgtacccg

SEQ ID NO: 35974 - DNA, 182 bp, Homo sapiens
  misc_feature: GYAE6OF01C6LFN.52.52.E08.1.454.CMB.1.raw
  modified_base (164)..(182): a, c, t, g, unknown or other
  misc_feature (164)..(182): n is a, c, g, or t
tcagcgcagtacgacacgaccggtgctcgatttagtcgagctctctcggcgggcacgaccggtgctcgatttagtcacgcgagaagggaaggggctggccctgacgtgtttctgttcccgaccctctctatacgatcgctgagcgggctggcaaggcgcatagnnnnnnnnnnnnnnnnnnn

SEQ ID NO: 35975 - DNA, 183 bp, Homo sapiens
  misc_feature: GYAE6OF01CULO0.52.52.E08.1.454.CMB.1.raw
  modified_base (166)..(183): a, c, t, g, unknown or other
  misc_feature (166)..(183): n is a, c, g, or t
tcagcgcagtacgacacgaccggtgctcgatttagtcgagctctctcggcgggcacgaccggtgctcgatttagtcacgcgagaaagggaaagggcctggccctgacgtgtttctgttcccgccctcctctatacgatcgctgagcgggctggcaaggcgcatagnnnnnnnnnnnnnnnnnn

SEQ ID NO: 35976 - DNA, 130 bp, Homo sapiens
  misc_feature: GYAE6OF01DZGTE.52.52.E08.1.454.CMB.1.raw
  modified_base (130)..(130): a, c, t, g, unknown or other
  misc_feature (130)..(130): n is a, c, g, or t
tcagcgcagtacgacacgaccggtgctcgatttagtcgagctctcccgcgagagagctcgactaaatcgagctgcctggtcaaggactacttcctatacgatcgctgagcgggctggcaaggcgcatagn

SEQ ID NO: 35977 - DNA, 736 bp, Homo sapiens
  misc_feature: GYAE6OF01CC365.52.52.E08.1.454.CMB.1.raw
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
tcagcgcagtacgacacgaccggtgctcgatttagtcgagctctctcggcgggggtgggtccaggaggcagaacctctgggtgtctcaccatggcctggactccctctacttcctccccctcctcactctctgcacaggctctggacgtcctcctatgagctagacacacgcccacccgtcggtgtcacgtccgtaccccgaggaccacggacgccaaggactcacctgtccgtagtaggagtattcttcgtacgtactaaaaccgttntcggtactttagtacgtacccganacgaaggtaacgccgacggtaccctacggtcccgttggtcggttggagtaaattaacggttaacggtaacggacctaggtacgggaaggtcccggtaccgtacggtacggggtaccttcccggagaccggttacgtgtttccgcgtcgaccgtacccacgtacgacggtaacctacgtacgtcctacgttacgacctagtaccgtaggtacgggtaccgacgggacgtaacgacgggaacgggtacgacgacgttaccgacgtactaccgtagtaccaactaagaccgtaaaggctaagttcgtagtttcgttctacgtttctacgtccgtactaacggggtcgtaaccggaccgttacccgtacccgttacggtacgtaccgacccggtaacccgtaacccgaacccccaaggttacccgtactccccgttagttccccccg

SEQ ID NO: 35978 - DNA, 807 bp, Homo sapiens
  misc_feature: GYAE6OF02F5EIQ.52.52.E08.1.454.CMB.1.raw
  modified_base (254)..(254): a, c, t, g, unknown or other
  misc_feature (254)..(254): n is a, c, g, or t
tcagcgcagtacgacacgaccggtgctcgatttagtcgagctctctcggcgggggtgggtccacggaggcagaactctgggtgtctcacctagtggcctggatccctctacttctccccctcctcactctctgcactagggctctagaggtcctcctatgacgtctggacacagccaccctacggtgtcagtggtccccaggacaggacggccaggactcacctggctctggagatattctcgtcaaaccgttntgcctttagttcgggtaccacgtcaagtaagcctaaggccacgggtcccctagtacggttgggtcgacttaactacgtaaacgggactaacggtgacggaacggtcccgtacgaagggtacttcccttagaacgtcgtagttccgtcgtacgggtccttacccgaccgttcggaagggtacctaacgttaggtaccgtaccggttttacggaacccgtacttaccgtaacgggttacgggaacgttcccgaacgggtacggaaacggtaacggggtaaccggtaacgggaccgttaacggaacccgttaaccgtaacgtttacggtttaaccgaaacttaccgaaaaccacgggtaacctaacggaccgttagggtttaccggtttacgtttaacggttcgtttaccgttaccgtaacgtaaacggttaccggggaacgtaacggggtaccctaacccgggttaccggtaacgggtttcccaacgggttacccccgaacggttacccccgaaccccggttaacgttccggttaccccgtaaccgttaccccgg

SEQ ID NO: 35979 - DNA, 154 bp, Homo sapiens
  misc_feature: GYAE6OF01C5DU6.51.9.A09.1.454.CMB.1.raw
  modified_base (152)..(154): a, c, t, g, unknown or other
  misc_feature (152)..(154): n is a, c, g, or t
tcagcgatcgtatacacgaccggtgctcgatttagcgagacgcgcagggcacgaccggtgctcgatttagagtgctacgaagggaagggcagcgtcactctgttcccgccctcctctcgtagcactctgagcgggctggcaaggcgcatagnnn

SEQ ID NO: 35980 - DNA, 173 bp, Homo sapiens
  misc_feature: GYAE6OF01DQIW5.51.9.A09.1.454.CMB.1.raw
  modified_base (153)..(173): a, c, t, g, unknown or other
  misc_feature (153)..(173): n is a, c, g, or t
tcagcgatcgtatacacgaccggtgctcgatttagcgagacgcgcagggcgacgaccggtgctcgatttagagtgctacgaagggaagggcagcgtcactctgttcccaccctcctctcgtagcactctgagcgggctggcaaggcgcatagnnnnnnnnnnnnnnnnnnnnn

SEQ ID NO: 35981 - DNA, 152 bp, Homo sapiens
  misc_feature: GYAE6OF01EH5GC.51.9.A09.1.454.CMB.1.raw
  modified_base (152)..(152): a, c, t, g, unknown or other
  misc_feature (152)..(152): n is a, c, g, or t
tcagcgatcgtatacacgaccggtgctcgatttagcgagacgcgcagggcacgaccggtgctcgatttagctacgactgcaagggaagggcagcgtcactctgttcccacctcctctcgtagcactctgagcgggctggcaaggcgcatagn

SEQ ID NO: 35982 - DNA, 163 bp, Homo sapiens
  misc_feature: GYAE6OF01DN48P.51.9.A09.1.454.CMB.1.raw
  modified_base (153)..(163): a, c, t, g, unknown or other
  misc_feature (153)..(163): n is a, c, g, or t
tcagcgatcgtatacacgaccggtgctcgatttagcgagacgcgcagggcacgaccggtgctcgatttagagtgctacgaagggaaagggcagcgtcactctgttcccaccctcctctcgtagcactctgagcgggctggcaaggcgcatagnnnnnnnnnnn

SEQ ID NO: 35983 - DNA, 156 bp, Homo sapiens
  misc_feature: GYAE6OF01D6URE.51.9.A09.1.454.CMB.1.raw
  modified_base (153)..(156): a, c, t, g, unknown or other
  misc_feature (153)..(156): n is a, c, g, or t
tcagcgatcgtatacacgaccggtgctcgatttagcgagacgcgcagggcacgaccggtgctcgatttagagtgctacgaagggaaagggcagcgtcactctgttcccgccctcctctcgtagcactctgagcgggctggcaaggcgcatagnnnn

SEQ ID NO: 35984 - DNA, 151 bp, Homo sapiens
  misc_feature: GYAE6OF01CUO7L.51.9.A09.1.454.CMB.1.raw
  modified_base (151)..(151): a, c, t, g, unknown or other
  misc_feature (151)..(151): n is a, c, g, or t
tcagcgatcgtatacacgaccggtgctcgatttagcgagacgcgcagggcacgaccggtgctcgatttagtcgatagtgaagggaagggcagcgtcactctgttcccgcctcctctcgtagcactctgagcgggctggcaaggcgcatagn

SEQ ID NO: 35985 - DNA, 155 bp, Homo sapiens
  misc_feature: GYAE6OF01DO31P.51.9.A09.1.454.CMB.1.raw
  modified_base (153)..(155): a, c, t, g, unknown or other
  misc_feature (153)..(155): n is a, c, g, or t
tcagcgatcgtatacacgaccggtgctcgatttagcgagacgcgcagggcacgaccggtgctcgatttagagtgctacgaagggaaagggcagcgtcactctgttcccaccctcctctcgtagcactctgagcgggctggcaaggcgcatagnnn

SEQ ID NO: 35986 - DNA, 192 bp, Homo sapiens
  misc_feature: GYAE6OF01AH167.51.9.A09.1.454.CMB.1.raw
  modified_base (188)..(192): a, c, t, g, unknown or other
  misc_feature (188)..(192): n is a, c, g, or t
tcagcgatcgtatacacgaccggtgctcgatttagcgagacgcgcagggcacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnnnn

SEQ ID NO: 35987 - DNA, 161 bp, Homo sapiens
  misc_feature: GYAE6OF01BKUF3.51.9.A09.1.454.CMB.1.raw
  modified_base (154)..(161): a, c, t, g, unknown or other
  misc_feature (154)..(161): n is a, c, g, or t
tcagcgatcgtatacacgaccggtgctcgatttagcgagacgcgcagggcacgaccggtgctcgatttagtcacgcgagaaagggaagggcagcgtcactctgttcccaccctcctctcgtagctactctgagcgggctggcaaggcgcatagnnnnnnnn

SEQ ID NO: 35988 - DNA, 153 bp, Homo sapiens
  misc_feature: GYAE6OF01A6GQP.51.9.A09.1.454.CMB.1.raw
  modified_base (153)..(153): a, c, t, g, unknown or other
  misc_feature (153)..(153): n is a, c, g, or t
tcagcgatcgtatacacgaccggtgctcgatttagcgagacgcgcagggcacgaccggtgctcgatttagagtgctacgaagggaaagggcagcgtcactctgttcccgccctcctctcgtagcactctgagcgggctggcaaggcgcatagn

SEQ ID NO: 35989 - DNA, 154 bp, Homo sapiens
  misc_feature: GYAE6OF01BXYB1.51.9.A09.1.454.CMB.1.raw
  modified_base (152)..(154): a, c, t, g, unknown or other
  misc_feature (152)..(154): n is a, c, g, or t
tcagcgatcgtatacacgaccggtgctcgatttagcgagacgcgcagggcacgaccggtgctcgatttagctacgctctaagggaagggcagcgtcactctgttcccaccctcctctcgtagcactctgagcgggctggcaaggcgcatagnnn

SEQ ID NO: 35990 - DNA, 155 bp, Homo sapiens; identical to SEQ ID NO: 35985
  misc_feature: GYAE6OF01AX3RB.51.9.A09.1.454.CMB.1.raw
  modified_base (153)..(155): a, c, t, g, unknown or other
  misc_feature (153)..(155): n is a, c, g, or t

SEQ ID NO: 35991 - DNA, 153 bp, Homo sapiens
  misc_feature: GYAE6OF01EJTDR.51.9.A09.1.454.CMB.1.raw
  modified_base (153)..(153): a, c, t, g, unknown or other
  misc_feature (153)..(153): n is a, c, g, or t
tcagcgatcgtatacacgaccggtgctcgatttagcgagacgcgcagggcacgaccggtgctcgatttagagtgctacgaagggaaagggcagcgtcactctgttcccaccctcctctcgtagcactctgagcgggctggcaaggcgcatagn

SEQ ID NO: 35992 - DNA, 153 bp, Homo sapiens; identical to SEQ ID NO: 35988
  misc_feature: GYAE6OF01E234A.51.9.A09.1.454.CMB.1.raw
  modified_base (153)..(153): a, c, t, g, unknown or other
  misc_feature (153)..(153): n is a, c, g, or t

SEQ ID NO: 35993 - DNA, 154 bp, Homo sapiens
  misc_feature: GYAE6OF01CJVCQ.51.9.A09.1.454.CMB.1.raw
  modified_base (153)..(154): a, c, t, g, unknown or other
  misc_feature (153)..(154): n is a, c, g, or t
tcagcgatcgtatacacgaccggtgctcgatttagcgagacgcgcagggcacgaccggtgctcgatttagtcacgcgagaaagggaagggcagcgtcactctgttcccgccctcctctcgtagcactctgagcgggctggcaaggcgcatagnn

SEQ ID NO: 35994 - DNA, 188 bp, Homo sapiens
  misc_feature: GYAE6OF01ECSL1.51.9.A09.1.454.CMB.1.raw
  modified_base (187)..(188): a, c, t, g, unknown or other
  misc_feature (187)..(188): n is a, c, g, or t
tcagcgatcgtatacacgaccggtgctcgatttagcgagacgcgcagggcacgaccggtgctcgatttagctctacgctcagggcacgaccggtgctcgatttagagtgctacgaagggaagggcagcgtcactctgttcccaccctcctctcgtagcactctgagcgggctggcaaggcgcatagnn

SEQ ID NO: 35995 - DNA, 153 bp, Homo sapiens; identical to SEQ ID NO: 35988
  misc_feature: GYAE6OF01DD3M2.51.9.A09.1.454.CMB.1.raw
  modified_base (153)..(153): a, c, t, g, unknown or other
  misc_feature (153)..(153): n is a, c, g, or t

SEQ ID NO: 35996 - DNA, 188 bp, Homo sapiens
  misc_feature: GYAE6OF01EI2Z7.51.9.A09.1.454.CMB.1.raw
  modified_base (184)..(188): a, c, t, g, unknown or other
  misc_feature (184)..(188): n is a, c, g, or t
tcagcgatcgtatacacgaccggtgctcgatttagcgagacgcgcagggccggtgctcgatttagctctacgctcagggcacgaccggtgctcgatttagctgtgcgtcgaagggaaagggcagcgtcactctgttcccaccctcctctcgtagcactctgagcgggctggcaaggcgcatagnnnnn

SEQ ID NO: 35997 - DNA, 166 bp, Homo sapiens
  misc_feature: GYAE6OF01DHXGX.51.9.A09.1.454.CMB.1.raw
  modified_base (132)..(132): a, c, t, g, unknown or other
  misc_feature (132)..(132): n is a, c, g, or t
  modified_base (147)..(147): a, c, t, g, unknown or other
  misc_feature (147)..(147): n is a, c, g, or t
  modified_base (153)..(166): a, c, t, g, unknown or other
  misc_feature (153)..(166): n is a, c, g, or t
tcagcgatcgtatacacgaccggtgctcgatttagcgagacgcgcagggcgacgaccggtgctcgatttagctgtgcgtcgaagggaaaggcagcgtcactctgttcccacctctctcgtagcactctggancgggctggcaaggcncatagnnnnnnnnnnnnnn

SEQ ID NO: 35998 - DNA, 154 bp, Homo sapiens
  misc_feature: GYAE6OF01CQQFP.51.9.A09.1.454.CMB.1.raw
  modified_base (153)..(154): a, c, t, g, unknown or other
  misc_feature (153)..(154): n is a, c, g, or t
tcagcgatcgtatacacgaccggtgctcgatttagcgagacgcgcagggcacgaccggtgctcgatttagagtgctacgaagggaaagggcagcgtcactctgttcccaccctcctctcgtagcactctgagcgggctggcaaggcgcatagnn

SEQ ID NO: 35999 - DNA, 156 bp, Homo sapiens
  misc_feature: GYAE6OF01CKAP3.51.9.A09.1.454.CMB.1.raw
  modified_base (153)..(156): a, c, t, g, unknown or other
  misc_feature (153)..(156): n is a, c, g, or t
tcagcgatcgtatacacgaccggtgctcgatttagcgagacgcgcagggcacgaccggtgctcgatttagagtgctacgaagggaaagggcagcgtcactctgttcccaccctcctctcgtagcactctgagcgggctggcaaggcgcatagnnnn

SEQ ID NO: 36000 - DNA, 168 bp, Homo sapiens
  misc_feature: GYAE6OF01EDTT6.51.9.A09.1.454.CMB.1.raw
  modified_base (154)..(168): a, c, t, g, unknown or other
  misc_feature (154)..(168): n is a, c, g, or t
tcagcgatcgtatacacgaccggtgctcgatttagcgagacgcgcagggcacggaccggtgctcgatttagagtgctacgaagggaaagggcagcgtcactctgttcccaccctcctctcgtagcactctgagcgggctggcaaggcgcatagnnnnnnnnnnnnnnn

SEQ ID NO: 36001 - DNA, 163 bp, Homo sapiens
  misc_feature: GYAE6OF01EXWK5.51.9.A09.1.454.CMB.1.raw
  modified_base (163)..(163): a, c, t, g, unknown or other
  misc_feature (163)..(163): n is a, c, g, or t
tcagcgatcgtatacacgaccggtgctcgatttagcgagacgcgcagggcacgaccggtgctcgatttagtcacgcgagaaagggaaagggggctggccctgacgtgtttctgttcccgccctcctctcgtagcactctgagcgggctggcaaggcgcatagn

SEQ ID NO: 36002 - DNA, 153 bp, Homo sapiens
  misc_feature: GYAE6OF01BHVIF.51.9.A09.1.454.CMB.1.raw
  modified_base (153)..(153): a, c, t, g, unknown or other
  misc_feature (153)..(153): n is a, c, g, or t
tcagcgatcgtatacacgaccggtgctcgatttagcgagacgcgcagggcacgaccggtgctcgatttagtcgatagtgaagggaaagggcagcgtcactctgttcccgccctcctctcgtagcactctgagcgggctggcaaggcgcatagn

SEQ ID NO: 36003 - DNA, 153 bp, Homo sapiens; identical to SEQ ID NO: 35991
  misc_feature: GYAE6OF01BU5N0.51.9.A09.1.454.CMB.1.raw
  modified_base (153)..(153): a, c, t, g, unknown or other
  misc_feature (153)..(153): n is a, c, g, or t

SEQ ID NO: 36004 - DNA, 167 bp, Homo sapiens
  misc_feature: GYAE6OF01DK0KG.51.9.A09.1.454.CMB.1.raw
  modified_base (153)..(167): a, c, t, g, unknown or other
  misc_feature (153)..(167): n is a, c, g, or t
tcagcgatcgtatacacgaccggtgctcgatttagcgagacgcgcagggcacgaccggtgctcgatttagctgtgcgtcgaagggaaagggcagcgtcactctgttcccacctcctctcgtagcactctgagcgggctggcaaggcgcatagnnnnnnnnnnnnnnn

SEQ ID NO: 36005 - DNA, 152 bp, Homo sapiens
  misc_feature: GYAE6OF01C66YB.51.9.A09.1.454.CMB.1.raw
  modified_base (152)..(152): a, c, t, g, unknown or other
  misc_feature (152)..(152): n is a, c, g, or t
tcagcgatcgtatacacgaccggtgctcgatttagcgagacgcgcagggcacgaccggtgctcgatttagagtgctacgaagggaaaggcagcgtcactctgttcccgccctcctctcgtagcactctgagcgggctggcaaggcgcatagn

SEQ ID NO: 36006 - DNA, 245 bp, Homo sapiens
  misc_feature: GYAE6OF01DRS8B.51.9.A09.1.454.CMB.1.raw
  modified_base (184)..(184): a, c, t, g, unknown or other
  misc_feature (184)..(184): n is a, c, g, or t
  modified_base (189)..(245): a, c, t, g, unknown or other
  misc_feature (189)..(245): n is a, c, g, or t
tcagcgatcgtatacacgaccggtgctcgatttagcgagacgcgcaaggggccggtgctcgactttagctctacgctcagggcacgaccggtgctcgatttagctgtgcgtcgaagggaaagggcagcgtcacgtctgttccccaccctcctctcgtagcactctgagcgggctggcaaggcgnatagnnnnnnnnnnnnnnnnnnnnnnnnnnnnnnnnnnnnnnnnnnnnnnnnnnnnnnnnn

SEQ ID NO: 36007 - DNA, 155 bp, Homo sapiens; identical to SEQ ID NO: 35985
  misc_feature: GYAE6OF01DCQGD.51.9.A09.1.454.CMB.1.raw
  modified_base (153)..(155): a, c, t, g, unknown or other
  misc_feature (153)..(155): n is a, c, g, or t

SEQ ID NO: 36008 - DNA, 154 bp, Homo sapiens; identical to SEQ ID NO: 35998
  misc_feature: GYAE6OF01ASJFL.51.9.A09.1.454.CMB.1.raw
  modified_base (153)..(154): a, c, t, g, unknown or other
  misc_feature (153)..(154): n is a, c, g, or t

SEQ ID NO: 36009 - DNA, 159 bp, Homo sapiens
  misc_feature: GYAE6OF01EDZML.51.9.A09.1.454.CMB.1.raw
  modified_base (151)..(159): a, c, t, g, unknown or other
  misc_feature (151)..(159): n is a, c, g, or t
tcagcgatcgtatacacgaccggtgctcgatttagcgagacgcgcagggcacgaccggtgctcgatttagagtgctacgaagggaaagggcagcgtcactctgttcccacctcctctcgtagcactctgagcggctggcaaggcgcatagnnnnnnnnn

SEQ ID NO: 36010 - DNA, 164 bp, Homo sapiens
  misc_feature: GYAE6OF01D1FPQ.51.9.A09.1.454.CMB.1.raw
  modified_base (146)..(146): a, c, t, g, unknown or other
  misc_feature (146)..(146): n is a, c, g, or t
  modified_base (152)..(164): a, c, t, g, unknown or other
  misc_feature (152)..(164): n is a, c, g, or t
tcagcgatcgtatacacgaccggtgctcgatttagcgagacgcgcagggcacgaccggtgctcgatttagagtgctacgaagggaaagggcagcgtcactctgtcccgccctcctctcgtagcactctgagcgggctggcaaggcncatagnnnnnnnnnnnnn

SEQ ID NO: 36011 - DNA, 154 bp, Homo sapiens; identical to SEQ ID NO: 35998
  misc_feature: GYAE6OF02HKPPB.51.9.A09.1.454.CMB.1.raw
  modified_base (153)..(154): a, c, t, g, unknown or other
  misc_feature (153)..(154): n is a, c, g, or t

SEQ ID NO: 36012 - DNA, 224 bp, Homo sapiens
  misc_feature: GYAE6OF02GXROF.51.9.A09.1.454.CMB.1.raw
  modified_base (223)..(224): a, c, t, g, unknown or other
  misc_feature (223)..(224): n is a, c, g, or t
tcagcgatcgtatacacgaccggtgctcgatttagcgagacgcgcagggcacgaccggtgctcgatttagctctacgctcagggcacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnn

SEQ ID NO: 36013 - DNA, 153 bp, Homo sapiens; identical to SEQ ID NO: 35991
  misc_feature: GYAE6OF02IR24I.51.9.A09.1.454.CMB.1.raw
  modified_base (153)..(153): a, c, t, g, unknown or other
  misc_feature (153)..(153): n is a, c, g, or t

SEQ ID NO: 36014 - DNA, 169 bp, Homo sapiens
  misc_feature: GYAE6OF02F0CIX.51.9.A09.1.454.CMB.1.raw
  modified_base (152)..(169): a, c, t, g, unknown or other
  misc_feature (152)..(169): n is a, c, g, or t
tcagcgatcgtatacacgaccggtgctcgatttagcgagacgcgcagggcacgaccggtgctcgatttagagtgctacgaagggaaagggcagcgtcactctgttcccgccctcctctcgtagcactctgagcggctggcaaggcgcatagnnnnnnnnnnnnnnnnnn

SEQ ID NO: 36015 - DNA, 190 bp, Homo sapiens
  misc_feature: GYAE6OF02GOCRO.51.9.A09.1.454.CMB.1.raw
  modified_base (188)..(190): a, c, t, g, unknown or other
  misc_feature (188)..(190): n is a, c, g, or t
tcagcgatcgtatacacgaccggtgctcgatttagcgagacgcgcagggcacgaccggtgctcgatttagctctacgctcagggcacgaccggtgctcgatttagagtgctacgaagggaaagggcagcgtcactctgttcccgccctcctctcgtagcactctgagcgggctggcaaggcgcatagnnn

SEQ ID NO: 36016 - DNA, 157 bp, Homo sapiens
  misc_feature: GYAE6OF02FFJ1C.51.9.A09.1.454.CMB.1.raw
  modified_base (152)..(157): a, c, t, g, unknown or other
  misc_feature (152)..(157): n is a, c, g, or t
tcagcgatcgtatacacgaccggtgctcgatttagcgagacgcgcagggcacgaccggtgctcgatttagagtgctacgaagggaaagggcagcgtcactctgttcccgcctcctctcgtagcactctgagcgggctggcaaggcgcatagnnnnnn

SEQ ID NO: 36017 - DNA, 155 bp, Homo sapiens
  misc_feature: GYAE6OF02G8I15.51.9.A09.1.454.CMB.1.raw
  modified_base (154)..(155): a, c, t, g, unknown or other
  misc_feature (154)..(155): n is a, c, g, or t
tcagcgatcgtatacacgaccggtgctcgatttagcgagacgcgcagggcacgaccggtgctcgatttagctgtgcgtcgaagggaaagggcagcgtcactctgttcccaccctcctctcgtagcactctgagcgggctggcaaggcgcatagnn

SEQ ID NO: 36018 - DNA, 153 bp, Homo sapiens; identical to SEQ ID NO: 35988
  misc_feature: GYAE6OF02GB5T3.51.9.A09.1.454.CMB.1.raw
  modified_base (153)..(153): a, c, t, g, unknown or other
  misc_feature (153)..(153): n is a, c, g, or t

SEQ ID NO: 36019 - DNA, 153 bp, Homo sapiens; identical to SEQ ID NO: 35988
  misc_feature: GYAE6OF02I317W.51.9.A09.1.454.CMB.1.raw
  modified_base (153)..(153): a, c, t, g, unknown or other
  misc_feature (153)..(153): n is a, c, g, or t

SEQ ID NO: 36020 - DNA, 154 bp, Homo sapiens
  misc_feature: GYAE6OF02G2FZ4.51.9.A09.1.454.CMB.1.raw
  modified_base (153)..(154): a, c, t, g, unknown or other
  misc_feature (153)..(154): n is a, c, g, or t
tcagcgatcgtatacacgaccggtgctcgatttagcgagacgcgcagggcacgaccggtgctcgatttagagtgctacgaagggaaagggcagcgtcactctgttcccgccctcctctcgtagcactctgagcgggctggcaaggcgcatagnn

SEQ ID NO: 36021 - DNA, 157 bp, Homo sapiens
  misc_feature: GYAE6OF02GSG5G.51.9.A09.1.454.CMB.1.raw
  modified_base (154)..(157): a, c, t, g, unknown or other
  misc_feature (154)..(157): n is a, c, g, or t
tcagcgatcgtatacacgaccggtgctcgatttagcgagacgcgcagggcacgaccggtgctcgatttagagtgctacgaagggaaagggcagcgtcactctgttcccaccctcctctccgtagcactctgagcgggctggcaaggcgcatagnnnn

SEQ ID NO: 36022 - DNA, 176 bp, Homo sapiens
  misc_feature: GYAE6OF02GBM3Z.51.9.A09.1.454.CMB.1.raw
  modified_base (153)..(176): a, c, t, g, unknown or other
  misc_feature (153)..(176): n is a, c, g, or t
tcagcgatcgtatacacgaccggtgctcgatttagcgagacgcgcagggcacgaccggtgctcgatttagagtgctacgaagggaaagggcagcgtcactctgttcccgccctcctctcgtagcactctgagcgggctggcaaggcgcatagnnnnnnnnnnnnnnnnnnnnnnnn

SEQ ID NO: 36023 - DNA, 153 bp, Homo sapiens; identical to SEQ ID NO: 35988
  misc_feature: GYAE6OF02FUS3A.51.9.A09.1.454.CMB.1.raw
  modified_base (153)..(153): a, c, t, g, unknown or other
  misc_feature (153)..(153): n is a, c, g, or t

SEQ ID NO: 36024 - DNA, 155 bp, Homo sapiens
  misc_feature: GYAE6OF02FP3PV.51.9.A09.1.454.CMB.1.raw
  modified_base (154)..(155): a, c, t, g, unknown or other
  misc_feature (154)..(155): n is a, c, g, or t
tcagcgatcgtatacacgaccggtgctcgatttagcgagacgcgcagggcacgaccggtgctcgatttaagagtgctacgaagggaaagggcagcgtcactctgttcccaccctcctctcgtagcactctgagcgggctggcaaggcgcatagnn

SEQ ID NO: 36025 - DNA, 189 bp, Homo sapiens
  misc_feature: GYAE6OF02F9C5A.51.9.A09.1.454.CMB.1.raw
  modified_base (188)..(189): a, c, t, g, unknown or other
  misc_feature (188)..(189): n is a, c, g, or t
tcagcgatcgtatacacgaccggtgctcgatttagcgagacgcgcagggcacgaccggtgctcgatttagctctacgctcagggcacgaccggtgctcgatttagagtgctacgaagggaaagggcagcgtcactctgttcccgccctcctctcgtagcactctgagcgggctggcaaggcgcatagnn

SEQ ID NO: 36026 - DNA, 195 bp, Homo sapiens
  misc_feature: GYAE6OF02F78OK.51.9.A09.1.454.CMB.1.raw
  modified_base (181)..(195): a, c, t, g, unknown or other
  misc_feature (181)..(195): n is a, c, g, or t
tcagcgatcgtatacacgaccggtgctcgatttagcgagacgcgcagggggtcctcgatttagctctacgctcagggcacgaccggtgctcgatttagctgtgcgtcgaagggaaaggcagcgtcactctgttcccacctcctctcgtagcacttctgagcgggctggcaaggcgcatagnnnnnnnnnnnnnnn

SEQ ID NO: 36027 - DNA, 216 bp, Homo sapiens
  misc_feature: GYAE6OF02GXGJ3.51.9.A09.1.454.CMB.1.raw
  modified_base (162)..(162): a, c, t, g, unknown or other
  misc_feature (162)..(162): n is a, c, g, or t
  modified_base (211)..(216): a, c, t, g, unknown or other
  misc_feature (211)..(216): n is a, c, g, or t
tcagcgatcgtatacacgaccggtgctcgatttagcgagacgcgcagggcacgaccggtgctcgatttagctctacgctcagggcacgaccggtgctcgatttagctctacgctcagggcacgaccggtgctcgatttatccacgcccagagctcgaaaacnccgcgccatctgatcgtagcactctgagcgggctggcaaggcgcatagnnnnnn

SEQ ID NO: 36028 - DNA, 160 bp, Homo sapiens
  misc_feature: GYAE6OF02FSZ8M.51.9.A09.1.454.CMB.1.raw
  modified_base (153)..(160): a, c, t, g, unknown or other
  misc_feature (153)..(160): n is a, c, g, or t
tcagcgatcgtatacacgaccggtgctcgatttagcgagacgcgcagggcacgaccggtgctcgatttagagtgctacgaagggaaagggcagcgtcactctgttcccaccctcctctcgtagcactctgagcgggctggcaaggcgcatagnnnnnnnn

SEQ ID NO: 36029 - DNA, 150 bp, Homo sapiens
  misc_feature: GYAE6OF02HQXNH.51.9.A09.1.454.CMB.1.raw
  modified_base (150)..(150): a, c, t, g, unknown or other
  misc_feature (150)..(150): n is a, c, g, or t
tcagcgatcgtatacacgaccggtgctcgatttagcgagacgcgcagggcacgaccggtgctcgatttagtcgatagtgaaggaaggcagcgtcactctgttcccaccctcctctcgtagcactctgagcgggctggcaaggcgcatagn

SEQ ID NO: 36030 - DNA, 156 bp, Homo sapiens
  misc_feature: GYAE6OF02F0C03.51.9.A09.1.454.CMB.1.raw
  modified_base (154)..(156): a, c, t, g, unknown or other
  misc_feature (154)..(156): n is a, c, g, or t
tcagcgatcgtatacacgaccggtgctcgatttagcgagacgcgcagggcacgaccggtgctcgatttagtcacgcgagaaagggaaagggcagcgtcactctgttcccaccctcctctcgtagcactctgagcgggctggcaaggcgcatagnnn

SEQ ID NO: 36031 - DNA, 184 bp, Homo sapiens
  misc_feature: GYAE6OF02I60TD.51.9.A09.1.454.CMB.1.raw
  modified_base (157)..(184): a, c, t, g, unknown or other
  misc_feature (157)..(184): n is a, c, g, or t
tcagcgatcgtatacacgaccggtgctcgatttagcgagacgcgcaggggcacgaccggtgctcgatttagagtgctacgaagggaaagggcagcgtccactctgttcccgccctccgtctcgtagcactctgagcgggctgggcaaggcgcatagnnnnnnnnnnnnnnnnnnnnnnnnnnnn

SEQ ID NO: 36032 - DNA, 154 bp, Homo sapiens; identical to SEQ ID NO: 35998
  misc_feature: GYAE6OF02FNYP9.51.9.A09.1.454.CMB.1.raw
  modified_base (153)..(154): a, c, t, g, unknown or other
  misc_feature (153)..(154): n is a, c, g, or t

SEQ ID NO: 36033 - DNA, 201 bp, Homo sapiens
  misc_feature: GYAE6OF02FYST4.51.9.A09.1.454.CMB.1.raw
  modified_base (191)..(201): a, c, t, g, unknown or other
  misc_feature (191)..(201): n is a, c, g, or t
tcagcgatcgtatacacgaccggtgctcgatttagcgagacgcgcagggcacgaccggtgctcgatttagagtgctacgaagggaaagggcacgaccggtgctcgatttagagtgctacgaagggaagggcagcgtcactctgttcccgccctctctcgtagcactctgagcggctggcaaggcgcatagnnnnnnnnnnn

SEQ ID NO: 36034 - DNA, 154 bp, Homo sapiens
  misc_feature: GYAE6OF02GG7XH.51.9.A09.1.454.CMB.1.raw
  modified_base (153)..(154): a, c, t, g, unknown or other
  misc_feature (153)..(154): n is a, c, g, or t
tcagcgatcgtatacacgaccggtgctcgatttagcgagacgcgcagggcacgaccggtgctcgatttagtcgatagtgaagggaaagggcagcgtcactctgttcccaccctcctctcgtagcactctgagcgggctggcaaggcgcatagnn

SEQ ID NO: 36035 - DNA, 451 bp, Homo sapiens
  misc_feature: GYAE6OF01A8D2Y.4.78.H01.1.454.CMB.1.raw
  modified_base (399)..(399): a, c, t, g, unknown or other
  misc_feature (399)..(399): n is a, c, g, or t
  modified_base (442)..(451): a, c, t, g, unknown or other
  misc_feature (442)..(451): n is a, c, g, or t
tcagagcactgtagcacgaccggtgctcgatttagtgtgagtagtttgggtttggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctattctgtgtgagagcctcctcttccgcgtatgactactggggccagggaaccctggtcaccgtctcctcagcctccaccaagggcccatcggtcttccccctggcgccctgctccaggagcacctccgagagcacagcggccctgggctgcctggtcaaggnttactccctacagtgctctgagcgggctggcaaggcgcatagnnnnnnnnnn

SEQ ID NO: 36036 - DNA, 451 bp, Homo sapiens
  misc_feature: GYAE6OF01DIZZC.4.78.H01.1.454.CMB.1.raw
  modified_base (446)..(451): a, c, t, g, unknown or other
  misc_feature (446)..(451): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaagggcccatcggtcttccccctggccgccctgctccaggacgcacctccgagagcacagcggccctgggctgcctggtcaaggctacttccctacagtgctctgagcgggctggcaaggcgcatagnnnnnn

SEQ ID NO: 36037 - DNA, 453 bp, Homo sapiens
  misc_feature: GYAE6OF01AW89T.4.78.H01.1.454.CMB.1.raw
  modified_base (440)..(440): a, c, t, g, unknown or other
  misc_feature (440)..(440): n is a, c, g, or t
  modified_base (446)..(453): a, c, t, g, unknown or other
  misc_feature (446)..(453): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaagggcccatcggtcttccccctggccgccctgctccaggacgcacctccgagagcacagccgccctgggctgcctggtcaaggctacttccctacagtgctctgagcgggctggcaaggcncatagnnnnnnnn

SEQ ID NO: 36038 - DNA, 462 bp, Homo sapiens
  misc_feature: GYAE6OF01A356T.4.78.H01.1.454.CMB.1.raw
  modified_base (422)..(422): a, c, t, g, unknown or other
  misc_feature (422)..(422): n is a, c, g, or t
  modified_base (444)..(444): a, c, t, g, unknown or other
  misc_feature (444)..(444): n is a, c, g, or t
  modified_base (451)..(462): a, c, t, g, unknown or other
  misc_feature (451)..(462): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaagggcccatccggtcttccccctggccgccctgcctccaggacgcacctccgagacgcacagcggcccctgggctgcctggtcaaggctacttccctacagtnctctgagcgggctggcaaggcncatacgnnnnnnnnnnnn

SEQ ID NO: 36039 - DNA, 491 bp, Homo sapiens
  misc_feature: GYAE6OF01DZ3O1.4.78.H01.1.454.CMB.1.raw
  modified_base (478)..(491): a, c, t, g, unknown or other
  misc_feature (478)..(491): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcacgcctccaccaagggccccatccggtccttccccctggccgcccctgcctccgaggacgccacccgtccgagacgcacgagccggccctgggctcggccctgggtccaacggtacctaccttcccctacgagtcgcctcgtgacggcgggctggcgaaggcgcatagnnnnnnnnnnnnnn

SEQ ID NO: 36040 - DNA, 527 bp, Homo sapiens
  misc_feature: GYAE6OF01DGR8Q.4.78.H01.1.454.CMB.1.raw
  modified_base (365)..(365): a, c, t, g, unknown or other
  misc_feature (365)..(365): n is a, c, g, or t
  modified_base (504)..(527): a, c, t, g, unknown or other
  misc_feature (504)..(527): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactgggccagggaaccctggtcaccgtctcctcagcctccaccaagggcccatccggtccttccccctggccgcccctgcctccaggacnccacctccgaagacgacacgacggccgcccgtcgggcctcgccgtggaccgaacggaccttacccttcccgtactacggtcgtccttcgtacggacggccggggtcgtacggaccggtaacggccgtactaagtcgagnnnnnnnnnnnnnnnnnnnnnnnn

SEQ ID NO: 36041 - DNA, 510 bp, Homo sapiens
  misc_feature: GYAE6OF01C7585.4.78.H01.1.454.CMB.1.raw
  modified_base (489)..(489): a, c, t, g, unknown or other
  misc_feature (489)..(489): n is a, c, g, or t
  modified_base (496)..(510): a, c, t, g, unknown or other
  misc_feature (496)..(510): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagtttcgctgcagttgaagtctgtcgaccccagagacacggctctctatttctgtgtgagacgcctcctcttccgcgtatgactacgtgggccacgggaccctggtcaccgtctcctcacgtcctccaccgaacggcccagtccggtccttcccccgtggccgccctgccctccgaggacgccaccgtccgagcgcaccgacgccggccctgggctcgccgtcggtacaacggtcctaccgttcccctacgagtcgtcctcgtggacggccggggtactcgggaccaagggcccgtanaagtcgnnnnnnnnnnnnnnn

SEQ ID NO: 36042 - DNA, 466 bp, Homo sapiens
  misc_feature: GYAE6OF01EX5EW.4.78.H01.1.454.CMB.1.raw
  modified_base (412)..(412): a, c, t, g, unknown or other
  misc_feature (412)..(412): n is a, c, g, or t
  modified_base (447)..(447): a, c, t, g, unknown or other
  misc_feature (447)..(447): n is a, c, g, or t
  modified_base (453)..(466): a, c, t, g, unknown or other
  misc_feature (453)..(466): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagtttcgctgcagttgaagtctgtgaccccagagacacggctctctatttctgtgtgagagcctcctcttccgcgtatgactactggggccagggaaccctggtccaccgtctcctcacgcctccaccaacgggcccatccggtcttcccctgcgccctgctccagcgcacctcgagagcacacgcggccctgggctgcctggtcaaggcctactccctanagtgctcgtgacggccgggctcgggacaacgggcncatagnnnnnnnnnnnnnn

SEQ ID NO: 36043 - DNA, 461 bp, Homo sapiens
  misc_feature: GYAE6OF01CF19M.4.78.H01.1.454.CMB.1.raw
  modified_base (447)..(447): a, c, t, g, unknown or other
  misc_feature (447)..(447): n is a, c, g, or t
  modified_base (453)..(461): a, c, t, g, unknown or other
  misc_feature (453)..(461): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaagggcccatcggtcttccccctggccgccctgcctccaggacgccacctccgagacgcacagccggccctgggcctgcctggtcaaggctaccttccctacagtgctctgacgcgggctggcaggcncatagnnnnnnnnn

SEQ ID NO: 36044 - DNA, 471 bp, Homo sapiens
  misc_feature: GYAE6OF01DN7HX.4.78.H01.1.454.CMB.1.raw
  modified_base (459)..(471): a, c, t, g, unknown or other
  misc_feature (459)..(471): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcacgcctccaccgaacgggcccagtcggtccttccccctggccacccctcctccaagcgcacctcgtgggggcacagccggccctgggctgtctggtcaaggctacttccctacagtgctctgacggcgggctggcgaaggcgacagtagnnnnnnnnnnnnn

SEQ ID NO: 36045 - DNA, 493 bp, Homo sapiens
  misc_feature: GYAE6OF01EOM6F.4.78.H01.1.454.CMB.1.raw
  modified_base (379)..(379): a, c, t, g, unknown or other
  misc_feature (379)..(379): n is a, c, g, or t
  modified_base (479)..(493): a, c, t, g, unknown or other
  misc_feature (479)..(493): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactacgtggggccagggaaccctggtcaccgtctcctcagcctccaccaagggcccatcggtccttccccctggccgcccctgctcccaggacgcaccgtccgagngcacagccggccctgggctcggccctagggtcaagggaccttaccttccccgtacagtcgcctcgtggacggcggggcgtgggacaagggcgacagtagnnnnnnnnnnnnnnn

SEQ ID NO: 36046 - DNA, 457 bp, Homo sapiens
  misc_feature: GYAE6OF01A2849.4.78.H01.1.454.CMB.1.raw
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
  modified_base (449)..(457): a, c, t, g, unknown or other
  misc_feature (449)..(457): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaaggcccatcggtcttccccctggcgccctgcctccaggcgcacctccgagacgcacagcggccctgggcctgcctggtcaacggactacttcccanagtgctcngagcgggctggcaaggcncatagnnnnnnnnn

SEQ ID NO: 36047 - DNA, 552 bp, Homo sapiens
  misc_feature: GYAE6OF01DHFC5.4.78.H01.1.454.CMB.1.raw
  modified_base (525)..(525): a, c, t, g, unknown or other
  misc_feature (525)..(525): n is a, c, g, or t
  modified_base (528)..(552): a, c, t, g, unknown or other
  misc_feature (528)..(552): n is a, c, g, or t
tcagagcactgtagcacgaccggtgctcgatttagtgtgagtagtttggggtttgggggggactgggtcagacagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactacgtggggccagggaaccctggtccaccgtctcctcacgccctcccaccgaacgggccccagtccggtccttcccccgtggccgcccctgcctccaggcgccacccgtccgagacgcacacggccggcccgtgggcctcggccgtcgggtaccaacgggtacccttaccgttccccctacgacggtcgtccttcgtcggacgggccggggctacggggaccgaaacgggccgacgtaacgtaggctncgnnnnnnnnnnnnnnnnnnnnnnnnn

SEQ ID NO: 36048 - DNA, 512 bp, Homo sapiens
  misc_feature: GYAE6OF01BSFZO.4.78.H01.1.454.CMB.1.raw
  modified_base (498)..(512): a, c, t, g, unknown or other
  misc_feature (498)..(512): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcacgcctccaccaacgggcccatccggtccttccccccgtggccgcccctgcctccgaggacgccacctcccgagagccacgacgccggccctggggcctcggcccgtgggtaccaacgggtaccttacccgttcccctaacacggttcgcctcgtggacggccggggctgggccaagggccgcatacgnnnnnnnnnnnnnnn

SEQ ID NO: 36049 - DNA, 538 bp, Homo sapiens
  misc_feature: GYAE6OF01C0QKS.4.78.H01.1.454.CMB.1.raw
  modified_base (520)..(538): a, c, t, g, unknown or other
  misc_feature (520)..(538): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtcgacccccagagacacggctctctatttctgtgtgagagcctcctcttccgcgtatgactacgtggggccagggaaccctggtccaccgtctcctcacgcctccaccgaacggcccacgtccggtccttcccccgtcggcccacccctccctacccaagaccgccacccgtccgtcgggggccacgacggccggcccgtcggggcctcgcccgtggtaccgaacggtacctaccgttacccctacgtacgtcgtcctcgtcggacggcgggtcgtcgggacgaacgggtccgacgtagtacgnnnnnnnnnnnnnnnnnnn

SEQ ID NO: 36050 - DNA, 452 bp, Homo sapiens
  misc_feature: GYAE6OF01BXBMK.4.78.H01.1.454.CMB.1.raw
  modified_base (439)..(439): a, c, t, g, unknown or other
  misc_feature (439)..(439): n is a, c, g, or t
  modified_base (446)..(452): a, c, t, g, unknown or other
  misc_feature (446)..(452): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaagggcccatcggtccttccccctggccgccctgctccaggcgcacctccgagagcacagcggccctgggctgcctggcaaggctacttcctacagtgctctgacgcgggctggcaggcncatagcnnnnnnn

SEQ ID NO: 36051 - DNA, 589 bp, Homo sapiens
  misc_feature: GYAE6OF01AGB1P.4.78.H01.1.454.CMB.1.raw
  modified_base (264)..(264): a, c, t, g, unknown or other
  misc_feature (264)..(264): n is a, c, g, or t
  modified_base (381)..(381): a, c, t, g, unknown or other
  misc_feature (381)..(381): n is a, c, g, or t
  modified_base (574)..(589): a, c, t, g, unknown or other
  misc_feature (574)..(589): n is a, c, g, or t
tcagagcactgtagcacgaccggtgctcgatttagtgtgagtagtttggggtttgggggactgggtcaggcacgtccccatcgagaggccttgagtggctgggacggtacttatttccggtccaaggtggtattttttgatttagtgaccgcattctcgtgagaggtcgaataagcactacaacccagacaaccaaaccaagaacctagttttcgctgcagttgagtctgccgaccccagacgaccacggtctctgttatttcngtgtgagcctccttctccgttccgcgtatcgactacggtggggcccagggtaaccctgtccaccgtctcccgcacgccctccaaccgacggccctacgttcccgtcccttcccccgngaccccacccctcctaccgacgacgcctaccgtcggcggggacccacgccggcccgtcccgtgggtacctcgtcccggttaggacctaaacgggtaccctttacccgttacccctacgtacgggttccgtaccgttccgtcgggaaccggggtccgggtttacgacgggtacgaacgggccgacctaaggcgnnnnnnnnnnnnnnnn

SEQ ID NO: 36052 - DNA, 479 bp, Homo sapiens
  misc_feature: GYAE6OF01BQ9WX.4.78.H01.1.454.CMB.1.raw
  modified_base (431)..(431): a, c, t, g, unknown or other
  misc_feature (431)..(431): n is a, c, g, or t
  modified_base (458)..(458): a, c, t, g, unknown or other
  misc_feature (458)..(458): n is a, c, g, or t
  modified_base (465)..(479): a, c, t, g, unknown or other
  misc_feature (465)..(479): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactacgtggggccagggaaccctggtcaccgtctcctcagcctccaccagggcccatccggtccttccccctggccgcccctcgcctcccgaggacgccaccctccgagacgcaccagccggccctgggctgcctggtacaaggacctacttccctacngtcgctctgagcgggctcggcaaggcncactagnnnnnnnnnnnnnnn

SEQ ID NO: 36053 - DNA, 537 bp, Homo sapiens
  misc_feature: GYAE6OF01CV709.4.78.H01.1.454.CMB.1.raw
  modified_base (251)..(251): a, c, t, g, unknown or other
  misc_feature (251)..(251): n is a, c, g, or t
  modified_base (322)..(322): a, c, t, g, unknown or other
  misc_feature (322)..(322): n is a, c, g, or t
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
  modified_base (485)..(485): a, c, t, g, unknown or other
  misc_feature (485)..(485): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
  modified_base (511)..(537): a, c, t, g, unknown or other
  misc_feature (511)..(537): n is a, c, g, or t
tcagagcactgtagcacgaccggtgctcgatttagtgtgagtagtttggggtttggggggactgggtcaggcagtccccatcgagaggccttgagtggctgggacgacttatttccggtccaagtggtattttttgattatgccgcatctctagagaggtcgaaataagcatcaacccagacacaaccaagaaccagttttcgctgcagttgaagtctagtcgacccccagagacacggctctctatttcngtagtgagacgcctcctcttccgcgtatcgactacgtgggccagggaaccctggtaccaccgtctcccttnaacgccctaccaaccgaaggccccagtccggtccttcccccgnggccgcccctgcctaccgaggacncctaaccgtccgaagacgccaacgtacgccggtcccgtggcctcgccgtgtacgaagtaccctactccccgatacgtgccttgaggaacgcgggtncggaccgaaggcccgnaagtacgngnnnnnnnnnnnnnnnnnnnnnnnnnnn

SEQ ID NO: 36054 - DNA, 467 bp, Homo sapiens
  misc_feature: GYAE6OF01CRDS8.4.78.H01.1.454.CMB.1.raw
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (446)..(446): a, c, t, g, unknown or other
  misc_feature (446)..(446): n is a, c, g, or t
  modified_base (453)..(467): a, c, t, g, unknown or other
  misc_feature (453)..(467): n is a, c, g, or t
tcagagcactgtagcacgaccggtgctcgatttagtgtgagtagtttgggtttgggggggactgggtcaggcagtccccatcgagaggccttgagtggctgggacggacttatttccggtccaagtggatttttgattatgccgcatctctgagaggtcgaataagcatcaacccagacacaaaccaagaaccagttttcgctgcagttgaagtctgtgacccccagagacacggctctctatttctgtgtgagagcctcctcttccgcgtatgactactggggccagggaccctggtcaccgtctcctcacgcctccacaggcccagtcgtcttcccctgcgccngctcagcgcacctcgagncacgacgcggccctgggctgccgtggtcaaagggccttaccttcccctagagtcgctctggacgcgggctgggccaagggcncagtagnnnnnnnnnnnnnnn

SEQ ID NO: 36055 - DNA, 573 bp, Homo sapiens
  misc_feature: GYAE6OF01EDUJC.4.78.H01.1.454.CMB.1.raw
  modified_base (400)..(400): a, c, t, g, unknown or other
  misc_feature (400)..(400): n is a, c, g, or t
  modified_base (549)..(550): a, c, t, g, unknown or other
  misc_feature (549)..(550): n is a, c, g, or t
  modified_base (552)..(573): a, c, t, g, unknown or other
  misc_feature (552)..(573): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggattttttgattatgccgcatctctgagaggtcgaataagcatcaacccagacacaaccaaagaaccagttttcgctgcagttgaagtctgtcgacccccagagacacggctctctatttctgtgtgagagcctcctcttccgcgtatgactacgtcggggccaacgggaaccctggtccacccgtccttcctacacgccctacccaccgaacgggcccagtccggtcccttcccccgtggccgccctcgcctccgaggcgccacctccgagcnccacgacggcccggcccgtggggcctcggcccgtacgggtaccgaaacgggtaccctttaccctttaccccgtaacgtacggttcgtcccttcggttacgggacgggtccggggtcgtacgggaccgtaaagggcccgacgtaacgtgnngnnnnnnnnnnnnnnnnnnnnnn

SEQ ID NO: 36056 - DNA, 575 bp, Homo sapiens
  misc_feature: GYAE6OF01CEAOK.4.78.H01.1.454.CMB.1.raw
  modified_base (390)..(390): a, c, t, g, unknown or other
  misc_feature (390)..(390): n is a, c, g, or t
  modified_base (545)..(546): a, c, t, g, unknown or other
  misc_feature (545)..(546): n is a, c, g, or t
  modified_base (548)..(575): a, c, t, g, unknown or other
  misc_feature (548)..(575): n is a, c, g, or t
tcagagcactgtagcacgaccggtgctcgatttagtgtgagtagtttggggtttgggggggactgggtcaggcagtccccatcgagaggccttgagtggctgggacggacttatttccggtccaagtggattttttgattatgccgcatctctgagaggtcgaataagcatcaacccagacacaaaccaagaaccagttttcgctgcagttgaagtctgtcgacccccagagacacggctctctatttctgtgtgagagcctcctcttccgcgtatgactacgtggggaccacgggtaaccctggtccaccggtcctcctcacgcctccaaccgaacgggcccagtccggtcccttccccccgtgggccgcccctgtccctccgaggacnccacccgtccggacgacgaccacgacggcccggacccgtggggctcggccgtacgggtaccgaagggtaccctttacccgttaccccgtaagtcggttccgacttccgtagggaccgggccgggtcgtcgggaccgtaacggccgtacagtacgnngnnnnnnnnnnnnnnnnnnnnnnnnnnnn

SEQ ID NO: 36057 - DNA, 480 bp, Homo sapiens
  misc_feature: GYAE6OF01BZ08S.4.78.H01.1.454.CMB.1.raw
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (457)..(480): a, c, t, g, unknown or other
  misc_feature (457)..(480): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaagggcccaatcggtccttcccccngccgccctgcctccaggcnccaccgtccgagacgcacagccggccctgggcctgcctggtcaaggctactccctanagtgctctgagcgggcngggcgaaggcgcagtagcgnnnnnnnnnnnnnnnnnnnnnnnn

SEQ ID NO: 36058 - DNA, 551 bp, Homo sapiens
  misc_feature: GYAE6OF01CYGMZ.4.78.H01.1.454.CMB.1.raw
  modified_base (364)..(364): a, c, t, g, unknown or other
  misc_feature (364)..(364): n is a, c, g, or t
  modified_base (528)..(551): a, c, t, g, unknown or other
  misc_feature (528)..(551): n is a, c, g, or t
tcagagcactgtagcacgaccggtgctcgatttagtgtgagtagtttggggtttggggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtcgaccccagagacacggctctctatttctgtgtgagacgcctcctcttccgcgtatcgactacgtggggccagggaccctggtccaccgtctcctcgacgtccctacccaccgaacgggccctacgttccggtccctttcccccgnggcccgtcccctcgcctccgacggcgccacccgtcgacgacgccacgacggcccggcccgtgggcctcgccgtcggtacgaacggtacccttacccgttaccccagacgtcgtcctcgtacggcggccggggtacgtcgggacgaacgggtccgactagtacgnnnnnnnnnnnnnnnnnnnnnnnn

SEQ ID NO: 36059 - DNA, 581 bp, Homo sapiens
  misc_feature: GYAE6OF01CS0CJ.4.78.H01.1.454.CMB.1.raw
  modified_base (540)..(540): a, c, t, g, unknown or other
  misc_feature (540)..(540): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (553)..(554): a, c, t, g, unknown or other
  misc_feature (553)..(554): n is a, c, g, or t
  modified_base (557)..(559): a, c, t, g, unknown or other
  misc_feature (557)..(559): n is a, c, g, or t
  modified_base (561)..(561): a, c, t, g, unknown or other
  misc_feature (561)..(561): n is a, c, g, or t
  modified_base (564)..(565): a, c, t, g, unknown or other
  misc_feature (564)..(565): n is a, c, g, or t
  modified_base (567)..(570): a, c, t, g, unknown or other
  misc_feature (567)..(570): n is a, c, g, or t
  modified_base (572)..(578): a, c, t, g, unknown or other
  misc_feature (572)..(578): n is a, c, g, or t
  modified_base (580)..(581): a, c, t, g, unknown or other
  misc_feature (580)..(581): n is a, c, g, or t
tcagagcactgtagcacgaccggtgctcgatttagtgtgagtagtttgggtttgggggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtcgaccccagagacacgctctcttatttctgtgtgagacgtcctcctcttccgcgtatgactacgcggggccaacgggaccctggtccaccgtctcctcacgccctccaccgaacggcccagtccggtccctcccccgtggccctccctcgcctcgacggcgccacccgtcgagcgaccacgacggcccggcccgtgggcctcgcccgtgggtaccaaacgggtccctttacccttacccccgtaagacggttccgaccgtttcgtacgggaccgggtccggggtaccgtcgggaaccgtaaacgggcctaacgtaagtacgnacncngtacncgnncgnnngncgnngnnnncnnnnnnngnn

SEQ ID NO: 36060 - DNA, 589 bp, Homo sapiens
  misc_feature: GYAE6OF01DZIBH.4.78.H01.1.454.CMB.1.raw
  modified_base (366)..(366): a, c, t, g, unknown or other
  misc_feature (366)..(366): n is a, c, g, or t
  modified_base (557)..(557): a, c, t, g, unknown or other
  misc_feature (557)..(557): n is a, c, g, or t
  modified_base (567)..(567): a, c, t, g, unknown or other
  misc_feature (567)..(567): n is a, c, g, or t
  modified_base (571)..(572): a, c, t, g, unknown or other
  misc_feature (571)..(572): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggattttttgattatgccgcatctctgagaggtcgaataagcatcaacccagacacaaccaagaacctagtttcgctgcagttgaagtctgtcgaccccagacgacacggctctctatttctgtgtgagacgcctcctcttccgcgtatcgactacgtcgggccacggtaccctggtccaccgtctccctcaccgccctaccgaaccgaaccgggccctacgtccggtacccttcccccgnggcccgtcccgtcgcctccgacggacgccacccgtcgacgacgcgacacggcccggccgtcgggctcgcgtacggtacgaacgtaccttaccgttccctaacgcgttcgccgttacgtcggacggccgggtacgttcgggaccgaacggtccgaacgtacgtacgctcgcgcgagcgcacgcgcgcgcgancgcgcgcagngcgnnacgacgacnncngngcg

SEQ ID NO: 36061 - DNA, 598 bp, Homo sapiens
  misc_feature: GYAE6OF01EUW9T.4.78.H01.1.454.CMB.1.raw
  modified_base (386)..(386): a, c, t, g, unknown or other
  misc_feature (386)..(386): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(572): a, c, t, g, unknown or other
  misc_feature (571)..(572): n is a, c, g, or t
  modified_base (574)..(577): a, c, t, g, unknown or other
  misc_feature (574)..(577): n is a, c, g, or t
  modified_base (579)..(582): a, c, t, g, unknown or other
  misc_feature (579)..(582): n is a, c, g, or t
  modified_base (584)..(590): a, c, t, g, unknown or other
  misc_feature (584)..(590): n is a, c, g, or t
  modified_base (592)..(598): a, c, t, g, unknown or other
  misc_feature (592)..(598): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggattttttgattatgccgcatctctgagaggtcgaataagcatcaacccagacacaaaccaagaaccagttttcgctgcagttgaagtctgtcgacccccagagacacggctctctatttctgtgtgagacgcctcctcttccgcgttatgactacgtgggccaagggaaccctggtcaccgtctcctcacgccctccaaccgacgggcccctagttccggtcccttcccccgtcggcccgcccctgccctccagggacnccacctccggaagacgcaacgacggccgggtcccgtcggggcctcgcccgttagggtaccgtaaacgggtaccctttaacccgttcccgtaacgtacggttaccgtccgttcggtacgggaccgggtcccgggggtagttccgggaaccggtaacgggtcccggactaacgtagggncgcncngnncnnnngnnnngnnnnnnngnnnnnnn

SEQ ID NO: 36062 - DNA, 593 bp, Homo sapiens
  misc_feature: GYAE6OF01D9SCS.4.78.H01.1.454.CMB.1.raw
  modified_base (404)..(404): a, c, t, g, unknown or other
  misc_feature (404)..(404): n is a, c, g, or t
  modified_base (564)..(564): a, c, t, g, unknown or other
  misc_feature (564)..(564): n is a, c, g, or t
  modified_base (567)..(569): a, c, t, g, unknown or other
  misc_feature (567)..(569): n is a, c, g, or t
  modified_base (571)..(572): a, c, t, g, unknown or other
  misc_feature (571)..(572): n is a, c, g, or t
  modified_base (574)..(593): a, c, t, g, unknown or other
  misc_feature (574)..(593): n is a, c, g, or t
tcagagcactgtagcacgaccggtgctcgatttagtgtgagtagtttggggtttgggggggactgggtcaggcagtccccatcgagaggccttgagtggctgggacggacttatttccggtccaagtggattttttgattatgccgcatctctgagaggtcgaataagcatcaacccagacacaaaccaagaacctagttttcgctgcagttgaagtctgtcgaccccagagacacggctctctatttctgtgtgagagcctcctcttccggcgtatgacctacgtcggggccacgggaaccctggtccaccgtcctcctcacgccctaccgaaccgaacgggcccctacgtcccgggttccctttccccccgtgggccccgtccccgtgccctcccgaggacnccacccgtccgagacgccaccgacggcccggcccgtcgggcctcgtcccgtacggtaccgtaacggtacccttacccttacccgtaacacggttcgtccgtcgtagggacgggtaccggggtccgtaacgggaccgtaacgggcccgacgtaagtacggncgnnngnncnnnnnnnnnnnnnnnnnnnn

SEQ ID NO: 36063 - DNA, 612 bp, Homo sapiens
  misc_feature: GYAE6OF01B8F8R.4.78.H01.1.454.CMB.1.raw
  modified_base (250)..(250): a, c, t, g, unknown or other
  misc_feature (250)..(250): n is a, c, g, or t
  modified_base (572)..(572): a, c, t, g, unknown or other
  misc_feature (572)..(572): n is a, c, g, or t
  modified_base (582)..(582): a, c, t, g, unknown or other
  misc_feature (582)..(582): n is a, c, g, or t
  modified_base (590)..(612): a, c, t, g, unknown or other
  misc_feature (590)..(612): n is a, c, g, or t
tcagagcactgtagcacgaccggtgctcgatttagtgtgagtagtttggggtttggggggactgggtcaggcagtccccatcgagaggccttgagtggctgggacgacttatttccggtccaagtggtatttttgattatgccgcatctctgagaggtcgaataagcatcaacccagacacaaaccaagacctagttttcgctgcagttgaagtctgtcgaccccagagacgacgtctctcttatttcgngtgtgagacgtccttcctcttaccgcgtaatcgtacgtacggtcgggaccacggaacccgttggtcctaccggttctccctcgacgtccctaccaaccgaaccggccctagttcccgggttcccctttcccccggcgggtccccgtaccccgtcggtaccccgtaccgtaacggaccgcctaaccccgtacggaacgtacgccgaaaccgcgggtcccgacccggttcggccgttaccggcccgtaggtaccgaacgtccttaccgtcccgtaagtcgtcgtcgtcgtacggacggtcgggtcgtagaccgtaacggcaacngtaagctagntcagcgannnnnnnnnnnnnnnnnnnnnnn

SEQ ID NO: 36064 - DNA, 791 bp, Homo sapiens
  misc_feature: GYAE6OF01DEEWN.4.78.H01.1.454.CMB.1.raw
  modified_base (146)..(146): a, c, t, g, unknown or other
  misc_feature (146)..(146): n is a, c, g, or t
  modified_base (700)..(700): a, c, t, g, unknown or other
  misc_feature (700)..(700): n is a, c, g, or t
tcagagcactgtagcacgaccggtgctcgatttagtgtgagtagtttgggtttggggggactgggtcaggcagtccccatcgagaggccttgagtggcgtgggacggacttatttccggtccaagtggtatttttgattatgccgnatctctgagaggtacgaataagcatacaaccagacacaaacaagaacctagtttcgctgctagttagaagttctgtaccgaccccgagaacgaccgacggtcttcttacgttatttcgtagtgtagacgaccgtccttccttcgttccgtagttacgtacgtacgttacggcgggtaaccgaaccggggtaacccgtcggtacccgtaccggttcctacccgtacgaccgtacccgtacccgaaccggaaccggcccttaccggttcccggttccccttccccggtccggtccccgtccctacggtacccctacggaaccgggacctaccgtaaccccggtacggaacgaccgtacccgaacggcccggggtacccgggtccgtccgggtacgttaccggtacccgggttacgggaacctaaacgggttacccttaaccccgttttaccccggaagtaccgggtttcccgtacccgttaacgggtacgggtaccggggcccggttacgggtaaggacccggaaacggggtaccacggttaaacggtgagtacgngtacgtcgtacgtacgacgacgtcgtacgtacgtacgtacgacgtacgtcgacgacgtacgacgtagacgtacgtcacgacgtacgtcgtc

SEQ ID NO: 36065 - DNA, 411 bp, Homo sapiens
  misc_feature: GYAE6OF01EC3B2.4.78.H01.1.454.CMB.1.raw
  modified_base (382)..(411): a, c, t, g, unknown or other
  misc_feature (382)..(411): n is a, c, g, or t
tcagagcactgtagcacgaccggtgctcgatttagtgtgagtagtttggggtttggggggactgggtcaggcagtccccatcgagaggccttgagtggctgggacggacttatttccggtccaagtggtattttttgattatgccgcatctctgagaggtcgaataagcataccaacccagaacaacaaaccgaaagaacctagttttcgctgctagttgaacgtctcgtacgacccccagacacgacggtcctcttcttactttctagtgtagacgtacgtcccttcctcgttccgtacgtagtacgtacgtacggtacggaccgacggtaccgtcggtacctaccgtcctcctacacgtccctaccgaaccgaccggtannnnnnnnnnnnnnnnnnnnnnnnnnnnnn

SEQ ID NO: 36066 - DNA, 708 bp, Homo sapiens
  misc_feature: GYAE6OF01D74T4.4.78.H01.1.454.CMB.1.raw
  modified_base (496)..(496): a, c, t, g, unknown or other
  misc_feature (496)..(496): n is a, c, g, or t
  modified_base (672)..(672): a, c, t, g, unknown or other
  misc_feature (672)..(672): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
  modified_base (682)..(684): a, c, t, g, unknown or other
  misc_feature (682)..(684): n is a, c, g, or t
  modified_base (687)..(688): a, c, t, g, unknown or other
  misc_feature (687)..(688): n is a, c, g, or t
  modified_base (693)..(696): a, c, t, g, unknown or other
  misc_feature (693)..(696): n is a, c, g, or t
  modified_base (698)..(700): a, c, t, g, unknown or other
  misc_feature (698)..(700): n is a, c, g, or t
  modified_base (702)..(708): a, c, t, g, unknown or other
  misc_feature (702)..(708): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggtattttttgattatgccgcatctctgagaggtacgaaataagcactaccaaacccagaacaaccaaaccgaaacgaaacctagtttttcgctgactagttgaagtctcgtaccgaacccccagacgacgacggtccttcttacttatttcgttgtgtgacgacgtcccttcttcctaccgcgttatcgaactacggtccggggaccgacgggaacccgtcggtccgtacccgttcctcccgtaccgaccgtcccttacccgaccggaaccgggtcccctaacggttccccggttccctttcccccggtcgggccccgttccctccggtccctccggaacggtccacccgtacccgtacggaacgtaccnccggaaacgccgggaccggtcccggtcgggccgtaccggtcccgtagggtaaccgtaaccggttaacccttaccctttaccccgtaacgttcggtacccgtaccgttaccgtacggggaccgggtccgggacggtcggggaccgggtacggaccggtacgtaacggtacgtgaccngcagngnacnnncgnnacgannnngnnncnnnnnnn

SEQ ID NO: 36067 - DNA, 636 bp, Homo sapiens
  misc_feature: GYAE6OF01A81L4.4.78.H01.1.454.CMB.1.raw
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (555)..(555): a, c, t, g, unknown or other
  misc_feature (555)..(555): n is a, c, g, or t
  modified_base (564)..(564): a, c, t, g, unknown or other
  misc_feature (564)..(564): n is a, c, g, or t
  modified_base (615)..(636): a, c, t, g, unknown or other
  misc_feature (615)..(636): n is a, c, g, or t
tcagagcactgtagcacgaccggtgctcgatttagtgtgagtagtttgggtttgggggggactgggtcaggcagtccccatcgagaggccttgagtggctgggacggacttatttccggtccaagtggatttttgattatgccgcatctctgagaggtcgaataagcatccaaaccccagacaacaaaccaacgaacctagtttcgntgcagttgaagtctgtcgacccccagagacacggctctccttattttcngtagttgagacnccctccgttccgttccgcgttatacgaaccgttacggtcggggacccgtaacggggaaccccttgggttacccctccggttcctccctaccgaccgcccctacccaaccccggtaaaggggcccccctaacggttcccggtttcccccttcccccccggtcggggccccgtcccccgtcgtccctccggaacggccgtacccacccgtacccggacgacggccaccgacggtccccggcccgtcggggtctcggtcccgttcgggtaccgaaccggacctttacccncccctaagngttcgcccttagtcggaggcccggtcgtagggaacccgaggctacatgccnnnnnnnnnnnnnnnnnnnnnn

SEQ ID NO: 36068 - DNA, 537 bp, Homo sapiens
  misc_feature: GYAE6OF01AQBG4.4.78.H01.1.454.CMB.1.raw
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
  modified_base (502)..(502): a, c, t, g, unknown or other
  misc_feature (502)..(502): n is a, c, g, or t
  modified_base (513)..(513): a, c, t, g, unknown or other
  misc_feature (513)..(513): n is a, c, g, or t
  modified_base (515)..(522): a, c, t, g, unknown or other
  misc_feature (515)..(522): n is a, c, g, or t
  modified_base (524)..(537): a, c, t, g, unknown or other
  misc_feature (524)..(537): n is a, c, g, or t
tcagagcactgtagcacgaccggtgctcgatttagtgtgagtagtttgggtttgggggggactgggtcaggcagtcccatcgagaggccttggagtggctgggacggacttattccggtccaagtggattttttgattatgccgcatctctgagaggtcgaataagcatcaacccagacacaaaccaagaacctagttttcgctgcagttgaatctgtacgaccccagacgacacgtctctctatttctatgtgagcgtcctctccttcgcgtatgactcgtgggccacggtaaccctggtacaccgtcctacctcacgcctaccaccgacggccctagtccgtccttcccccgtggccnccctgacctccgaggacnccgtacctcgacggngcacgacgccggtaccgtgggcttcgccgtagggtaccgaacggtaccttacccgtttccgaactgtcgtactaccgtgaccggcggtctggacgaaggcatacgagtncgtcagtgatncnnnnnnnngnnnnnnnnnnnnnn

SEQ ID NO: 36069 - DNA, 606 bp, Homo sapiens
  misc_feature: GYAE6OF01CU2NL.4.78.H01.1.454.CMB.1.raw
  modified_base (147)..(147): a, c, t, g, unknown or other
  misc_feature (147)..(147): n is a, c, g, or t
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
  modified_base (569)..(569): a, c, t, g, unknown or other
  misc_feature (569)..(569): n is a, c, g, or t
  modified_base (573)..(573): a, c, t, g, unknown or other
  misc_feature (573)..(573): n is a, c, g, or t
  modified_base (587)..(599): a, c, t, g, unknown or other
  misc_feature (587)..(599): n is a, c, g, or t
  modified_base (601)..(604): a, c, t, g, unknown or other
  misc_feature (601)..(604): n is a, c, g, or t
  modified_base (606)..(606): a, c, t, g, unknown or other
  misc_feature (606)..(606): n is a, c, g, or t
tcagagcactgtagcacgaccggtgctcgatttagtgtgagtagtttggggtttggggggactgggtcaggcagtccccatcgagaggccttgagtggctgggacggtacttatttccggtccaagtggattttttgattatgccgnatctctgagaggtcgaataagcatcaaacccagacacaaaccaagaacctagttttcgctgctagttgaagtctgtcgacccccagacgacgaccggctctcttatttcgtgtgtagagacgccttcctcgttccgcgtatgactcgtcgggaccacgggaccctgtcnccgtctacctcncgtcctaccaccgacggcccagttccggtccctcccctggccctcccgtcgcctccgacggtcgccctacccgtaccgtacggacgtaccacggaccggcccgggtacccgtggggacccttcggtcccgttagggtaccgaacggtacctttaccccgtacccttaaggcgttcgtcccgttagtacgggacgggtccgggacggttaggaacccgggtaggccggtaacgaagtgactntcgntagctagcatgacnnnnnnnnnnnnnannnngn

SEQ ID NO: 36070 - DNA, 450 bp, Homo sapiens
  misc_feature: GYAE6OF02ILDO9.4.78.H01.1.454.CMB.1.raw
  modified_base (444)..(450): a, c, t, g, unknown or other
  misc_feature (444)..(450): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggatttttgattatgccgcatctctgagaggtcgaataagcatcaacccagacacaaccaagaaccagtttcgctgcagttgaagtctgtgacccccagagacacggctctctatttctgtgtgagagcctcctcttccgcgtatgactactggggccagggaacccctggtcaccgtctcctcagcctccaccaagggcccatcggtcttccccctggcgccctgctccaggagcacctccgagagcacagcggccctgggctgcctggtcaaggactactccctacagtgctctgagcgggctggcaaggcgcatagnnnnnnn

SEQ ID NO: 36071 - DNA, 454 bp, Homo sapiens
  misc_feature: GYAE6OF02GT82U.4.78.H01.1.454.CMB.1.raw
  modified_base (445)..(454): a, c, t, g, unknown or other
  misc_feature (445)..(454): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaacccctggtcaccgtctcctcagcctccaccaagggcccatcggtcttcccctggcgccctgctccaggagcacctccgagagcacagcggccctgggctgcctggtcaaggactacttccctacagtgctctgagcgggctggcaaggcgcatagnnnnnnnnnn

SEQ ID NO: 36072 - DNA, 450 bp, Homo sapiens
  misc_feature: GYAE6OF02HQUZT.4.78.H01.1.454.CMB.1.raw
  modified_base (443)..(450): a, c, t, g, unknown or other
  misc_feature (443)..(450): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcacgtctcctcagcctccaccaagggcccatcggtcttccccctggcgccctgctccaggagcacctccgagagcacagcggccctgggctgcctggtcaaggctacttccctacagtgctctgagcgggctggcaaggcgcatagnnnnnnnn

SEQ ID NO: 36073 - DNA, 498 bp, Homo sapiens
  misc_feature: GYAE6OF02JVUBE.4.78.H01.1.454.CMB.1.raw
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (439)..(439): a, c, t, g, unknown or other
  misc_feature (439)..(439): n is a, c, g, or t
  modified_base (474)..(474): a, c, t, g, unknown or other
  misc_feature (474)..(474): n is a, c, g, or t
  modified_base (481)..(498): a, c, t, g, unknown or other
  misc_feature (481)..(498): n is a, c, g, or t
tcagagcactgtagcacgaccggtgctcgatttagtgtgagtagtttgggtttgggggactgggtcaggcagtccccatcgagaggccttgagtggctgggacggacttatttctggtccaagtggatttttgattatgccgcatctctgagaggtcgaataagcatcaacccagacacaaccaagaaccagttttcgctgcagttgaagtctgtgacccccagagacacggctctctattctgtgtgagagcctcctcttccgcgtatgactactggggccagggaaccctggtcaccgtctcctcacgcctccaccaacgggccccatccggtccttcccccnggccncccctgcctccaggagccacctccgagacgcacagccggccctggggcctcgcccgtgggtccaaacgggtaccttaccttcccctaanacgtcgccttctggaggccgggctgggcaagggcncagtagnnnnnnnnnnnnnnnnnn

SEQ ID NO: 36074 - DNA, 516 bp, Homo sapiens
  misc_feature: GYAE6OF02G3ULK.4.78.H01.1.454.CMB.1.raw
  modified_base (499)..(500): a, c, t, g, unknown or other
  misc_feature (499)..(500): n is a, c, g, or t
  modified_base (502)..(516): a, c, t, g, unknown or other
  misc_feature (502)..(516): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactctaaaaaagggccacgggaaccctcggtcaccgtctcctcacgcctccaccaacggcccactccggtccttccccctcggccgcccctcgcctccacggacgccacctccgacgacgcacgacgccggccccgtcggggcgtcgccgtcggtccgaacggaacctaccttcccctaccacgtcgcctctcggacggcgggcgtcgggcgaacggcgcgagtagnngnnnnnnnnnnnnnnn

SEQ ID NO: 36075 - DNA, 452 bp, Homo sapiens
  misc_feature: GYAE6OF02GDFUP.4.78.H01.1.454.CMB.1.raw
  modified_base (443)..(452): a, c, t, g, unknown or other
  misc_feature (443)..(452): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctattctgtgtgagagcctcctcttccgcgtatgactactggggccagggaaccctggtcaccgtctcctcagcctccaccaagggcccatcggtcttcccctggcgccctgctccaggagcacctccgagagcacagcggccctgggctgcctggtcaaggactactccctacagtgctctgacgcgggctggcaaggcgcatagnnnnnnnnnn

SEQ ID NO: 36076 - DNA, 455 bp, Homo sapiens
  misc_feature: GYAE6OF02IFLAC.4.78.H01.1.454.CMB.1.raw
  modified_base (449)..(455): a, c, t, g, unknown or other
  misc_feature (449)..(455): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaagggcccatccggtcttccccctggccgccctgcctccaggacgcacctccgagagcacagcggccctgggctgcctggtcaggacctacttccctacagtgctctgagcggctggcaaggcgcatagnnnnnnn

SEQ ID NO: 36077 - DNA, 472 bp, Homo sapiens
  misc_feature: GYAE6OF02H9NJ4.4.78.H01.1.454.CMB.1.raw
  modified_base (463)..(472): a, c, t, g, unknown or other
  misc_feature (463)..(472): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgaccccagagacacggctctctatttctgtgtgagagcctcctcttccgcgtatgactactggggccagggaaccctggtcaccgtctcctcagcctccaccaagggcccatcggtcttccccctggccgccctgctccaggacgccacctccgagacgcacaggccggccctggggcctggcctgggtcaagggacttaccttcccctaacagtgctctgaggcgggctgggcaaggccgcatagnnnnnnnnnn

SEQ ID NO: 36078 - DNA, 457 bp, Homo sapiens
  misc_feature: GYAE6OF02FYAAC.4.78.H01.1.454.CMB.1.raw
  modified_base (442)..(442): a, c, t, g, unknown or other
  misc_feature (442)..(442): n is a, c, g, or t
  modified_base (448)..(457): a, c, t, g, unknown or other
  misc_feature (448)..(457): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctattctgtgtgagagcctcctcttccgcgtatgactactggggccagggaaccctggtcaccgtctcctcagcctccaccaagggcccatcggtcttcccctggccgccctgctccaggacgccacctccgagacgcacagcggccctggggcctgcctggtcaaggactacttcccacagtgctctgagcgggctggcaaggcncatagnnnnnnnnnn

SEQ ID NO: 36079 - DNA, 452 bp, Homo sapiens
  misc_feature: GYAE6OF02IE0OJ.4.78.H01.1.454.CMB.1.raw
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (440)..(452): a, c, t, g, unknown or other
  misc_feature (440)..(452): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaaggcccatcggtcttcccctggcgccctgctccaggacgcacctccgagagcacagcgccctgggctgcctggtcaggctactccctacngtnctctgagcggctggcaaggccgcatagnnnnnnnnnnnnn

SEQ ID NO: 36080 - DNA, 453 bp, Homo sapiens
  misc_feature: GYAE6OF02HQAKF.4.78.H01.1.454.CMB.1.raw
  modified_base (441)..(441): a, c, t, g, unknown or other
  misc_feature (441)..(441): n is a, c, g, or t
  modified_base (447)..(453): a, c, t, g, unknown or other
  misc_feature (447)..(453): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctacaccaagggcccatcggtcttccccctggcgccctgctccaggagcacctccgagagcacagcggccctggggctgcctggtcaaggactacttccctacagtgctctgagcgggctggcaaggcncatagnnnnnnn

SEQ ID NO: 36081 - DNA, 574 bp, Homo sapiens
  misc_feature: GYAE6OF02I8TBK.4.78.H01.1.454.CMB.1.raw
  modified_base (381)..(381): a, c, t, g, unknown or other
  misc_feature (381)..(381): n is a, c, g, or t
  modified_base (497)..(497): a, c, t, g, unknown or other
  misc_feature (497)..(497): n is a, c, g, or t
  modified_base (499)..(500): a, c, t, g, unknown or other
  misc_feature (499)..(500): n is a, c, g, or t
  modified_base (502)..(503): a, c, t, g, unknown or other
  misc_feature (502)..(503): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
  modified_base (545)..(545): a, c, t, g, unknown or other
  misc_feature (545)..(545): n is a, c, g, or t
tcagagcactgtagcacgaccggtgctcgatttagtgtgagtagtttgggtttggggggactgggtcgaggcagtccccatcgagaggccttgagtggtctgggacggacttatttcccggtccaagtggattttttgattatgccgcatctctgtagaggtcgaataaggtcatcaacccagtacacaaccaagaaccagttttcgctgcagttgaagtctgtggacccccagagacacggctcgtctattctgtgtgagacgcctcctcttcccgcgtatgactactgggccagggacccctggtcaccgtctcctcaggccctccaccaacgggcccatccgggtccttcccccgtggccgccctgcctcctacgganccaccgtccggagacgcacacgcggccctggggcctcggcccgtggtcaacgggccctacttccccaacacgtcgcctcgtagacggccgggctgggaccaaggccgctagtagcntnncnncagnacgtgntacgancgtcgagaggaccgggattaccgggngtacgtacgtacgtactcgtacgtcgtcg

SEQ ID NO: 36082 - DNA, 451 bp, Homo sapiens
  misc_feature: GYAE6OF02FFZ99.4.78.H01.1.454.CMB.1.raw
  modified_base (444)..(451): a, c, t, g, unknown or other
  misc_feature (444)..(451): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaaggcccatcggtctcccctggccgccctgctccaggacgcacctccgagagcacagcggccctgggctgcctggtcaaggactacttcccacagtgctctgagcgggctggcaaggcgcatagnnnnnnnn

SEQ ID NO: 36083 - DNA, 454 bp, Homo sapiens
  misc_feature: GYAE6OF02F2VV6.4.78.H01.1.454.CMB.1.raw
  modified_base (444)..(454): a, c, t, g, unknown or other
  misc_feature (444)..(454): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaaggcccatcggtcttcccctgccgcctgctccaggagcacctccgagacgcacagcggccctgggctgcctggtcaaggactacttccctacagtgctctgagcgggctggcaaggcgcatagnnnnnnnnnnn

SEQ ID NO: 36084 - DNA, 451 bp, Homo sapiens
  misc_feature: GYAE6OF02F6DRO.4.78.H01.1.454.CMB.1.raw
  modified_base (409)..(409): a, c, t, g, unknown or other
  misc_feature (409)..(409): n is a, c, g, or t
  modified_base (433)..(433): a, c, t, g, unknown or other
  misc_feature (433)..(433): n is a, c, g, or t
  modified_base (439)..(451): a, c, t, g, unknown or other
  misc_feature (439)..(451): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaaggcccatcggtcttcccctggcgccctgctccaggagcacctctggggcacagcggccctgggctgcctggcaaggctactccctacngtgctctgagcgggctggcaggcncatagnnnnnnnnnnnnn

SEQ ID NO: 36085 - DNA, 463 bp, Homo sapiens
  misc_feature: GYAE6OF02GFM1A.4.78.H01.1.454.CMB.1.raw
  modified_base (341)..(341): a, c, t, g, unknown or other
  misc_feature (341)..(341): n is a, c, g, or t
  modified_base (412)..(412): a, c, t, g, unknown or other
  misc_feature (412)..(412): n is a, c, g, or t
  modified_base (445)..(463): a, c, t, g, unknown or other
  misc_feature (445)..(463): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctattctgtgtgagagcctcctcttccgcgtatgactactggggccagggaaccctggtcaccgtctcctcagcctccaccaagggcccatccggtcttccccnggccgccctgcctccaggacgcacctcgagagcacagcggccctgggctgcctggtcaaggctactcccanagtgctctgacgcgggctggcaaggcgcatagnnnnnnnnnnnnnnnnnnn

SEQ ID NO: 36086 - DNA, 454 bp, Homo sapiens
  misc_feature: GYAE6OF02HT8SF.4.78.H01.1.454.CMB.1.raw
  modified_base (443)..(454): a, c, t, g, unknown or other
  misc_feature (443)..(454): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctattctgtgtgagagcctcctcttccgcgtatgactactggggccagggaaccctggtcaccgtctcctcagcctccaccaagggcccatccggtcttcccctggccgccctgctccaggagcacctctgggggcacagcggcctgggctgcctggtcaaggactacttccctacagtcgctctgagcgggctggcaggcgcatgnnnnnnnnnnnn

SEQ ID NO: 36087 - DNA, 463 bp, Homo sapiens
  misc_feature: GYAE6OF02H3SN3.4.78.H01.1.454.CMB.1.raw
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (450)..(450): a, c, t, g, unknown or other
  misc_feature (450)..(450): n is a, c, g, or t
  modified_base (453)..(463): a, c, t, g, unknown or other
  misc_feature (453)..(463): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtgacccccagagacacggctctctatttctgtgtgagagcctctcttccgcgtatgactactggggccagggaaccctggtcaccgtctcctcagcctccaccaagggcccatccggtcttccccctggccgccctgcctccaggcgcacctccgagcgcacagcgccctgggctgcctggtcaaggactaccttcccctacngtcnctctgacggcgggctggcaaggcgcanagnnnnnnnnnnn

SEQ ID NO: 36088 - DNA, 523 bp, Homo sapiens
  misc_feature: GYAE6OF02G6T7B.4.78.H01.1.454.CMB.1.raw
  modified_base (400)..(400): a, c, t, g, unknown or other
  misc_feature (400)..(400): n is a, c, g, or t
  modified_base (494)..(495): a, c, t, g, unknown or other
  misc_feature (494)..(495): n is a, c, g, or t
  modified_base (497)..(523): a, c, t, g, unknown or other
  misc_feature (497)..(523): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactacgtgggccaagggaaccctggtcaccgtctcctcaggctccaccaacggcccacgtcggtccttcccctggcgcccctgcctcaggacgccaccgtccgagagcacgacgccggaccctggcncgcctggtacaaacggtcctaaccttaccctaacgtacggtcgccttacgtggaacggccgggtacgtcgggacgaaacggcgactaagtacgnnannnnnnnnnnnnnnnnnnnnnnnnnnn

SEQ ID NO: 36089 - DNA, 525 bp, Homo sapiens
  misc_feature: GYAE6OF02GMG24.4.78.H01.1.454.CMB.1.raw
  modified_base (496)..(496): a, c, t, g, unknown or other
  misc_feature (496)..(496): n is a, c, g, or t
  modified_base (499)..(525): a, c, t, g, unknown or other
  misc_feature (499)..(525): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactacgtggggccagggaaccctggtcaccgtctcctcagcctccaccaagggcccagtccggtccttccccctggccctcccctgccctccacggacgccacccgtccgagacgccacacgctacgcccgtgggctcggcctggtaccaaggtacctacttccctacgagtcgacttcgtggacggcgggtactcgggaccgaacgggccgactagtaacggncgnnnnnnnnnnnnnnnnnnnnnnnnnnn

SEQ ID NO: 36090 - DNA, 540 bp, Homo sapiens
  misc_feature: GYAE6OF02F9693.4.78.H01.1.454.CMB.1.raw
  modified_base (345)..(345): a, c, t, g, unknown or other
  misc_feature (345)..(345): n is a, c, g, or t
  modified_base (514)..(517): a, c, t, g, unknown or other
  misc_feature (514)..(517): n is a, c, g, or t
  modified_base (519)..(540): a, c, t, g, unknown or other
  misc_feature (519)..(540): n is a, c, g, or t
tcagagcactgtagcacgaccggtgctcgatttagtgtgagtagtttgggtttggtgggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaacgggcccatccggtccttcccccnggccgccctgccttcccaggacgccaccctccgacgagccacaggccggccctgggcctcgccgtggtccgaaagggtaccttaaccgttcccctaacgacgtcggcccttctacggacgggccggggttacgtcgggaccgtaagggccgcgtaacgacgggtcagcnnnngnnnnnnnnnnnnnnnnnnnnnn

SEQ ID NO: 36091 - DNA, 495 bp, Homo sapiens
  misc_feature: GYAE6OF02FIGTG.4.78.H01.1.454.CMB.1.raw
  modified_base (476)..(495): a, c, t, g, unknown or other
  misc_feature (476)..(495): n is a, c, g, or t
tcagagcactgtagcacgaccggtgctcgatttagtgtgagtagtttgggtttgggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctattctgtgtgagagcctcctcttccgcgtatgactactggggccagggaaccctggtcaccgtctcctcacgccctccaccaagggccccaatccggtccttccccccgtgggccgcccctgcctccgaggacgccaccctccgagacgcacaggccggccctggggctggcctggtcaaggactaccttccccacagtgcctcgtgacggcgggctcggcgaacggcgacatagnnnnnnnnnnnnnnnnnnnn

SEQ ID NO: 36092 - DNA, 547 bp, Homo sapiens
  misc_feature: GYAE6OF02HBO3X.4.78.H01.1.454.CMB.1.raw
  modified_base (513)..(513): a, c, t, g, unknown or other
  misc_feature (513)..(513): n is a, c, g, or t
  modified_base (521)..(547): a, c, t, g, unknown or other
  misc_feature (521)..(547): n is a, c, g, or t
tcagagcactgtagcacgaccggtgctcgatttagtgtgagtagtttggggtttgggggggactgggtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtcgacccccagagacacggctctctatttctgtgtgagagcctcctcttccgcgtatgactacgtcggggccagggaaccctggtccaccgtctccctcacgcctcccaccaacgggcccagtccggtcctcccccgtggccgcccctgcctccgaggacgcccgaccgtccgagacgacacgaggccgcccgtagggcctcgcccgtggtaccgaagggtaccctacctttcccctacgtacgtcgcgtacgtggacggccggggtcgtacgggacgaacggggccagaacgtancgtgacgnnnnnnnnnnnnnnnnnnnnnnnnnnn

SEQ ID NO: 36093 - DNA, 478 bp, Homo sapiens
  misc_feature: GYAE6OF02FJ8ED.4.78.H01.1.454.CMB.1.raw
  modified_base (457)..(457): a, c, t, g, unknown or other
  misc_feature (457)..(457): n is a, c, g, or t
  modified_base (461)..(478): a, c, t, g, unknown or other
  misc_feature (461)..(478): n is a, c, g, or t
tcagagcactgtagcacgaccggtgctcgatttagtgtgagtagtttggggtttgggggggactgggtcaggcagtccccatcgagaggccttgagtggctgggacggacttatttccggtccaagtggattttttgattatgccgcatctctgagaggtcgaataagcatcaaccccagacacaaccaagaaccagttttcgctgcagttgaagtctgtgaccccccagagacacggctctctattctgtgtgagagcctcctcttccgcgtatgactactggggccagggaacccctggtcacccggtctcctcagcctccaccaaggcccatcggtccttccccctggccacccctcctccaacgacgccaccctcgtggggccacgacgcggccctgggcctgccctggcaaggctactcctacacgtgctctgagcgggctggcaggcgcanacgnnnnnnnnnnnnnnnnnn

SEQ ID NO: 36094 - DNA, 553 bp, Homo sapiens
  misc_feature: GYAE6OF02F7L10.4.78.H01.1.454.CMB.1.raw
  modified_base (354)..(354): a, c, t, g, unknown or other
  misc_feature (354)..(354): n is a, c, g, or t
  modified_base (454)..(454): a, c, t, g, unknown or other
  misc_feature (454)..(454): n is a, c, g, or t
  modified_base (527)..(530): a, c, t, g, unknown or other
  misc_feature (527)..(530): n is a, c, g, or t
  modified_base (532)..(536): a, c, t, g, unknown or other
  misc_feature (532)..(536): n is a, c, g, or t
  modified_base (539)..(540): a, c, t, g, unknown or other
  misc_feature (539)..(540): n is a, c, g, or t
  modified_base (542)..(547): a, c, t, g, unknown or other
  misc_feature (542)..(547): n is a, c, g, or t
  modified_base (549)..(552): a, c, t, g, unknown or other
  misc_feature (549)..(552): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggattttttgattatgccgcatctctgagaggtcgaataagcatcaacccagacacaaccaagaaccagttttcgctgcagttgaagtctgtgacccccagagacacggctctctatttctgtgtgagacgcctcctcttccgcgtatgactagtgggccagggacccctggtcaccgtctcctcacgcctcaccgaagggcccagtccggtccttcccccgtggcccnccctgcctccgaggacgccaccctccggaacgtacgccacgacgaccggcccgtgggcctcggcccgtggtccgaacgggtacctaccgttcccctacgngttccgcgttcgtcggacggccgggcgttacgggaccgaacgggcgacgtaacgtaggactgacgctagcgcnnnncnnnnngcnngnnnnnncnnnng

SEQ ID NO: 36095 - DNA, 563 bp, Homo sapiens
  misc_feature: GYAE6OF02HT1TS.4.78.H01.1.454.CMB.1.raw
  modified_base (372)..(372): a, c, t, g, unknown or other
  misc_feature (372)..(372): n is a, c, g, or t
  modified_base (533)..(533): a, c, t, g, unknown or other
  misc_feature (533)..(533): n is a, c, g, or t
  modified_base (535)..(537): a, c, t, g, unknown or other
  misc_feature (535)..(537): n is a, c, g, or t
  modified_base (539)..(540): a, c, t, g, unknown or other
  misc_feature (539)..(540): n is a, c, g, or t
  modified_base (542)..(563): a, c, t, g, unknown or other
  misc_feature (542)..(563): n is a, c, g, or t
tcagagcactgtagcacgaccggtgctcgatttagtgtgagtagtttggggtttgggggggactgggtcaggcagttccccatcgagaggccttgagtggctgggacggacttaatttcgggtccaagtggatttttgattatgccgcatctctgagaggtcgaataagcatcaacccagacacaaccaagaaccagttttcgctgcagttgaagtctgtcgacccccagagacacggctctctatttctgtgtgagacgcctccttcttccgcgtatcgactacgtcgggccacgggaaccctggtccaccgtcctcctcacgcctccaccgaacgggccctactccggtccttcccccgtggccgccctncctccgacggacgccaccctacgagacgacacgacggcccgcccgtgggcctcggccgtgggtaccgaaggtacccttaaccgtttcccctaacggtacgtcgtccttcgtacgggacggtccggggcgttcgggacgtaacgggccggactagtaacggngnnngnngnnnnnnnnnnnnnnnnnnnnnn

SEQ ID NO: 36096 - DNA, 663 bp, Homo sapiens
  misc_feature: GYAE6OF02G7TAW.4.78.H01.1.454.CMB.1.raw
  modified_base (145)..(145): a, c, t, g, unknown or other
  misc_feature (145)..(145): n is a, c, g, or t
  modified_base (586)..(586): a, c, t, g, unknown or other
  misc_feature (586)..(586): n is a, c, g, or t
  modified_base (608)..(608): a, c, t, g, unknown or other
  misc_feature (608)..(608): n is a, c, g, or t
tcagagcactgtagcacgaccggtgctcgatttagtgtgagtagtttgggtttggggggactgggtcaggcagtccccatcgagaggccttgagtggctgggacggacttatttccggtccaagtggattttttgattatgccgnatctctgagaggtcgaataagcatcaacccagacacaaaccaagaaccagttttacgctgctagttgaagtctgtcgacccccagacgacaccggctctcttattcgtgtgtgacgacgtcctccgttctaccgtcgtatcgactacgcggggaccaacgggtacccgtggtcctaccggtcctcctacgtacgcctacccgaccgaccggccctacgtccgttccttcccccgtggcccgccttcgacccgtccgacggacctccgtacccgtaccggacgacgaccaccgtacggcccggtcccggtgggcctcggtacccgtcgggtaaccgtaaccgggtaccttacccgtttaccccgtaacggtagttccgtccttaccggtggacccggtcgggtcgttacggacgtacgggaccgtcgaagtacgtgactcgngcgatccgagaccgtgtaccgngtacgagctacggctacggcgtccgcgttacctcggtacgcgtctcgactcgacg

SEQ ID NO: 36097 - DNA, 863 bp, Homo sapiens
  misc_feature: GYAE6OF02FOSE3.4.78.H01.1.454.CMB.1.raw
  modified_base (795)..(795): a, c, t, g, unknown or other
  misc_feature (795)..(795): n is a, c, g, or t
  modified_base (812)..(812): a, c, t, g, unknown or other
  misc_feature (812)..(812): n is a, c, g, or t
  modified_base (850)..(850): a, c, t, g, unknown or other
  misc_feature (850)..(850): n is a, c, g, or t
tcagagcactgtagcacgaccggtgctcgatttagtgtgagtagtttgggtttgggggactgggtcaggcagtccccatcgagaggccttgagtggctgggacggacttatttccggtccaagtggattttttgattatgaccgcatctctgagaggtacgaataagctatacaacccagacacaaccaagaacctagttttcgctgcagttagaagttcgtgtacgaaccccctagacgacgaccggtctaccttacttacgtttcgtgttaggttacgaacggaggtccccttacccgttaccgtttccccggtacgttaacttaggaaacccgtttaccgggttaggggggacccccgaaaccgggggtaacccccgtttcggggtacccgttaacccccggttaccctttacccccggtacctaacccggtccccgttaaccccctaaccccgggaaacggggacccccctaaacggtttccccgggttttacccccttacccccccggttagggtacccccgtcccccggttaacggccccgtttaaccggaaccggggtacgacccgtaaccccgtttccggaacggtaaccggacctacccggaaggccccgggtacccgttacgggggaccgttcgtacccgggttacgggtaacccggtaaaccggtaacccgtttaacccgttaccccgttaaacgtaccggttacgtaccgtaccgttacgggacggtaccggggttcgacgggacgtaaccgggaccgtacgaacgtaagcgtacgatcaganacagcacggataccganacgtacgacgtacgtacgactgactaggactacgacanacgacgtacgacg

SEQ ID NO: 36098 - DNA, 663 bp, Homo sapiens
  misc_feature: GYAE6OF02HXTGP.4.78.H01.1.454.CMB.1.raw
  modified_base (487)..(487): a, c, t, g, unknown or other
  misc_feature (487)..(487): n is a, c, g, or t
  modified_base (599)..(599): a, c, t, g, unknown or other
  misc_feature (599)..(599): n is a, c, g, or t
  modified_base (604)..(604): a, c, t, g, unknown or other
  misc_feature (604)..(604): n is a, c, g, or t
  modified_base (606)..(607): a, c, t, g, unknown or other
  misc_feature (606)..(607): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (652)..(652): a, c, t, g, unknown or other
  misc_feature (652)..(652): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
tcagagcactgtagcacgaccggtgctcgatttagtgtgagtagtttgggtttgggggggactgggtcaggcagtccccatcgagaggccttgagtggctgggacggacttatttccggtccaagttggtattttttgattatgccgcatctctgagaggtacgaataagcataccaacccagaaccacaaaccaacgaaacctagttttcgctgactagttagaagttcgtataccgaacccccagaacgacgacggtctacgttacttatttacgtgtgacgagacgtcctacttccttacgacgtatacgtaactacggtcgggaccgaacgggtaaccctcggtacctaccggtactaccctacgtaaccgccttaccgaaccggaacgggaccctacgttaccggttacccttaccccgttggacccgtcccgtgaccgttacgtaacggacgccgtacccgttacgaacgtagacccgaanaccgggtaccgccgtaggtcttacgccgtagtaaccgaacgtacgtaaccttcctactacgtcgtactacgcgtacggcggtacgaggacgaacgtcgactacgagtacganacgancnnacacgacgtacacgacananacagtcgacgagacagtacacgtanacacgananac

SEQ ID NO: 36099 - DNA, 148 bp, Homo sapiens
  misc_feature: GYAE6OF01C7NPC.19.21.B10.1.454.CMB.1.raw
  modified_base (147)..(148): a, c, t, g, unknown or other
  misc_feature (147)..(148): n is a, c, g, or t
tcagtactctcgtgcacgaccggtgctcgatttagtgtcgtcgcaagggaccaaggtggagatcaaacgaactgtggctgcaccatctgtcttcatcttcccgccatctgacacgagagtactgagcgggctggcaaggcgcatagnn

SEQ ID NO: 36100 - DNA, 149 bp, Homo sapiens
  misc_feature: GYAE6OF01BKGWU.19.21.B10.1.454.CMB.1.raw
  modified_base (147)..(149): a, c, t, g, unknown or other
  misc_feature (147)..(149): n is a, c, g, or t
tcagtactctcgtgcacgaccggtgctcgatttagtgtcgtcgcaagggaccaaggtggagatcaaacgaactgtggctgcaccatctgtcttcatcttcccgccatctgacacgagagtactgagcgggctggcaaggcgcatagnnn

SEQ ID NO: 36101 - DNA, 148 bp, Homo sapiens; identical to SEQ ID NO: 36099
  misc_feature: GYAE6OF01DCGUX.19.21.B10.1.454.CMB.1.raw
  modified_base (147)..(148): a, c, t, g, unknown or other
  misc_feature (147)..(148): n is a, c, g, or t

SEQ ID NO: 36102 - DNA, 145 bp, Homo sapiens
  misc_feature: GYAE6OF01DTNC4.19.21.B10.1.454.CMB.1.raw
  modified_base (145)..(145): a, c, t, g, unknown or other
  misc_feature (145)..(145): n is a, c, g, or t
tcagtactctcgtgcacgaccggtgctcgatttagtgtcgtcgcaagggaccaaggtggagatcaaacgaactgtggctgcaccatctgtcttcatcttcccgccatctgacacgagtactgagcgggctggcaaggcgcatagn

SEQ ID NO: 36103 - DNA, 514 bp, Homo sapiens
  misc_feature: GYAE6OF01C5A8D.19.21.B10.1.454.CMB.1.raw
  modified_base (382)..(382): a, c, t, g, unknown or other
  misc_feature (382)..(382): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
tcagtactctcgtgcacgaccggtgctcgatttagtgtcgtcgcaagagaggagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagccggggccaccgagtcaactgacaagtccagccactaatctttatacagttaccaaacaatagaaaactactagacttggtaccagctagacgacaggacagcctctagctagctcattactaggcatcgtacccgggaatccggggtccctgaccgtatcagtggtcaggcggtcnggacagtattcactctcacatcagcacgtctgcacgctagaagtgtgtagctagtttatattgtacaactatattatatacttcgtgtacggtcgacgaagggacctaaggtgtactananagngtacgtgg

SEQ ID NO: 36104 - DNA, 549 bp, Homo sapiens
  misc_feature: GYAE6OF01B3LIG.19.21.B10.1.454.CMB.1.raw
  modified_base (242)..(242): a, c, t, g, unknown or other
  misc_feature (242)..(242): n is a, c, g, or t
tcagtactctcgtgcacgaccggtgctcgatttagtgtcgtcgcaagtaggtaggagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagcccacaatcttttanacagttccaacaatagaaaactacttacgtcttgttaccgacgacagagaacccaggtacagccctcctaaggctgctcatttactgggcatctacccgggaatccggggtcctgaccgattcagtggcagcgggtctgggacagatttcactctcaccatcagcagcctgcagctgaagatgtgctagtttattgtgtactaactaattattaattattacttcgtaggtaccgttcggtaccgttaacgggaccctaagggtacggaagttacgtacagtacgaaacgttgtaggtcgtgtaccc

SEQ ID NO: 36105 - DNA, 527 bp, Homo sapiens
  misc_feature: GYAE6OF01D0NQH.19.21.B10.1.454.CMB.1.raw
  modified_base (238)..(238): a, c, t, g, unknown or other
  misc_feature (238)..(238): n is a, c, g, or t
  modified_base (412)..(412): a, c, t, g, unknown or other
  misc_feature (412)..(412): n is a, c, g, or t
tcagtactctcgtgcacgaccggtgctcgatttagtgtcgtcgcaatagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatctttanacagttccaacaatagaaaactacttagcttaggtaccagcagagaccaggacagcctcctaggctgctcatttactggcatctacccggaatccggggtccctgaccgattcagtggcaggcgggtctgggacagtatttcactctcaccatcagcagcctgcaggctgaagntgtggctagtttattattgactaactaattattattactacgttcgtggtacgttccggaccgtaagggtaccgtaaggtggattagtcgaagtacgaaactgtcggtcgtgacc

SEQ ID NO: 36106 - DNA, 150 bp, Homo sapiens
  misc_feature: GYAE6OF01C2MS9.19.21.B10.1.454.CMB.1.raw
  modified_base (147)..(150): a, c, t, g, unknown or other
  misc_feature (147)..(150): n is a, c, g, or t
tcagtactctcgtgcacgaccggtgctcgatttagtgtcgtcgcaagggaccaaggtggagatcaaacgaactgtggctgcaccatctgtcttcatcttcccgccatctgacacgagagtactgagcgggctggcaaggcgcatagnnnn

SEQ ID NO: 36107 - DNA, 876 bp, Homo sapiens
  misc_feature: GYAE6OF01EO56M.19.21.B10.1.454.CMB.1.raw
tcagtactctcgtgcacgaccggtgctcgattttagtgtcgtcgcaagtaggtagggaggggggtaggtacaacaggcgaggcaaggggcgagcaagatggtggttgactagaccccaggtccttcagttttcctcgttgttcgctcctggatctctcggtcgcccacgggacatcgtgagtcgacccgacgtctccagtactccctggctgtgtcctcctggacgtagccgggccgacccagtacaacgtacggacaacgtccacgtcccacaacttccgttttagtaaccaacgtttacccaaactaaagtacggaaaaaccttaacttaagtactttaggtaacctagtaccaacgtacggtaacccaagggaccaacgtccctaccgtaaacggcctacccgaaccttcctaattttaccgtcgggtactaacgttaacccgtaaaccccggggaaacgttccccggggggttaccccctacggtaacccggggttacctttaccggaacggtttcggtacccgtaacgggtccggggttacccgtacggggtaaccgtaacggttacgttttacccgtaaccgtttaccgttaccctaaaccccgtaccgtttacccgtaacggggtacccctaaacggtccccttacgggacccggtacgggtacccgtaggtaaaccggtagttacggtgggtaccgttaagttttacgttaagtttacgttacttaaaccgttaattaacgtttaacttaactttacgttacggtacggtaaccgttccgggtaccgtaaacggggtaccgtaagggtcggtaacttaacggtacggaacggtaccgtaaacgttggtacgggtacgttcgtaacccg

SEQ ID NO: 36108 - DNA, 181 bp, Homo sapiens
  misc_feature: GYAE6OF01AS7NC.19.21.B10.1.454.CMB.1.raw
  modified_base (154)..(181): a, c, t, g, unknown or other
  misc_feature (154)..(181): n is a, c, g, or t
tcagtactctcgtgcacgaccggtgctcgatttagtgtcgtcgcaagggaccgaagggtcggaagatccaaacgaactgtggcctgcaccatctgtcttcatcttcccgccatctgacacgagagttactgagcgggctggcaaggcgcatagnnnnnnnnnnnnnnnnnnnnnnnnnnnn

SEQ ID NO: 36109 - DNA, 148 bp, Homo sapiens; identical to SEQ ID NO: 36099
  misc_feature: GYAE6OF01BAEUJ.19.21.B10.1.454.CMB.1.raw
  modified_base (147)..(148): a, c, t, g, unknown or other
  misc_feature (147)..(148): n is a, c, g, or t

SEQ ID NO: 36110 - DNA, 150 bp, Homo sapiens; identical to SEQ ID NO: 36106
  misc_feature: GYAE6OF01B7FTL.19.21.B10.1.454.CMB.1.raw
  modified_base (147)..(150): a, c, t, g, unknown or other
  misc_feature (147)..(150): n is a, c, g, or t

SEQ ID NO: 36111 - DNA, 644 bp, Homo sapiens
  misc_feature: GYAE6OF01EKJEQ.19.21.B10.1.454.CMB.1.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
  modified_base (475)..(475): a, c, t, g, unknown or other
  misc_feature (475)..(475): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccgacggggacatcgtgatcgaccagtctccagcctccctggctgtgtctcgtggggcgaggccgggaccaccatcaacgtgacaagccagccataatcttttaanacattaccaaataatanaaaacctattagcttaggaccagacaganaccaggacagcctacgtaggctgctcgtaatttacgcggactataccgtacccggggaatccccggggtacctacgaccgtattcgaaggttggacctaggcggttcgagggacctagtacttacgacttcaccaacctatcgagtacgaacgtcccgtgaccgtaggtccgaagtaaagtnttacgggtggtaacctagttttaagttaactttacggaacccaaagttaattaattaagtttaacgtacctttcggtacgggtacccggttacggaaccggtaacgggtaaccgaaaggtcggtaactagtaccgaacgtaacgaagttacggcgtaccgtgtaacccg

SEQ ID NO: 36112 - DNA, 773 bp, Homo sapiens
  misc_feature: GYAE6OF01CMRZH.19.21.B10.1.454.CMB.1.raw
  modified_base (148)..(148): a, c, t, g, unknown or other
  misc_feature (148)..(148): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
tcagtactctcgtgcacgaccggtgctcgatttagtgtcgtcgcaagaggagaggggggacggttacaactagggcaggctagggacagcaagatggtggttagcagacccaggtcttcatttctctgttgtctctggatctctggtncccacgggacatcgtgatcgacccagtctcctagacctcccgtggctggttcgtcttcgtgggtcgtagcgggccaccatcaactgcaacgtccaggccaacaattcgtttanactagttaccaanaactagaaaactaccttagctttacggtaccagacagacgaccgacggtacagtccctaccgtacggtctgactctagtttacgtgggactacgttacccgtaacccggggaacgttccccgggggtccctagggaacccgtacgttaccgaacggtggggccaagggtccggggtcgtaggggacctaaggttactttcacgtacttaccgaaccgtaagttccgtaaagacccgtaacgtacccgttgaccgaacgggtcccgttaagggaaacggttacgttacgggttaccggtaccttaaaggttttttacgttttaacgttaggttaaccctaaaaacttaatttaaacgttttaaagtttaacgttaccgttttacgggtacgggttaaccgtttaccgggaacccgtaaaaggggtacccgttaaagggtcggtaaacttaacgtacgaaacggtaccggtaaacgttggtaaccgggtgtccggtaaccg

SEQ ID NO: 36113 - DNA, 159 bp, Homo sapiens
  misc_feature: GYAE6OF01C2Z83.19.21.B10.1.454.CMB.1.raw
  modified_base (145)..(159): a, c, t, g, unknown or other
  misc_feature (145)..(159): n is a, c, g, or t
tcagtactctcgtgcacgaccggtgctcgatttagtgtcgtcgcaagggaccaaggtggagatcaaacgaactgtggctgcaccatctgtcttcatcttcccgcatctgacacgagagtactgagcggctggcaaggcgcatagnnnnnnnnnnnnnnn

SEQ ID NO: 36114 - DNA, 649 bp, Homo sapiens
  misc_feature: GYAE6OF01C9B59.19.21.B10.1.454.CMB.1.raw
  modified_base (154)..(154): a, c, t, g, unknown or other
  misc_feature (154)..(154): n is a, c, g, or t
  modified_base (259)..(259): a, c, t, g, unknown or other
  misc_feature (259)..(259): n is a, c, g, or t
  modified_base (359)..(359): a, c, t, g, unknown or other
  misc_feature (359)..(359): n is a, c, g, or t
  modified_base (501)..(501): a, c, t, g, unknown or other
  misc_feature (501)..(501): n is a, c, g, or t
  modified_base (522)..(522): a, c, t, g, unknown or other
  misc_feature (522)..(522): n is a, c, g, or t
  modified_base (637)..(637): a, c, t, g, unknown or other
  misc_feature (637)..(637): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctcgtggtcgcccgacgggacngtcgtgatcgacccagtctccagacctcccgtggctgtcgtcgtcgtgggcgaggccgggccaccataccgaactgacaacgtccacgaccactaattctttaanacgtacttaccaaataataacgtaaaaccttacttacgtcttaggaaccagacaagacgaccgaggacacgtcctacgtaggctcgacttactattacgnggactacgtaccgacccggagtccgggtcacgaccgtatcgagtcggcaggtcggtcgtaggactagttacttccgactcaccactatcgacgctacgcctgaccgtagtctaaggtaagagttggtagtactttaagtttnttagtacgtaacctaaaattnttaactttagttacttacgttcgggtacggttaccgttaccgggaaaccgaaacgggtaacgtaagggttacgaacttacgtaacggaacgttaaacggtcgtaggttacccggnttaccggaaccc

SEQ ID NO: 36115 - DNA, 808 bp, Homo sapiens
  misc_feature: GYAE6OF01EC472.19.21.B10.1.454.CMB.1.raw
  modified_base (354)..(354): a, c, t, g, unknown or other
  misc_feature (354)..(354): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggattctctggtcgcccgacgggggacatcgtgatcgacccagtcctccagacctccctggctgtgtctcgtgggcgaggccggccaccatcaactgactaacgtccagcccactaattcttttatactacgttaccaaactaataagtaaaacctacttacgtacgttacggtaccagaccaagacgaccgaggacacgcctaccgtagctgctactatttacgnggacctacgtaccggtaacccgggtaccgttcccgggggtaccctacggaccgtactacgtaggtcggaccgacgggtccggggtacgtacggggaacctaaggtaccgttttaccaaccgttcctaccaaccctacgtacgacgtaccgacgtcccggtcgaccgtacgggtacgtaaggtaacgtaggttcggttacgggtaacctttaaggttttaacgttttaacgttaaccgggttaaaaccttaaacgtttaaattttaacgttttaacgttttaaccgtttaacccggtttcggggttaaccgggttaacccgggtttacccggggaacccgggttaaaaccgggggtaaaacccgttaagggggttacgggttaaacttaacggtaaccgtaaaccgggtaaccggttaaacggttggggttaccgggtacgttaccggtaacccg

SEQ ID NO: 36116 - DNA, 901 bp, Homo sapiens
  misc_feature: GYAE6OF01DLRJ2.19.21.B10.1.454.CMB.1.raw
  modified_base (259)..(259): a, c, t, g, unknown or other
  misc_feature (259)..(259): n is a, c, g, or t
tcagtactctcgtgcacgaccggtgctcgatttagtgtcgtcgcaaaggaaggagagggggaggtacaacaggcaggccagggcagctaagatggtgttgcagacccaggtcttcatttctctgttgctctggatcttcgtggtgcccgacggggactattcgtgatcgaccctagtctccagactccgtggctgtgtctcgtgggcgaggccggggccacatacaacgtgaccaagtccagcccactaattcttttanactacgttaccaaactaataggtaaaaccttacgttaacggtcctttacgggtaaccagccgtaaggacgacccaagggacacgtcccgtacggtacgggtctcggtccttacgtacttttacgcgggactaacgtacccggtaacccgggtaacgtccccgggggtacctaggaaccgttattcggtacggttcggaaccgtcggggtccgggttaccggtaggggtaacctaacggttaccttttacccgaaccgtttacccgttaacccgaacccgtaacttacccgaaaccggttacccgtaaccggtaccccgttagggaccccgttaaggggtacccgttaagggtaaacgtaacggtttcgggttaaccgggtaaccgtttttaacggtttttaacgtttaaacggtttaaccggttaaacccggttaaaaccttaaacgtttttaaacttttaacggttttaacgttttaccccgggttttacggggtttaaaccgggtttaaccgggtttaccggggaaaccccggttaaaacgggggtaaaccccggtaaaggggtttacgggttaaacttaaacgtaccggtaaacggtaaaccgttaacggtttagggtacggtacgttcgtaaaccccg

SEQ ID NO: 36117 - DNA, 824 bp, Homo sapiens
  misc_feature: GYAE6OF01BLR9F.19.21.B10.1.454.CMB.1.raw
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctcggcctcccagaggtgtcctgtcacaagtacagctgcagtcagtcgaggtccagggtactggtacgacgtccctcgacacgtccctcgtcgcctcgaccgtgtcgcctacgtccggaccggggacaggacggtcgacgtacggccgtacgtaggttcggttgtcggttacggccgtacggttcgggtaccgaacgggcctaaccgtccccgaaggttccgggaaggtacggttaccggtaagggtacgggtacgggtacggggtaaagggtaaacggtaaccttaaagttttacgtttacgtacgttaaccggtaaacccgttaaaccggtaaacgggtttaacggtaaaaacctttaaaccgttaaaagtttacgtaacgacccctaaccggttatttccgggttaaggttacggtaacggttaacggtaccgtaaaccgtaaggtaaccttaaacgtaaccgtaaaacggtactaaccgaacgtaacgtaaacccgaacggtaacctaaccgtttccctaccggtacgaccgtacgtaccgttaccgtccgttacgtacgggttaccgtaacccgttacccggggaaggttaccccggtagggtttaccttaagtttaacggttaccggtaacgggttaccgggaaacccggtaccccgtaacccgtaaggtaaccg

SEQ ID NO: 36118 - DNA, 697 bp, Homo sapiens
  misc_feature: GYAE6OF01DDVDD.19.21.B10.1.454.CMB.1.raw
  modified_base (665)..(665): a, c, t, g, unknown or other
  misc_feature (665)..(665): n is a, c, g, or t
  modified_base (671)..(671): a, c, t, g, unknown or other
  misc_feature (671)..(671): n is a, c, g, or t
  modified_base (692)..(692): a, c, t, g, unknown or other
  misc_feature (692)..(692): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatcctcgtggtcgcccgacgggactatcgtgatccgaccctagtcctaccacgtaccctcccgtggtctgtcgtctcggtcggggacggacggccgggacctaccactacgaactcggacctaacgtccgacacctaaactaacttttaccttttaactaaccgtaacgttaaccaaaactaaacgttaaacgtaaaaaccttacgttaacgtaccgttaccggtaaccagacgaagacgaacgaacggacaccgtacctacgagctcgtacttactaacgttacgcggtacaaccggtaccggtaaccgggtacggtcccgggtacctacgaaccgtgtacggtagtcggacgtacgggcggtacgtcgggaatacgtagttaccacttcctaaccgaactactacgaccgacgtacctccggacgacggtacgacgtaagaagtgtcgtagtacttaagttattcgtaacataaactagttaattaacttactacgttcgtacggtacgtacggacgaaggtacgtagggtanacgtanacgaacgtacgagtggctacncgtac

SEQ ID NO: 36119 - DNA, 750 bp, Homo sapiens
  misc_feature: GYAE6OF01AVXY3.19.21.B10.1.454.CMB.1.raw
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (328)..(328): a, c, t, g, unknown or other
  misc_feature (328)..(328): n is a, c, g, or t
  modified_base (404)..(404): a, c, t, g, unknown or other
  misc_feature (404)..(404): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcattttctctgttgctctggatctctggtgcccacggggacatcgtgatgacccagtctccagactccctggctgtgtctcgtgggcgaggcgggccaccagtcaactgcaagtccagccanaatcttttanacagttccaacaatgaaaactacttagcttaggtaccagcagagaccaggacacgccctccgtaggcctgacctactatttacgngggacctagtccgtaacccgggaacgttcccgggggtaccctgaccgtagttcgaaggtcggcgtacggccgggtntgggaactagtactttcgaaccttcgtacctaacccattaccacggtaccctaacgcccgttagacccgtacggggtaccttaaggaaacggtacgttacgggttcggtaccgtttaagggttttttaactttaacgtttacggtaacctaaacgttaaaccgtttaagttttaacgtttaacgtttacccgtttacgggttaaccgggtacccggttttacccggggtaacccggttaaaacgggggttaccccgtaaaggggttacggtaacgttaaccggttaccgtaaacgggtaacccggttaacggttagggttaccgggtaccgttacgggtaaccccg

SEQ ID NO: 36120 - DNA, 604 bp, Homo sapiens
  misc_feature: GYAE6OF01CPXBF.19.21.B10.1.454.CMB.1.raw
  modified_base (332)..(332): a, c, t, g, unknown or other
  misc_feature (332)..(332): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgaggccggccacatcaactgacaagtccagccactaattctttatacacgttaccaaacaatagaaaactacttaagcttaggaccagacaagacgaccaggaccacgcctcaggctgctacatttacgnggactacgtaccgtaacccgggagtcccggggtacctggaaccgtattcgaggtggacaggtcgggtactgggactagtactttacgcttctaccgactatcgacgctacgtctacgcgtacggctaggaacgtagttggtcggtaactttaagtttagttacttagaacctaaaacgtattaatttacttactacgttacgtaggtaccgttcggaaccgtaagggtaccgtaaggtagtatacacgagtacgtaatgggtcgcgtagacc

SEQ ID NO: 36121 - DNA, 753 bp, Homo sapiens
  misc_feature: GYAE6OF01DAYOS.19.21.B10.1.454.CMB.1.raw
  modified_base (190)..(190): a, c, t, g, unknown or other
  misc_feature (190)..(190): n is a, c, g, or t
  modified_base (376)..(376): a, c, t, g, unknown or other
  misc_feature (376)..(376): n is a, c, g, or t
  modified_base (428)..(428): a, c, t, g, unknown or other
  misc_feature (428)..(428): n is a, c, g, or t
tcagtactctcgtgcacgaccggtgctcgatttagtgtcgtcgcaaggagaggaggggggaggtacaacaggcaggcaggggcagcaagatcggtgttgcagacccaggtcttcatttctctgttgctctggatctcgtggtgacccgtacgggtacatcgtgactcgacccagtcctcagtactcccgnggcgtgtgtcctcgtggcgaggccggccaccatcaacgtgcaagtcccagacctaataactttctttaagacctacgttaccaaacgtaacgtaacgtaaaaacctccgttacgtccgtttacgtacccagactagacgacctaggaccaccgtacctcgtacggctcgtctactacgtttaccgngggacctacgtacccggtaacccgggtacgtcccggggtcctacggaccgtntacgacggtcgacgtacggtccggtacgtgggactagtacgttcaccttcgtacccacgtactacgacggtaccgtcgtaccgtaggtaccgtaaggcttaagggaaacgcggtttacgggttaacgtaaccttttaggtttttaacttaaccgtttaggtaaaccctaaagtttaaacgttacgtttaaacgttaccgtttacggtttcggtaacgggttacgggttaacccccggaaggttaacgggtaacggtaacggggttgttaaacgtaacctacggaaacggttaccgtaaacggttggtaccgtaccgtcgtacccg

SEQ ID NO: 36122 - DNA, 676 bp, Homo sapiens
  misc_feature: GYAE6OF01DGSNN.19.21.B10.1.454.CMB.1.raw
  modified_base (237)..(237): a, c, t, g, unknown or other
  misc_feature (237)..(237): n is a, c, g, or t
  modified_base (467)..(467): a, c, t, g, unknown or other
  misc_feature (467)..(467): n is a, c, g, or t
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
tcagtactctcgtgcacgaccggtgctcgatttagtgtcgtcgcaagagaggagggggagagtctgctgaattctggctgaccagggcagtcaccagagctccagacaatgtctgtctccttctcttcttcctgcccgtgctcggcctcccacgaaggtgtcctgtcacaagtacagctgcagcagtcgacggtccaggacgtggtacgaaccgccctcgaccaacgtccccgttcnccgccttccaccgtggtcgcctagtcccggtaccggggaacacggtacggtccgacgttacggaccgtacgtaggttcggttgtccggtttggccgtacgggttcggggtaccgacggtcccaccggtaccccgtaggtacgggaggtacggtcgtacggaggtgggacggtagggaacgtatagttacttcgacttacgacaacgtaacggtagaaacttaataattancgactactattcgtagtagacgtacgtacgactagaactacgtacgaacgtacgactactacgtaacgaacctacgttccgttcnccgtacgntaaccgtcgtaccgtcgtcgtcgtaccgacccggtaccggaacggtccggttaaggttcgttaacgttcggttacggtaggaacggtaaccggcccctaacgtaaagtccgtaacg

SEQ ID NO: 36123 - DNA, 545 bp, Homo sapiens
  misc_feature: GYAE6OF01DORCC.19.21.B10.1.454.CMB.1.raw
  modified_base (185)..(185): a, c, t, g, unknown or other
  misc_feature (185)..(185): n is a, c, g, or t
  modified_base (253)..(253): a, c, t, g, unknown or other
  misc_feature (253)..(253): n is a, c, g, or t
  modified_base (345)..(345): a, c, t, g, unknown or other
  misc_feature (345)..(345): n is a, c, g, or t
  modified_base (395)..(395): a, c, t, g, unknown or other
  misc_feature (395)..(395): n is a, c, g, or t
  modified_base (420)..(420): a, c, t, g, unknown or other
  misc_feature (420)..(420): n is a, c, g, or t
  modified_base (517)..(517): a, c, t, g, unknown or other
  misc_feature (517)..(517): n is a, c, g, or t
  modified_base (523)..(523): a, c, t, g, unknown or other
  misc_feature (523)..(523): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacggggacagtcgtgatcgacccagtctccagcctcccgnggctgtgtctcgtgggcgaggccgggccaaccatacaactgacaagtccagccaataattcttttaanactacgttaccaaataatacgaaaacttcgtaagtcttacggaaccagacagaagaccgaggacagccctcgtaggctgactcgatttacgnggcacgtcgacccggagtccgggcctagactatcgagtgacaggtcgtancggatagtcttcgactctaccactntacagcacgctgacgagtcgtggatacgtgtaggtacttagttatcgttagactaatatattatatacgtgagtccgtgaacgaaggctagcggtanacgtanacgtacgaatggcgtctagacc

SEQ ID NO: 36124 - DNA, 787 bp, Homo sapiens
  misc_feature: GYAE6OF01EGM55.19.21.B10.1.454.CMB.1.raw
  modified_base (244)..(244): a, c, t, g, unknown or other
  misc_feature (244)..(244): n is a, c, g, or t
  modified_base (347)..(347): a, c, t, g, unknown or other
  misc_feature (347)..(347): n is a, c, g, or t
tcagtactctcgtgcacgaccggtgctcgatttagtgtcgtcgcaagaggagagggggaggtacaacaggcaggcagggcagcaagatggtgttgcagacccaggtcttcatttctctgttgctctggatctctggtgcccacgggacatcgtgatcgaccagtctcacgactccctggctgtcgtctcgtggcgtagcggccacagtccaacgtcgacaagtccagtccacgaattcttttanacgagttaccaactaacgttagtaaaacttacgttacgtacttacggtaaccagtacacggacgacctaggacacgcctacgtaggctagctcgtatttacgngggtcacgtacgtaccgggaactccggggtacctggtacctagttccgaggtaggacgtacggtccgggtacgtacgggactaaggtactttacgaccttaccgtaaccgaccgtacgtacgtaaacgggtcctaaccggtccgtagtaccggtacggtaccgttaaggtaaacgtaaccggttggttaacggttccggttaaagtttttaacgtttaacggttaaccgttaacgttaaaaccggtttaaattttaccgttttaaacgtttaacggtttaacccgtttaccgggttaacgggtttaacccgggttaccgggtaaacccgggtaaacggggttaaccccgtaaaaggggtttcccgggtaaaggtaaaccggttacggtaaaccgttaaaccggttaaacgtcgggtttacggttccgttacgggtaaccc

SEQ ID NO: 36125 - DNA, 791 bp, Homo sapiens
  misc_feature: GYAE6OF01DB8LV.19.21.B10.1.454.CMB.1.raw
  modified_base (225)..(225): a, c, t, g, unknown or other
  misc_feature (225)..(225): n is a, c, g, or t
tcagtactctcgtgcacgaccggtgctcgatttagtgtcgtcgcaagagaggaggggggaggtacaacaggcaggcgaggggcagcaagatggtgtgcagacccaggtcttctatttctcttgttgctctggactctcgttggttccgtggacgggacagtcgtgatcgaccctagtacccagtactcactggctgttgtctcggtgggacgacgaccgaccaanaactacaactgacacggtccaagaccaagtaacttactttccacctaacctaactaaaacgtaaacctaaaacgtttcctaacgtaccgtaacggtaacccaacgagacgaaccgaggacctagtcccttaacgtaaggttcacgttactagtttacgtcggttctacgtaccggcgtaccgtaacggtttccgggacctacggtaacccgttggtcccgggacgtaccgggtcggtacgacggggaaccttaaggttaccctttcgtaaccttccgtaccaacccgtagtacccgaacgcgtaaccggtccgttaaggccgtaaacgggtaacctaagggttaacggtagtttacgggtacggttaccgttttaaattttaccgttaccgtagggtaacctaaacggtttcttttaaactttttccgttttaaccttaccgcccgtttacggttacgggtaccgttaccggaccggtaaacgggtaccggttaagggtactaaaacgtcgttaacggaaccgttaaggtcggtacgtacctacgacctaagttcgtccgttaacg

SEQ ID NO: 36126 - DNA, 904 bp, Homo sapiens
  misc_feature: GYAE6OF01D5V3Z.19.21.B10.1.454.CMB.1.raw
tcagtactctcgtgcacgaccggtgctcgatttagtgtcgtcgcaagaggtaggaggggggaggtaacaacaggcaggcaggggcagcaagatggtgttgcagacccaggtcttcatttctctgttgctctggatctctggtcgcccacggggacatcgtgatcgacccagtctccagactcccgtggcctgtgtctcgtcgggcgagccggccacatcgaacgtgacaacgtccacgaccaactaacttccttttacaccgtacgttaccaaacgtaacgtaacggtaaaaccttacgtttaaggtaccgtttacgggtaaccaggtactaacggaaccgaaccgaacgggaaaccaacggtacccgttaaccgttaacggccttacgtacctttacctaagttttaccgtcgggtacctaacgttaccccggttaaacccgggtaacggtttccccggggttaccccgtacggttaaacccggttcgtttacccggtacggttccggggtaacctccggggttaacccgggggttccggtaacgggggttaaccgttaaacgggtttaccgttttacccggaaccctttacccggttaccctaaccccggttaaaccttaccgaaccggtacccgtaaaccgtcccggttaacgggaccccggtaacgggttcccgtaaaggtaaccgggttagttacgggttacggttaacgttttaacgggtttttaagttaccgtttaaacggtaactttaaaccgttaaattttaacttaacgtttaacgttacgtttacgggtacggttaaccggttcccggaacggttaaaccgggtaccgttaagggtacggtactaaggtaccgaaacggtaacgttacgtaagggtcgtaagtccggtaaccc

SEQ ID NO: 36127 - DNA, 870 bp, Homo sapiens
  misc_feature: GYAE6OF01CLMDV.19.21.B10.1.454.CMB.1.raw
  modified_base (154)..(154): a, c, t, g, unknown or other
  misc_feature (154)..(154): n is a, c, g, or t
tcagtactctcgtgcacgaccggtgctcgatttagtgtcgtcgcaagagaggaggggggagtacaacaggcaggcaggggcagcaagatggtgtgcagacccaggtcttcatttctcttgttgctctggatctcgtggtcgcccgacggggacntcggtgatacgaccctagtcctaccacgtacctcccgtggtctggtcgtccgtcggtcggggccggacggcccgggacccacctactaccaacgtcgaccgaacgtcccgaacgtaccctaacgttaactttaccttttaactacctaacgtttaaccaaactaaagttaaccgtaaaaaccttacgttaacggttaccgtttaccggtaaccgacggaccaacgggaaccgaaccggtaacggaaccgaccggtacccttacccggtaacggtcctcggtaccttaccgttaacgttttaccggaccggacttaccgttaccccggaaccccgggttaccggttccccggggtacctacggtaaccggttatacggcgggtcggtacgagggtccgggtcgtacggacgtagtttactcctacgtcctaccgaactacgtacgcgtacgtaccgtcggtaccgcggttaacggtcggttagggaacgttcgtttgggaccgttttaagtttaagggtttttactttaagttaaccgtaaaccgtttaaaagtttaactttttaacgttacgttttaaccggtttacggttccgggttaacccgggtttacggtaaacccgggtaaccgggtaaacggggtaacgttaaggggttaacgtagtttaaccgacggtaaacccggtgttaaccggttgtacccggtcgtacgtacccg

SEQ ID NO: 36128 - DNA, 692 bp, Homo sapiens
  misc_feature: GYAE6OF01D5Z7L.19.21.B10.1.454.CMB.1.raw
  modified_base (245)..(245): a, c, t, g, unknown or other
  misc_feature (245)..(245): n is a, c, g, or t
  modified_base (336)..(336): a, c, t, g, unknown or other
  misc_feature (336)..(336): n is a, c, g, or t
tcagtactctcgtgcacgaccggtgctcgatttagtgtcgtcgcaagagaggaggggggaggtacaacaggcaggcaggggtagcaagatggtgttgcagacccaggtcttcatttctctgttgctctggatctctggtgcccacggggacatcgtgatgacccagtctccagacctccctggctgtgtctcgtgggcgagcgggccaccatcaactgacaagtccagccaactaattcttttanactagttaccaaacaaatagaaaacttacttagcttaggtaaccagacagacgaccaggacacgtcctcgtaggctgcctactatttacgnggactacgtccgtaaccccggggaacgttcccgggtaccctgaccgtattcgagtcggcgaggtcgggtcgtagggactaggtactttcaccttctaccacctactacacgacgaccgtccgtacgacgtacgggtctaaggaacgtagttcggttagggtaactttaaggttttattaacgtttacgtaaacctaaacgttaaagtttaatttaacgtttaacgttacggtttacggttaacgggtacccggtttaccgggaaacccggtaaaacggggtaaccgtaaaggggttcggtaatacgtacgtaacggtaaccggtaacttcgggaacgtcgtcgtaaccgtaacccg

SEQ ID NO: 36129 - DNA, 800 bp, Homo sapiens
  misc_feature: GYAE6OF01CW0L1.19.21.B10.1.454.CMB.1.raw
  modified_base (268)..(268): a, c, t, g, unknown or other
  misc_feature (268)..(268): n is a, c, g, or t
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcattttctctgttgctctggatctcgtggtcgcccgacggggacatcgtagactcgacccagtcctccgagtacctcccgtggctgtcgtctcgcgggacgaggccggaccaaccatacaactgacaacgtccacgaccaactaactttactttaanactacgttaaccaaaactaacgtaaacgtaaaacttacttaacgtacgtttacggaaccagaccgaaggaacaacgtacggaacnccgtacctaccgaggcctgacttaactattacggngactaacgtaccgaacccgggtacttcccgggtacctacgacgtacttacgacgggtcgaccggtacgggtcggtacggtacgggtaactaacgtttaccttaccgacctaccctacgtaaacccgtacgttacgaaaccggttccgaaccgttccgttaaccgggaataccgggtaaccgtaagggaaaagttcgttacggggtaaccgtttaagtttaacgtttttaacgtacgttaaaccgtaacctaaaagtttaaacgttttatttaaccgtttaacgtaacgttacgggttaacccggtaccgtttaaccgggaaaaccggtaaacgggtaaccggtaagggttaactaacgttacgaaccggttaaaggtacggtaaaccgttggaaccgttccgtaacggaccc

SEQ ID NO: 36130 - DNA, 707 bp, Homo sapiens
  misc_feature: GYAE6OF01D0F7T.19.21.B10.1.454.CMB.1.raw
  modified_base (257)..(257): a, c, t, g, unknown or other
  misc_feature (257)..(257): n is a, c, g, or t
tcagtactctcgtgcacgaccggtgctcgatttagtgtcgtcgcaagagaggaggggggagtacaacaggcaggcaggggcagcaagatggtgttgcagacccaggtcttcatttctctgttgctctggatctcgtggtcgcccgacggggacatcgtgatcgaccctagtcctccagtacctcccgtggctgtgtctcgtgggcgaggccggaccaccatcaacgtgacaacgtccacgaccaactacttctttanacgtacttaccaaactaagtaacgtaaaacttaccgttagtaccgttacggtaaccagactaaggaacgaccggagtaaccacggtcccttacgtaggctcgcttactacgtttcgaggactacgtaccgtaccgggactcccgggtacctggaccttagtcgagggtcgccgtaggcgggtacgtggactaggtacttccgaccttacgaccacgtactcgacgaccacgtcctagacgacggtactaaggaacgtgtcgggttcgaacggttttattttagttaacggttactaaaccgttaattaacgtttaacgtttattaacgttccgtttcgggtacggtaacccggtttacgggaaccgtaacggggtaaccgttaaggggttactaaagttaccgtacgaaacggtaacccgttaagacgggtttacgtaccgcgtaaaccg

SEQ ID NO: 36131 - DNA, 761 bp, Homo sapiens
  misc_feature: GYAE6OF01CFJMS.19.21.B10.1.454.CMB.1.raw
  modified_base (105)..(105): a, c, t, g, unknown or other
  misc_feature (105)..(105): n is a, c, g, or t
  modified_base (233)..(233): a, c, t, g, unknown or other
  misc_feature (233)..(233): n is a, c, g, or t
tcagtactctcgtgcacgaccggtgctcgatttagtgtcgtcgcaagaggagaggggggaggtacaacgaggcaggcgagggcagcaagatggtgtgcagacccnggtcttcatttctctgtgctctggatctcgtggtcgacccgacgggacagtcgtgaactcggaaccctgtcctccaacggcccttcccgtggccttggtgtacgtcgagggcgacgcggtcccaacgntacaacgtgactagcagccaatacttctttagactacgtaccaacgtaagtacgtaaaacgtacttagacgttacggaaccagaccaagacgacacggtacagcccttacgaagctcactacgtacttacgcggactacgtccgaccggaacgtccgggtactcgaccgtagtcgagtcgacgcggtcggtacacgggtaactacgtacgtttacccaacgttcctaccgaacgttctacggtaacaccgtaacgttcccgtaggtacgaccgggtacgtaaggaaccgtaggtacgggtacgtaacgttttaacgttaaacgtttccggttaaaccgtaaaccgtttaaaaccgttaatttaaacggtttaacgtttaaccgtttaaccggtttaaccgggtacggttaacccgtttacccgggtaaaccggaaaaccgggttaacccggtaaggggttactaaaccggttacgtaaccgtaaagttaccccggtaggttacgttacggtccgtaacggtaaccccg

SEQ ID NO: 36132 - DNA, 812 bp, Homo sapiens
  misc_feature: GYAE6OF01C1XLL.19.21.B10.1.454.CMB.1.raw
  modified_base (258)..(258): a, c, t, g, unknown or other
  misc_feature (258)..(258): n is a, c, g, or t
  modified_base (561)..(561): a, c, t, g, unknown or other
  misc_feature (561)..(561): n is a, c, g, or t
tcagtactctcgtgcacgaccggtgctcgatttagtgtcgtcgcaagagaggaggggggagtacaacaggcaggcaggggcagcaagatggtgttgcagacccaggtcttcatttctctgttgctctggatctcgtggtcgcccgacgggacatcgtgatcgaccagtctcagacctcccgtggctgtgtcgtcgtgggcgacggccggaccaacctatacaacgtgacctaacgtccagccaataacttcttttaanactaacgttaccaaactaacgtaagtaaaacttacgtagtacctttacggaaccagacaacgacgaacgaacggacacgtacccttaccgaggtacctacgtccttaacgttaacgttttaaccgtcgggtacctaaaccggttaccccggtaaacccgggtaaccggtttccccggggacccttaacgggtaacccggtactttacggacgggttaccggcggtaacgggtcggggttactacggggaaaccttagtaaccgttttaccacctccgtaaccacctagtacacgtaccgtacnccgtaggccgaacggtcgtaaggaaacgtggtacggtaacgttcgtttaagttttaatttagtaaccgtaactaaacgtttaaatttaaacgtttaacgtttaactttaccggttacgggttaccgggtaaccggttacccggtaaaccgggaaaaccgggtaacggtttaagggaccgttaaagttaaccgttaacggaaaccggttaaaccggttaaaggtccgggtcggtaaacccggtctaacccgg

SEQ ID NO: 36133 - DNA, 737 bp, Homo sapiens
  misc_feature: GYAE6OF01BLOZX.19.21.B10.1.454.CMB.1.raw
  modified_base (209)..(209): a, c, t, g, unknown or other
  misc_feature (209)..(209): n is a, c, g, or t
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
tcagtactctcgtgcacgaccggtgctcgatttagtgtcgtcgcaagagaggagggggaggtacaacaggcaggcaggggcagcaagatggtgttgcagacccaggtcttcatttctctgttgctctggatctctggtcgcccgacggggacatcgtgatcgacccagtctccagcctccctggctgtgtctcgtggcgagcggccacntcaactgctaagccagccaatattcgtttaacactagttaccaanaatagaaacttactgcttgacagnagacacgagaccngcctcgtagctcgcttcactttacgcggactacgtccggtaaccggtacgtcccggggtacctggacccgtattaccgagggtcggaacccggtggtccggggttacgtaccggggaaattccggttaaacttttccgaaccgttcgttacccaaccgtacgtaccgaacggtcctacggtacccgtggtacccgagggttaccgaagggtaaacgtgggttacgaccggggttaactttaagggttttaactttaacgttacggtacttaaaaccgttaaattttacgtttaacgtttaaccgttacccggtttaacgggttaaccggtaccgggttaaacccggtaacccgggtaaacggtacccggttaaaggggtacggtaactttaccggaaaccggtaacggtaacgttaccggtagtttcccgggactccgggtaaacc

SEQ ID NO: 36134 - DNA, 725 bp, Homo sapiens
  misc_feature: GYAE6OF01CVPQX.19.21.B10.1.454.CMB.1.raw
  modified_base (401)..(401): a, c, t, g, unknown or other
  misc_feature (401)..(401): n is a, c, g, or t
  modified_base (713)..(713): a, c, t, g, unknown or other
  misc_feature (713)..(713): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctcgtggtcgcccgacggggacatcgtgatcgacccagtctaccagtacctcccgtggctgtcgtctcgtgggcgacggccgggaccaccagtacaacgtcgaccaacggtccaacgaccctaacttaactttacttttaactaactacgttaaccaaaacgtaacgttaacgtaaaacttcgttaagtaccgtttacggaaccagacaaggaacgaaccgaggaccaccgtacccttcggtagtcctcgtacttactacgtttacggnggtacctacggtaccggtaaccccgggtacgttccccggggtacctacggtaccgttacttcggacggtacggaccgtacgggtccggggttactacgggacgtagttacctttaccgacttcctaaccgactacgacacggcgtacggtctacggacgaggtcgtaagagtacgtggttacgtactttatttacgtagtctaactaattagttaattacgttacgttacgttacggtacggttaccgacggtaaacggtaacgggcgttaaggcgttaacacgttaaccgaaggttaccgtacgttggacncgttactacccg

SEQ ID NO: 36135 - DNA, 606 bp, Homo sapiens
  misc_feature: GYAE6OF01C8YNT.19.21.B10.1.454.CMB.1.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (403)..(403): a, c, t, g, unknown or other
  misc_feature (403)..(403): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (563)..(563): a, c, t, g, unknown or other
  misc_feature (563)..(563): n is a, c, g, or t
  modified_base (589)..(589): a, c, t, g, unknown or other
  misc_feature (589)..(589): n is a, c, g, or t
  modified_base (594)..(594): a, c, t, g, unknown or other
  misc_feature (594)..(594): n is a, c, g, or t
tcagtactctcgtgcacgaccggtgctcgatttagtgtcgtcgcaagagaggaggggggagtacaacaggcaggcaggggcagcaagatggtgttgcagacccaggtcttcatttctctgttgctctggatctcgtggtcgcccgacggggacatcggtgatcgacccagtcctccagcctccctggctggtgtcctcgtgggacgcggccgggcctacgntacgaactgactaagccagccactaattcttanactataccaanaatagaaacttctagtcttaggaccagcaagtagaccagacagccctcgagcctgactactaacttcgcggactacgtaccgaccgggagttcccgggtacccagaaccgtgtacgacggtgaccgaggtccgggtangggaacctaagttcttaccactcacactacncgcacgtnacctggngacnggtaacggattcggaggtacttagtttacgtattaccgaataaattattaagttactttaacgtacggtttcggacggttaaggtcccgtaaacgaaggccgttaagggntacttacggaccgaaagtaccgtaangggtnccgttggaaccc

SEQ ID NO: 36136 - DNA, 582 bp, Homo sapiens
  misc_feature: GYAE6OF01EHMLX.19.21.B10.1.454.CMB.1.raw
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
  modified_base (577)..(577): a, c, t, g, unknown or other
  misc_feature (577)..(577): n is a, c, g, or t
tcagtactctcgtgcacgaccggtgctcgattttagtgtcgtcgcaagtaggtagggagggggaggagtctgcctgaattcgtggctgaccagggcagtcacaggcgctccagacaactggtctcgtctccttctcttctcccgacgtcccccatagacatgcctacctcgtctctggtgtctatattcggggccagggtacccatgtcacgtctcctcggctcacagggccatcgtccttcccgtggccgcctgctaccgaggtacgtcaaccgtcgagtacgcacgagccggcctagggcctggccgtagggtaccaaccgggtaccttaccttcccgaacgtaggtacggttaccgtggtacgggtacggggtacgacggggtccgaaacggggcgtacgtaaagttacgggancggacgtgngagnanacatcacncgcacactcgcgcgcncgacgacgacgtagtactctactactctatctatacactactactactacgacgtcgtacgtacgacgacgacgngngtacanacgtacgtagacgtcgacgtacgacgtactactatctntcgtc

SEQ ID NO: 36137 - DNA, 582 bp, Homo sapiens
  misc_feature: GYAE6OF01DZ8QJ.19.21.B10.1.454.CMB.1.raw
  modified_base (153)..(153): a, c, t, g, unknown or other
  misc_feature (153)..(153): n is a, c, g, or t
  modified_base (383)..(383): a, c, t, g, unknown or other
  misc_feature (383)..(383): n is a, c, g, or t
  modified_base (434)..(434): a, c, t, g, unknown or other
  misc_feature (434)..(434): n is a, c, g, or t
  modified_base (476)..(476): a, c, t, g, unknown or other
  misc_feature (476)..(476): n is a, c, g, or t
tcagtactctcgtgcacgaccggtgctcgatttagtgtcgtcgcaagagaggagggggagagtctgctgaattctggctgaccagggcagtcaccagagctccagacaatgtctgtctccttcctcttcttcctgcccgtgctgggcctccanaggtgtcctgtcacaagtacagctgcagcagtcaggtccaggactggtacgaacgccctgcaacgccccttctccgctcaccttgtcgccatcgtccggggaacagacgtcgctagcacagtgttcgcttggcctagtgggtcaggctacgtcccagtcgagaggtctagagtgcgtaggaagactatattcattcgtaccaacgtacgtaggaaattaacaaagtttanggacacctatcttagtgaagcgtacgactagactaagtacaacggtacaanacgtataccgaacgtaactacgttcctccgtacgcacgtacncgtacctcggtcgtacgtaccgtacccggagggtaccgtacgggttacgtaaattacgtttacgacgggtacggaaacggaccgtacccctaaggttcgtaacccg

SEQ ID NO: 36138 - DNA, 783 bp, Homo sapiens
  misc_feature: GYAE6OF01EBJYL.19.21.B10.1.454.CMB.1.raw
tcagtactctcgtgcacgaccggtgctcgatttagtgtcgtcgcaaggagagaggggtcaggctggaactgaggagcaggcgagggcagcaagatggtgttgcaggacccaggtcttcatttctctgttgctcgtggatctctggtcgcccacggggacatcgtgatcgaccctagtcctccagactcccgtggctgtgtctcgtgggcgagccggccaccgatccgaacgtcgaccaacgtccagaccctaactaattcgttttaataccgtaacgtttacccaaactaagtacgaaaaaccttacgttaacgccgtttacggtaaccccaggtaccaaggaacgaacccgtaagggacctacggaccccttaccgtacgggtccttcgtaccttacgtaaagttttaccggcgggtactacgttacccggtaaccccggggtaacgttccccgggggtacccctaggtaaccccgttagtttaccgaacgggttcgggacccgtacggggtacccgggtttaccgtaggggaacctaacggttaccttttacccgaaccttaccttacccgaaaccctacgtaccgaaacgtcccgaaccgttcccgtaggtacccgtaggttccgaagtaacgtgttggtacgtactttaaggttttattagttacgtaactaattacgtttaagtttaactttacgtaccgtttacgggttacgtaccggttacgggaacgtaaacgggtaacgtaagggtacgtataacgtacgaacgtcgtacgtgg

SEQ ID NO: 36139 - DNA, 569 bp, Homo sapiens
  misc_feature: GYAE6OF01E4LXR.19.21.B10.1.454.CMB.1.raw
  modified_base (242)..(242): a, c, t, g, unknown or other
  misc_feature (242)..(242): n is a, c, g, or t
  modified_base (322)..(322): a, c, t, g, unknown or other
  misc_feature (322)..(322): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
  modified_base (525)..(525): a, c, t, g, unknown or other
  misc_feature (525)..(525): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaactaattcttttanacagttccaacaatagaaaacttcttagcttggtaccagcagagaccaggacagcctcctaggcttgctactattttacngggctactcgtacccggaagtcccggggtacctggacctatcgagtggcaggcggtctgggacngtacttcacgtcncacntcancacgcctgcgagtctagaacgtngtgctaagtttattnttagactaacgtattaactttattactacgtttcgtaggtaccgtttcggaaccgtaaacggggacccttaagggacggnttaagtacaacgggtacgtaaacgtgggtcgtacgtggaacccg

SEQ ID NO: 36140 - DNA, 656 bp, Homo sapiens
  misc_feature: GYAE6OF01EVNV0.19.21.B10.1.454.CMB.1.raw
  modified_base (374)..(374): a, c, t, g, unknown or other
  misc_feature (374)..(374): n is a, c, g, or t
  modified_base (606)..(606): a, c, t, g, unknown or other
  misc_feature (606)..(606): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccatcaactgacaagtccagccactattcttttatacagttaccaacaatagaaaactactagcttaggtaccagacagacaccgaggacacgtcctacgtaggctgctactatttacgcggtacacgttaccgtaacccgggtacgtcccggggtacctacgaccgtnttccgaggtcggcgaggtccgggtcgtcgggaacagttacttacgactccaccaacctagcacgctacgtcctgacgaggtctaagagtgtgtaggtacttaggttttaactagttacgaacctaaattaagtttaacttttaattacgttaaccggtttacggtacggttaacccggttacccgggaaccgttaaaacggggtacccgtaaggggttaacgtcgttaaacnggtaaaaccggtaaccgtaacgggttaggttccggcgttcgtaaaccccg

SEQ ID NO: 36141 - DNA, 711 bp, Homo sapiens
  misc_feature: GYAE6OF01A3XHT.19.21.B10.1.454.CMB.1.raw
  modified_base (371)..(371): a, c, t, g, unknown or other
  misc_feature (371)..(371): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgaggccggccaccatacaacgtgacaacgtccaagccaactaactttcttttaacactaacgttaccaaacgaaataacgtaaaacttacttagtcgttacggtaaccaggacaaggacgaaccgacggacacgccctaccgtacggctcgtactacgtactttaccggnggactacgtaccggtaacccgggtaacgtcccggggtccctacggaccgtacttcgaggtcggcgtacggtcggggtctacggggaactaggttacttaccgacgtcctaccgtacctactacgacgtaccgacgtccgtacgacgacggtacgtaggaagtacgtagtacggttacgttaagtttaacgttacgttacgtaactaaacgttaaacgttaatttaacttaacgttacgttacggttacgtaccggggggggttacctaaccgggtaacggtaacggtagggtacgtacgtaacgtacgtaacgtaacgtacgtaggtcggcgtcgtaccg

SEQ ID NO: 36142 - DNA, 813 bp, Homo sapiens
  misc_feature: GYAE6OF01CIWV4.19.21.B10.1.454.CMB.1.raw
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctcgtggtcgcccgacggggacagtcgtgactcgacccagtcctaccgacgcctcccgtggccttggttcgtcctcgggtcggggccggacggccgggacccaacctactaccgtaacgtcgaacgtaacgtcccacgacctaaacttaatttctttaactaccgtaacgttaacctaaacgtaactaaacgtaaaacttacgttaacgtacgttacggtaaccagacgtaacggaccgaccgaagactaccgaccctaccgacggtctacgtccgttactaacgttcggtcggtacctacggtacccggtaaccgggtaccgtccccgggggtacctacggtaaccgtacgtacgtaggtcggcggacggtccgggtacggtacggacgttaaggttccttacgaccgttacctaccgaaccttacgcggtaacgccgtaaccggtccgaacgtacgtacggtacgtaacggtaagtcggttagtacggttaccgttttaagtttaacgtttaacgtagtaaacccgttaaagttaactttaagtttaacgttaacgttacggtttaccgggtacgggttaaccggtaccgggaaccgttaaacgggtaaccgtaaggggtcttaaacgtaagtaccggaacgtaacgggtaacgttacggtcgtacggtaccgtaaccg

SEQ ID NO: 36143 - DNA, 154 bp, Homo sapiens
  misc_feature: GYAE6OF01B1RXK.19.21.B10.1.454.CMB.1.raw
  modified_base (148)..(154): a, c, t, g, unknown or other
  misc_feature (148)..(154): n is a, c, g, or t
tcagtactctcgtgcacgaccggtgctcgatttagtgtcgtcgcaagggaccaaggtggagatcaaacgaactgtggctgcaccatctgtcttcatcttcccgccatctgacacgagagtactgaggcgggctggcaaggcgcatagnnnnnnn

SEQ ID NO: 36144 - DNA, 837 bp, Homo sapiens
  misc_feature: GYAE6OF01ECGO3.19.21.B10.1.454.CMB.1.raw
tcagtactctcgtgcacgaccggtgctcgatttagtgtcgtcgcaagagaggaggggggaggtacaacaggcaggcgagggcagcaagatggtgttgcagacccaggtcttctatttctcgtgttcgctcgtggacttcgtcgtggtaccgcccggacgggactagtcgtgacgtaccgacccgtagtcctaccgaacgtccctcccgtggtccgttgtcgtccgttacgggcgggaccggacgggcccggacccaacgtacgtaccgtaacgtcgaaccgtaacgtcccaacgtaccctaatttaactttaccttttaacgaccgttaccgtaaaccaacgtaaactaacgtaaaaccttacggttcgtaccgttacgggaacacgacggaacgaaccggaacgaacggtaccgaccgttacccgtacgtaccggcttacgtcctttaacgtacgtttaacgccgggtactacccggtaaccgggtaccgggtaccgttccccgggtactacggtaccaggttacggcggttaccggacgggtcgggtaccggttacgtacggtaaaccgtacgttccgttacccgtacccgttacgtaccctaaccgcgtacccgacgttaccgaccggtcgtacggaacggtacggttagaacgtacggtcgtacgggttaccgtttaattttccggttaagtttaccgtaaacgttaataaacggtttaacttttaagttaccgttttagtaccggttacggtaaccggtacggtaacccggtaaggtaaccggtaggtaagtcgaactacgagtaacgtcgtagtacgtcggactccgtaac

SEQ ID NO: 36145 - DNA, 836 bp, Homo sapiens
  misc_feature: GYAE6OF01DOLTC.19.21.B10.1.454.CMB.1.raw
  modified_base (646)..(646): a, c, t, g, unknown or other
  misc_feature (646)..(646): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcattttctctgttgctctggatctcgtggtcgcccgacggggacatcgtgatcgacccagtctaccagacctcccgtggctgtcgtctcgtggggacgaggacggccaaccactaccaacgtgaccgaacgtccaagccgtaagtacggtttacttttaacaccgacgtacctaaaccaaaactaaaacgttaaacgtaaaacctttaaccgttttaaacgttagggtaactacgaacgaaccgaaaaccggaaaaccgacggaaccgtaaccgtacccgttaaccggtaaaggtccgtaccttacgtttaccgtttaccggagggtacctaccggttacccggtaacccggggtaaccggttccccgggtaccgtacggtaaccgttaacgttccggaaggttcggacggtacgggtcgggtacggtacggactacggttactttcacgttcacgactactacgtcgacggcccgtcgtgaccgtaggacgttaaggacgttggtacggttacggttaattttaccgggttttnttaccggtcgttaaccgtaagttaaccttaaaagtttacttaacttaccaccttacccggtaccccggttacgggtaaccggttacccggggaaaccggggtacgggtaacccggtaaggggtaaaaccgtaaacgtaaaacccggaacgggttacgttcggtaacgggtcccacggttaaactacccgg

SEQ ID NO: 36146 - DNA, 762 bp, Homo sapiens
  misc_feature: GYAE6OF01BJVHD.19.21.B10.1.454.CMB.1.raw
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacggggacatcgtagatcgacccagtctccagactccctggctgtgtctcgtggcgagcggccacatcaactgacaacgtccacgaccataatcttttaanactattaccaaacaatagtaaaaccttacttagtctttaggtaccanacgtaacgacgaccaagggaccacgccgtaccgtaggccttcgcttacacgttttacgaggacctacgttaccgtaacccgggtacgttccccgggggaccttacggaccgtacttcggagtcggacgtacggtcggtacgtacgggtactacgtacttttaccgacgttacctaccaccgttaacgtactaacggccctaacggtccctgggaacctacgggtacttaacgggaacgtacgttgggacggttacgtttaacgttttacgtttaagttaccgttaaacaaacctttaaagtttaagttttaacctttaaggttacccgtttagggttaccgggtttaaccggtttacccggaaaccggttaacggggtaaacccggttaggggttaacggtaacgttaaaccgttaaccgggaaacgttaaccgtaacgggttacggacggtaccgtttcggaaacccg

SEQ ID NO: 36147 - DNA, 794 bp, Homo sapiens
  misc_feature: GYAE6OF01D5V7Y.19.21.B10.1.454.CMB.1.raw
  modified_base (558)..(558): a, c, t, g, unknown or other
  misc_feature (558)..(558): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcattttctctgttgctctggatctctggtgcccgagggacagtcgtgactcgacccagtcctaccgacgtacctcccgtggtcttgtcgtctcgtggggcgaggcccgggccacgtataccacgtcgacaacgtccacgaccaacttattacttttaacgactacgttaaccaaaacaattacgaaaaacttacgttacgtcctttacggaaccagtaccaaggtaacgaaccgaacggaccgtaccgtcccgtaccggtcggacttaccggtcttacgttacgtttacggtcggtacccaacgtttacccggtaacccggggtaacctcccggggttacccaacgtacccgtacgttaccgacgggttacggaccggtcggtaccggggttacgtacggggtactacggtttacctaccgtacccttcctaaccgactaaccgttnaaaccgcgtagtaccgaggtacgtacggtacttaaacgggattacgggttcgggttacgtaacgtttattttaacgttacgttaagtaaacccgtaagttaaaccttttaagtttaacccttaacgttacggttaccgttagggtaaccggttaccgaaacggtaacggtacgttaaacgggatttaacgaccgttaagaacggttacccaggttaggccgtaacgtccttaaccg

SEQ ID NO: 36148 - DNA, 146 bp, Homo sapiens
  misc_feature: GYAE6OF01CBH6I.19.21.B10.1.454.CMB.1.raw
tcagtactctcgtgcacgaccggtgctcgatttagtgtcgtcgcaagggaccaaggtggagatcaaacgaactgtggctgcaccatctgtcttcatcttcccgccatctgacacgagagtactgagcgggctggcaaggcgcatag

SEQ ID NO: 36149 - DNA, 664 bp, Homo sapiens
  misc_feature: GYAE6OF01DPUU4.19.21.B10.1.454.CMB.1.raw
  modified_base (353)..(353): a, c, t, g, unknown or other
  misc_feature (353)..(353): n is a, c, g, or t
  modified_base (504)..(504): a, c, t, g, unknown or other
  misc_feature (504)..(504): n is a, c, g, or t
  modified_base (530)..(530): a, c, t, g, unknown or other
  misc_feature (530)..(530): n is a, c, g, or t
  modified_base (652)..(652): a, c, t, g, unknown or other
  misc_feature (652)..(652): n is a, c, g, or t
tcagtactctcgtgcacgaccggtgctcgatttagtgtcgtcgcaagagaggaggggggaggtacaacaggcaggcaggggcagcaagatggtgttgcagacacaggtcttcatttctctgttgctctggatctcgtggtcgcccgacggggacatcgtgatcgacccagtctccagacctccctgaccgttgtcctcgtggggcgcggccgggccaccgactacgaacgtcgacaacgtccagaccaactacttacttttacactaacgttaccaaacaattaacgtaaaaccttacttacggtacctttacggaccagaccagtacgaccgagacacgtcctacgaggctntacctctactttaacggcggactacgttaccggtacccgggtaacgtccggggttcccaggtaccgtatccggtaggtcggacgacgggtacgggtcgtagggaactcgtactttaccgactctaccacgtatcagccagccgtgacgcgngtagaagtgtaggtgtacttagtttnttattacgtaactaattacttattacttaacgtccgttaggtcgtaccggttacggaccggtaacgggtaacgtaggggtaactacgttaacgtccgaaaggtaaccggtaacgtggtacgngttacgacccgg

SEQ ID NO: 36150 - DNA, 702 bp, Homo sapiens
  misc_feature: GYAE6OF01CQSH3.19.21.B10.1.454.CMB.1.raw
  modified_base (208)..(208): a, c, t, g, unknown or other
  misc_feature (208)..(208): n is a, c, g, or t
  modified_base (252)..(252): a, c, t, g, unknown or other
  misc_feature (252)..(252): n is a, c, g, or t
  modified_base (347)..(347): a, c, t, g, unknown or other
  misc_feature (347)..(347): n is a, c, g, or t
  modified_base (682)..(682): a, c, t, g, unknown or other
  misc_feature (682)..(682): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctcttgttgctctggatctctggtcgcccgacggggacatcgtagactcgaccctagtcctccagcctccgtgctgtgtctcgtgggaccgngccggccacatacactgacacgtccagaccactaattactttanactactccaaacataactaaactctagtcgttacgaaccagcgaacgacgaacctaaggacaccgtcttaccgagctcgtactactacgtttcgnggtacctacgtaccggtaacccggacgttccccgggtaccctaggtaaccgtagtttaccggagggttacggccgtacggggtccggggttccgtacgggtaactacggttaactttcccgacttcccgtaccacgttacgctagcgaacgtccgtagaaccgtagtctaaaggactaggtcgtacgttagttacgtttaacttaatccgtaacttaaacgtaattttaactttacgttttaacgtcggtttacggtacggttaaccggttccgggaaacgtacggggaccttaagggtaacgtaacttaggtaaccctagtaaccgggttacgngggttaccgccgtcgtaccg

SEQ ID NO: 36151 - DNA, 838 bp, Homo sapiens
  misc_feature: GYAE6OF01CCBVA.19.21.B10.1.454.CMB.1.raw
tcagtactctcgtgcacgaccggtgctcgatttagtgtcgtcgcaagagaggagggggtcaggctggaactgaggagcaggcaggggcagcaagatggtgtgcagacccaggtcttcatttctctgttgctctggatctcgtggtcgcccacggggacatcgtgatcgaccagtctcagactccctggctgtgtctcgtggcgacgcggaccaaccagtacaactgcaagtccacgacctaactaattcttttaactacgtaacgttaccaaaactaaagtaagtaaaaaccttagttacgacttacggtaaccaagtcaaaggacgaaccgaaggaccgacgcccttaccgtaaggcgttagaccttaccgtattttaccggagggtaccaacgttacccggtaaccccggggtaaagttcccccgggggtaccctaaggtaaccccgttaatttccgaagggttccggacgtaccggggtaccgggttcgtaacggggtaacaacggtttactttacccgaacctaccggtaccaaaccctaacgtacccggtaaagaccgtaccggtacccttagggacccgtaagggtaacccgttaaggaaacggttacgttacggtaacgggttaccgtttaagttttaagtttacgtacggtaaacttaaaacgttaaagtttaaccgtttaaatttaaaccggtccgttttaaggggtaaccgggtttaccgggttaaaccgggtaccccggggtaaaaacggggttaacccgtaaagggggttacgtaaaccgtttaacgaccgggtaaaaccgttaaccgggtaaacccgggttacgg

SEQ ID NO: 36152 - DNA, 841 bp, Homo sapiens
  misc_feature: GYAE6OF01AOHW2.19.21.B10.1.454.CMB.1.raw
  modified_base (253)..(253): a, c, t, g, unknown or other
  misc_feature (253)..(253): n is a, c, g, or t
  modified_base (388)..(388): a, c, t, g, unknown or other
  misc_feature (388)..(388): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctcgtggtcgcccgacggggacatcgtgatcgacccagtcctccagacctccctggctgtgtctcgtgggcgagcggccacatcaactgacaagtccacgacccaactaacttcttttaanaccgtagttacccaaactaaacgtacgtaaaaaccttaccttaagtctttacgggtaacccaagaccaaggaacgaacccgaaggaccctaggaccccttaccgtaacggcctgaccttactaagttttaaccgnggggacctacgttacccggtaaccccggggtaacgttcccccggggggttacccttacggaaccccggtaatttccccggaaggttcgggacccggtaagggtccggggttaccgtacgggggactaacggttacttttcccgaacttaccgtacctaacccgtaacgttaccgtaacgacccgaaacggtcccgttacggaaccgaacgggtaccttaaggaaaaccggtacgttagggttaccggtaccgtttaagggttttaacttttacgtttaaccggttaaccttaaaacggttaaactttaaagttttaacttttaaccgttaacgttaccgggttaacggttaccggtttaacccgggaccggtaaaacggggtacccgaaagggttaggacgtaaacgttcgaaacggtaccgtaaacgttagggtacggtacgtcgtaacccg

SEQ ID NO: 36153 - DNA, 709 bp, Homo sapiens
  misc_feature: GYAE6OF01BSCLT.19.21.B10.1.454.CMB.1.raw
  modified_base (144)..(144): a, c, t, g, unknown or other
  misc_feature (144)..(144): n is a, c, g, or t
  modified_base (669)..(669): a, c, t, g, unknown or other
  misc_feature (669)..(669): n is a, c, g, or t
tcagtactctcgtgcacgaccggtgctcgatttagtgtcgtcgcaagaggagaggggggaggtacaacaggcaggcaggggcagcaaagatggtgttcgcagacccaggtcttcagtttctctgttgctctggatctctggtcncccgaggggacatcgtgatgacccagtctcagacctccctggctgtcgtctcgtcggggcggacggccgggcccacctactactaactcggacaacggtccacgcccaactaacgttccttttaactaaccgtaacgttacccaaataaagtaactaaaaacctttacttacgtcgtttaccggtaaccagacaacggacgaacccgaggacctacgtccctaccgtaggctcgtctactactttacgacgggtctacggtccgtaaccgggaaccggttccccggggtcctacggaccctgttccgaggtcggcgacggtccgggtgtgggactaagtactttacgacttccaacgacctatcggactaccgaggtccgaagtcgaggtctaagggtatagttcggtagttacttaaggttttctacgtagtaacctacttaatttacggttaattaccgttcgtcgggttaggacccggttacggaaacccgggtaaggtaccgttaagggagtaaccgttanaacggttacgaacggttacggttcgaggtccgtatacccg

SEQ ID NO: 36154 - DNA, 819 bp, Homo sapiens
  misc_feature: GYAE6OF01AHU4E.19.21.B10.1.454.CMB.1.raw
  modified_base (587)..(587): a, c, t, g, unknown or other
  misc_feature (587)..(587): n is a, c, g, or t
tcagtactctcgtgcacgaccggtgctcgatttagtgtcgtcgcaagagaggaggggggaggtacaacaggcaggcgaggggcagcaagatggtgttgcagacccaggtctctatttctctgttgctctggatctcgtggtcgcccgacggggacagtcgtgatcgaccctagtcctccacgacctcccgtggtctggtcgtctcggtgggcgaggccgggtccaccgtataccaacgtcggactaacgtcccgacgaccctaactaacttctttttaacgaccgtaccgttaacccaaaacgtaaacgtaacgtaaaaaccgtttcgttaacggtccgtttacgggaacccaggtacgaacggaacgaaccgaggaccgaccgtcccttaccgtacgggtcctacgtaccttaccgttaagtttaccgggtacgggaccttaacggtaccccgggttaaaccggggacccggtttcccgggggtaccccttaggaaccggttactacggtacggtacgccggaagggtccggggtctacgggaactacggtttaaccttcgaccttacgccgaaactctacggacncgtacggtacccaggtaccggacgtgtaagtaccgtagggtacggttcgtaggtttaaagtttcttaacgggtttacctaacgtaaattttaagttactttaacttacggttacggttcgggtttaacggtcccggttaacgggtaccgtaaacggggttccgtaaaggggcggttacaacggttaaccggacgtaccgttagggttgggtaacctcgggtaaccctcccgg

SEQ ID NO: 36155 - DNA, 815 bp, Homo sapiens
  misc_feature: GYAE6OF01DKDIO.19.21.B10.1.454.CMB.1.raw
  modified_base (282)..(282): a, c, t, g, unknown or other
  misc_feature (282)..(282): n is a, c, g, or t
tcagtactctcgtgcacgaccggtgctcgatttagtgtcgtcgcaagagaggaggggggaggtacaacaggcaggcgaggggcagcaagatggtgtgcagacccaggtcttcatttctctgttgctctggactctcgtggtcgcccgacggggacacgtcgtagagtccgaccctagtcctccgacgcctcccgtggtctcgtcgtcgtcggtacggggcgacggccggaccaactactacaacgtcgactaacgtccacgacctaacttaacttctttaanaccgtaacttaaccaaataaaacgtaactaaaaccgttcgttaacggtaccgtttaaccggaacaacggaaccgaacggaaccgaaccgaacggtaaccaccggtacctacggtacgtctacgtacttaaccgtaagtttacggacggtactaccggttaccggtaacccgggtaaccggttcccggggtaccctaacggtaaccggtacttaccggagggtccggacggcgggtacgggtacgtacggacgttacgttaccgttaccacgttccaaccacgtactaccgtacgactcgtccgtagagaccgtgaagttacgtcgtagggtcttaacgtttagtttacgtttacgaacgttacgttaaaacttacgttttatttaacgttaccgttacggttccgggttaacggttaccggacccgggtaaacggtaaacgggtaaaccggttagggttaacgttaacgaaccggttaaggaaacccggtttacgggtacggttacggtaaccggttcctaacgggtaacccc

SEQ ID NO: 36156 - DNA, 787 bp, Homo sapiens
  misc_feature: GYAE6OF01C5X5A.19.21.B10.1.454.CMB.1.raw
  modified_base (100)..(100): a, c, t, g, unknown or other
  misc_feature (100)..(100): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (408)..(408): a, c, t, g, unknown or other
  misc_feature (408)..(408): n is a, c, g, or t
  modified_base (451)..(451): a, c, t, g, unknown or other
  misc_feature (451)..(451): n is a, c, g, or t
tcagtactctcgtgcacgaccggtgctcgatttagtgtcgtcgcaagagaggagggggtcaggctggaactgaggagcaggcaggggcagcaagatggtnttgcagacccaggttcttcatttctctgttgctctggatcctcgtggtcgacccgacggggacactcgtgataccggaaccctagtcctaccgaacgtaccttcccgtggtcctggttcgttccgtccggtggggcgacggccgggacccacctaataccaacgtcgaccgtaaacgtccacgacctaacttaactttacttttaaacacctaacgttacccaaataaactaaacgtaaaactacgttagcttacggaccnacagaccacgagataccncctcgtagcctagtcctactattaccggnggacctaacgtacccgtaaccgggtacggtacccggtacccgngtaacccgtagtacgttagggcggacgtcggggttccggaggtacgtacgtaactacgtcctaacgtcccactacgaaccgtcacgaccgtacgccgtagaccggaagtccgaaggaaacgttgtaccgtaggtaaccgtttttaaggttaactttacgtaaccggttaacttaaagtttaattaaacttttaagttaccgttacggtttaccggtaaccgggtttaaacgggtttcccgggaaaaaccggttaaacccgggggtaacgggtaaaacggtttacgggtacggtaaaactttacggaaacccgggttaaaccgttgggtaaaaccgg

SEQ ID NO: 36157 - DNA, 743 bp, Homo sapiens
  misc_feature: GYAE6OF01CAKDE.19.21.B10.1.454.CMB.1.raw
  modified_base (183)..(183): a, c, t, g, unknown or other
  misc_feature (183)..(183): n is a, c, g, or t
  modified_base (191)..(191): a, c, t, g, unknown or other
  misc_feature (191)..(191): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgtgctctggatctcgtggtcgcccgagggacatcgtgatcgaccctagtctaccagacctccnggtctgtntctcgtgggcgacggccggaccaccatacaacctgacgaacgtccaagaccctaactaatttctttatactaacgttaccaaacaataacgtaaaaccttacgttagtaccttacgggtaaccagaacgaacgaaccgaacgaaggaaccaccgtccctaccgtagcctacgtcttaacctacgttacgtcggacgttaaccacccgggttaaacccgggaccggttccccggggtaccctacggtaacccgtagtaccgtggtcgacggtaacggtcggtacggtacggactaggtactttaaccgactacctacctaacctagtaccaccggacctaacgtcgaaccgtacggacggtaacgtaggaaagttcggttacggttacggttacttttaagtttacttaacttaacttaacgtaaacttaaagtttatttaattaacctttcgttaacgggtacgttacggttacccggaacggtaaccgggtacgtaagggtagttaacgactaacggaacgtacccgtaagtaccggtgtacgtcgtaacc

SEQ ID NO: 36158 - DNA, 913 bp, Homo sapiens
  misc_feature: GYAE6OF01BBJZC.19.21.B10.1.454.CMB.1.raw
tcagtactctcgtgcacgaccggtgctcgatttagtgtcgtcgcaagtaggtaggaggggggaggttacgaacaggccaggggccaggggcagcaacgatggtgttgccagacccgaggttccctttcattttccttcgtgttggcctcgtcggactcgtctcggtaggccccggacggggtacagttcggtggactagacccaggtcctccgagacgtcccgtggctgtgtctctgggcgagcggccacgagtccaacttcgaccaagtccacgaccaacaactccttttacaacgacgttaccaaacctaattacgtaaaaccttacgttaacgtacctttacggtaaccacggtacgaacggaacggtaacccgaagggaaccgaacggtcccttaccgttaagggtacctttacggccgttcgtaacgtttaaccgtagggtacctacgtaccgtaacccgggtaacgttcccggggggtaccccttacgggaacccgtaatttccgtaacggttacggtaccgttacgggaccgggttccgtacgggggttaaccggaacggtaaaccggttttacccgaacccgtttcccgttacccgaaccccgttacgtttacccgtaacgtacccgtacccggtaccccgttaccggaaccccggtaccgggtacccgttacggtaacccgttacccggttgggtacccgggtaccctttaaggttttaaccgtttacgttaaccggtacctaaaccggttaacctttaaccggtttaacgtttaacgttacccgttacgggtaccgggttaacccggtttcccgggtaaccgtaacgggtaccgtaacgggttaggtaactaacggtaccgtaacgtaccggtaaacgttcggtaacggtccgtggtaacccg

SEQ ID NO: 36159 - DNA, 649 bp, Homo sapiens
  misc_feature: GYAE6OF01DZRII.19.21.B10.1.454.CMB.1.raw
  modified_base (248)..(248): a, c, t, g, unknown or other
  misc_feature (248)..(248): n is a, c, g, or t
  modified_base (349)..(349): a, c, t, g, unknown or other
  misc_feature (349)..(349): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacggggacatcgtgatcgacccagtctccagactccctggctgtgtctcgtggcgagcgggccacatcaactgcaacgtccacgaccaactaattcttttaanactacgttaccaaactaataacgaaaacttacttacgtacgttacggtaacagacaggaacgaccaggaccacgtccctcgtaggctgctactactttcgnggactacgtaccgtacccgggtacgtcccggggtacctcggtaccgtacttcgaggtcgacgtacggtcggtcgtagggacagtacttacactccgtaccacatacacgacgacgtctgacgtacgctaggaacgtgtggtcgtacgtttagtttacttagttaacgtaactaagttaactttaagtttacttaagttacgtttaccggtagggtacccggttaccgggaaccgtaacggggtacctaaggggttacgtactacgtacgacgtaacgtacgtcggtacgtcgtgaacccg

SEQ ID NO: 36160 - DNA, 744 bp, Homo sapiens
  misc_feature: GYAE6OF01C96PD.19.21.B10.1.454.CMB.1.raw
  modified_base (266)..(266): a, c, t, g, unknown or other
  misc_feature (266)..(266): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacggggacatcgtgatcgaccagtcctccagacctcccgtggctgtgtcgtcgtgggcgacggccgggccaaccataccaaactcgacaacgtccacgacccaaactaacttacttttaanaacttaacggttaaccaaaactaaacttaacgtaaaaaccttacgtacgtacgttacggtaaccagacaagacgaacgaacggacacgcccgttaccgtaggtctcgtactactaactttacgcggactacgtaccggtacccgggtaacgtccccggggtacctaggtaaccgtacgttacgacggtcggacggtacggttcgggtaccgtagggtaacctaggtactttaccgaccttccgaccaacctatacgataccgaacgtcctagaccgaagggacgtaaggaaagtcgttagggtacgttacgtttaacgttttaactttacgttaacgtaactaaaacgttaatttaattttaacttaacttacggttaccgggttaggacccggttacggaaccgtaaacggggtaccggtaaggtggtaacttacggaacaacggtaccgttaaaggtcggtacgacgttcgaaccg

SEQ ID NO: 36161 - DNA, 616 bp, Homo sapiens
  misc_feature: GYAE6OF01EV0F8.19.21.B10.1.454.CMB.1.raw
  modified_base (241)..(241): a, c, t, g, unknown or other
  misc_feature (241)..(241): n is a, c, g, or t
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
tcagtactctcgtgcacgaccggtgctcgatttagtgtcgtcgcaagaggagaggggggaggtacaacaggcaggcaggggcagcaagatggtgttgcagacccaggtcttcatttctctgttgctctggatctcgtggtgcccacggggacatcgtgatgacccagtctccagactccctggctgtgtctcgtgggcagcgggccacatcaactgcaagtccagccacaattcttttaanacctagttaccaacaatagaaaactacttaagtcttaggtaccagcagacgaacgaggacacgcctaccgtaggctgctctattacgtgggctagtccgtaccgggaactccggggtccctagaccgtattcgaggtggcgaggcggtcgtaggtacagtactttcactctcacncatcgagccgctcgacgagngtagagtagtgtcggtacttagtttattctagtaccgagtacgttaatttattaactacgttacctaccgtaccccgtttcccggtacggtttaccgggccggtaacgggggtaaccgtacggggtaaacggtaaacgtaacgtaaaacggacgttaggtacggtaccgtcggtaacccg

SEQ ID NO: 36162 - DNA, 685 bp, Homo sapiens
  misc_feature: GYAE6OF01DDAJT.19.21.B10.1.454.CMB.1.raw
  modified_base (677)..(677): a, c, t, g, unknown or other
  misc_feature (677)..(677): n is a, c, g, or t
tcagtactctcgtgcacgaccggtgctcgatttagtgtcgtcgcaagagaggaggggggaggtacaacaggcaggcaggggcagcaagatggtgttgcagacccaggtcttctatttctctgttgctcgtggactctcgtggtcgcccgagggacagtcgtgactcgaaccctagtcctaccacgtcctcccgtggcctgtcgtccgtcgcggggacgacggccggacctacactacgaacgtgaccaacgtccacgacctaatatttcttaacacgtactaaccaaagtaataacgtaaaactcgttagtacgttacggaaccagacaacggaacgtacccgaaggtaaccacgttccctacggtaggtcctacgtccttaacttacggtttaccgcgggaccttacccgtacccgggtaaccggtacggtcccggtaccagacgtatcggagcgacgtgggtacggtcgtacgaagtaccttacttaccgcttacctacaccgtaagtccgaacgtcgtaacggtcctacggaggtacgtacgaagtaacgtcggttacgtacgtagtttacgtttatacgtaacaacgtaacttagttattacgttacgtcgttcggtacgtacgtacgaacgtaagaccgtagtaggactagtaccagaacgtaacgtgcggntcgtaccg

SEQ ID NO: 36163 - DNA, 896 bp, Homo sapiens
  misc_feature: GYAE6OF01EWH1I.19.21.B10.1.454.CMB.1.raw
tcagtactctcgtgcacgaccggtgctcgatttagtgtcgtcgcaagagaggaggggggaggtacaacaggcaggcaggggcagcaagatggtgttgcagacccaggtcttctatttctctgttgctcgtggatctcgtgggtcgcccgacgggactatcgtagacgtcgaccctagttcctacccgacgtaccctcccgtggtccgttgttcgttcctcgggtcggggacggacgggcccgggacccaacctactaccgtaaaccgtcgaaccgtaacgtacccgaacgtaccctaaacttaactttttaccttttaaagtaaccgtaaccgtttaaccaaaactaaacgttaacgtaaaaaccttacgttacgttaccgttacggtaaccagactaacggacgtaaccggacggacctaccggtaccgttaccggtacggtctacgtaccttagttaacgttaccggtcgggtaactacccgttaacccggggtaacccgggtaccgttccccggggtacccgtaagtaccgttggtccgaagggtcggtacggcgggtacggtaccggacggttactagttaccttcaccgttacacccttaacccgtaagcgtaccgaccgtaaccgggtcgtaaccggtcgtacgggtaaccggtaagtaggttacgttcggggttaactttacgttttaagtttaataccgttaacgtaacttaaacttttacgtttagtttaacccttgggttttaacctacggggtaaccggttaccccgggtaaaccgtaacccggggttaaaccgggtaacggttaaagggtcgtaaaaaccgttacgtcgggtaaaaccggtagggtttacggttagtccggggtttaccccagttaaacccccg

SEQ ID NO: 36164 - DNA, 552 bp, Homo sapiens
  misc_feature: GYAE6OF01CTCJV.19.21.B10.1.454.CMB.1.raw
  modified_base (155)..(155): a, c, t, g, unknown or other
  misc_feature (155)..(155): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
  modified_base (347)..(348): a, c, t, g, unknown or other
  misc_feature (347)..(348): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (379)..(380): a, c, t, g, unknown or other
  misc_feature (379)..(380): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (465)..(465): a, c, t, g, unknown or other
  misc_feature (465)..(465): n is a, c, g, or t
  modified_base (545)..(545): a, c, t, g, unknown or other
  misc_feature (545)..(545): n is a, c, g, or t
tcagtactctcgtgcacgaccggtgctcgatttagtgtcgtcgcaagagaggaggggggaggtacaacaggcaggcgaggggcagcaagatggtgttgcagacccaggtcttcatttctcgttgttgctctggatctcgtggtcgcccgaggganctgtacgatcgaccctagtcctaccgacgtcctccgtggtcttggtctacgtcggtggcggaccggcggaccacgagtacgaccgtcaagtaacgcacgactactattacgttagactgaaccaanaattaacgaactagtctactacgacaganaacgacagacgactagtccatcgacgatacattcggnngtaccgtacgaacccgnggttccgnaccggnntacgngcgcgatcgacgtagactnactacgctacacactacacagcngctagcgacagtanacgagtcgtatatatacgtactanactaatatatagtatcgtacgtacgtacgcggaagacggaaacggtagtatacgtacaacgtaagtcgtagacgtacgtntaacgtc

SEQ ID NO: 36165 - DNA, 795 bp, Homo sapiens
  misc_feature: GYAE6OF01E40GI.19.21.B10.1.454.CMB.1.raw
  modified_base (602)..(602): a, c, t, g, unknown or other
  misc_feature (602)..(602): n is a, c, g, or t
tcagtactctcgtgcacgaccggtgctcgatttagtgtcgtcgcaagagaggagggggtcaggctggaactgaggagcaggcgaggggcagcaagatggtgttgcacgacccgaggtcttctatttctctgttgtctcgtggtatctcgtggtcgacccggacggggactagttcggtagtactacgaccctaggttcctaccgaacgtccctcccgtggccttgtcgtcctacggtcgggcgacggcccggaccacctactacgaactcggacctaacgtccaccgtacctaaacttaacttttacctttaacgaaccgttaacttaccaaaactaattaaaccgtaaaacttcgttaacgtccgttacggtaaccacgtacgaacggtaaccgaaccggtacgaacgtccgtacccgtaggtacgtactcgtacgttacttcgttacggcgtactaccggttaacccggtaccggtaacggtccccggggtacctacggttacgtcgtacgtacgggtaccgcgggtacggggtccggtagggtacggtaacgttacggttacttccgtactccgtaaccaacctgtaccggactaccgnggtacctcggacgttacggttacgaaggacggttgtacggtttagtaaacgtttgttttaaattacgttaacaaaccgtaattttattaacgttaaccgttgttaaacgggttcgtaaccgggttaacggtacccgaaacgggttcggtaaacggtgggttaacttaacacgttaacgaacgtacgtagggtc

SEQ ID NO: 36166 - DNA, 703 bp, Homo sapiens
  misc_feature: GYAE6OF01EDRI5.19.21.B10.1.454.CMB.1.raw
  modified_base (60)..(60): a, c, t, g, unknown or other
  misc_feature (60)..(60): n is a, c, g, or t
  modified_base (78)..(78): a, c, t, g, unknown or other
  misc_feature (78)..(78): n is a, c, g, or t
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (382)..(382): a, c, t, g, unknown or other
  misc_feature (382)..(382): n is a, c, g, or t
tcagtactctcgtgcacgaccggtgctcgatttagtgtcgtcgcaagagaggaggggganagtctgctgaattctggntgaccagggcagtcaccagagctccagacaatgtctgtctccttcctcttcttcctgcccgtgctcgggccctcccacaaggtcgtcctgtcactaagtcagctgcagctagcaggtccaggactggtnacgtccctgcacgacccctctccgtcctcctaccgttggcnccccgaagttcccggtaccgggggaacacggtaccggtcgtccgaaggtccgacgttagggttcgttcggcgtttcggcgtacggttcgggtcggacggcctaccggtcccataccggaggtacggtcgtaggnggttggacgtaggggaagactatagtttcagtctacaacgtacgagtaactaactaaattagtccgacaccgtattgttacggttagaacgtacgtaccgacgtaacgaaactaacgtaaccgtaacgtaaccgaacaacgtacgttaaccggaaaccgtaaccgttccgttaccctacccgtcgtaccgacgtacgttacgtccgttaccgtgttaccggacccggtaaccggacgggtaaccggtagggtactttaacgtacgtttacggtaccgggtacgggtaaaacggtccccggaaccctaagtcgtaaacccgg

SEQ ID NO: 36167 - DNA, 737 bp, Homo sapiens
  misc_feature: GYAE6OF01CLPNZ.19.21.B10.1.454.CMB.1.raw
  modified_base (117)..(117): a, c, t, g, unknown or other
  misc_feature (117)..(117): n is a, c, g, or t
  modified_base (249)..(249): a, c, t, g, unknown or other
  misc_feature (249)..(249): n is a, c, g, or t
  modified_base (660)..(660): a, c, t, g, unknown or other
  misc_feature (660)..(660): n is a, c, g, or t
tcagtactctcgtgcacgaccggtgctcgatttagtgtcgtcgcaagagaggaggggggagtacaacaggcaggcaggggcagcaagatggtgttgcagacccaggtcttcatttcntgttgctctggactctcgtggtccgaccggaggactacgtcgtagacgtaccgaccgtagtcctaccgacgtccctccgtggtcgtgttcgtcgtacggtggacgacggccggtaccacgtactacgacgtnacgacgcacactaattactttacttaacactaccgtaacaaagtaagtaaactaacttcgttaaggtccgttaacggactaggacgaacggacaccggtaacgaccgtacgtccgtacgtacggtcctacgtaccttagtaacgttcggagtacctacggtacccggttaccggtcggtacccggttcaacggtactcgcggtacgtggaaccggtggtcggtacggaacggtacttacgtcctacgtacctacgtaccagtcgtacgtacgcccgtacgccgtaagcgtacgagttaacgacgtagttcggactttagtttaacttgttaacgtactaaaactactttagttaactttaccgtgttacggggaacgttacgggtcgaacccgggaagtaaaacccgggtnttaaaccgggttgtaaaactccccgtaaaagggacgtttaaaccggtcggttaccggtacctcggtaactaaacccg

SEQ ID NO: 36168 - DNA, 735 bp, Homo sapiens
  misc_feature: GYAE6OF01AJ5N6.19.21.B10.1.454.CMB.1.raw
  modified_base (158)..(158): a, c, t, g, unknown or other
  misc_feature (158)..(158): n is a, c, g, or t
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacgggacatcgtnatcgaccngtccnccagcctccgtgctgtcgtctcggtgggcgacggccggccacctataccaacgtcgacctacgtaccacgaccaacttatttaccttttaacactaccgttaaccaactaactaacgtaaaaccttacgttacgtacgttacggacctagacgacgacgacacggacgaccgtcctccgtaggctacgacttacgtacgtttacggcggtacctacgtcccggtaaccgggtacccggttcccgggtaccctacgtaccgtcgtacgacggtcggaccggtacgggtccgggtacgtacgggaaccttacgttactttaccgaccgttccaactacctacgtcgacgtctacggccggtacgacggtacgatacggtagtacgttgggtactatttaacgtttctagtaactactaagtttattacgtttacgttacgttaccggttaggtccggttacccggtacggtaacccgggaaacgggtttacgtaacggtttaggaccttaaacggtagtaaacccggttacggtacggttccgggtcgtaaccgtcggttaacccg

SEQ ID NO: 36169 - DNA, 771 bp, Homo sapiens
  misc_feature: GYAE6OF01A96JH.19.21.B10.1.454.CMB.1.raw
  modified_base (153)..(153): a, c, t, g, unknown or other
  misc_feature (153)..(153): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacgggacntcgtgatcgaccctagtcctccacgtacctcccgtggctgtcgtcctcggtgggcgacggccgggccactactacaactcgactactccacgaccactacttactttacactacgtaccaacgtaataacgaaaaccttacgttacgtcgttacggacctagacgagacgaaccgtaacgggaccacgtcccttaccggtacggtcctcgtaccttacgttaactttaccggaggtcctaacccgttacccgggtaacccggggtaaccggttccccggggttaccctacggaaccgttactacggtacggtcgggccggacggggtccgggtaccggtacgggtactacggtttaccttctacctccgtactaccgtcctacggaactaccgacgtacgtacggaccgtacgggtacgttaaggaacgtacggttgggttaacggtacgttttaagtttactttaacgtaaccgtaacttaaagttacttttaactttaacgttagtttacgttaccggggttagttaacccggttaacggaaccggttaaaccgggacgtttaagggtactataaccgtacggtaacgtactaacggttggtcgtacgtcgtaccc

SEQ ID NO: 36170 - DNA, 717 bp, Homo sapiens
  misc_feature: GYAE6OF01BVSS8.19.21.B10.1.454.CMB.1.raw
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (490)..(490): a, c, t, g, unknown or other
  misc_feature (490)..(490): n is a, c, g, or t
  modified_base (531)..(531): a, c, t, g, unknown or other
  misc_feature (531)..(531): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacggggacagtcgtgatcgaccagtcctccagacctcccgtggctgtcgtctcgtgggcgacgccggccacactacaactgaccacgtccganaccatacttactttanactacttaccaaactaataacgtaaaacttcgttaacgtcgtttacggaaccagaccagaacgaccgaacggtaccacgccctacgtacgccttcgacctcttaacgtttcggcgggtacctacggtacccggtaacccgggtacggttccccgggtccgtacgaccgtagttccgaggtcggacgtgggtaccggtcgtacggggaactacgttacctttccgactccactaacncgtacgacgtcctacgcgtacgcgtacgtacgtagtaaggngttacggtacggttacgtttaagtttaagttacttaagtttaaaccaaacgtttaattaatttacgttaacgtttacgttcggttacggttaaccgtaccggtaaaccgggtaacgggtaccgtaagggttacgtaaatccgtaacgaacggttaacgaccggttaggtcggtagtaccggaaccg

SEQ ID NO: 36171 - DNA, 823 bp, Homo sapiens
  misc_feature: GYAE6OF01BGVKV.19.21.B10.1.454.CMB.1.raw
tcagtactctcgtgcacgaccggtgctcgatttagtgtcgtcgcaagagaggagggggaggtacaacaggcaggcaggggcagcaagatggtgttgcagacccaggtcttcatttctctgttgctctggatctctggtcgcccgacgggacatcgtgactgacccagtctccagcctcctggcttgtgtctcgtgggcgacgccgggacccaacgctacaacgtcgacaacggtccacgaccaactattctttatactacgttaccaactaataacgtaaaacttactagtaccgttacggtaacctagaacgtaggaacgtacccgaacggaccgtaacggtaccccttaccgtacgggtaccttacggtccttaacttacgtttaccgtagggtacctacggtacccgtaaccccggggttaacggtccccgggggttaccctaccgggtaaccgtacgttacccggtaagggtccgtacggtaacggggtcccgggttacggtaacggggtaccgttaacgttaacgtttcccgtaaccgttacccgtacccgtaacctaaccgttaccggaacgtaccccggtaccgtaccgtacggacgtacggggtactaggtaaccggtagttacgggtacggtaacgtttagttttaacgttacgttacgtaaccttaaacttaacgtttaactttaagttaacgttacgttaacccggtagggttacccgttacggaaaccgggtaacgggtaacgtaacgggtaggtaacttacggaaccggtaaggtaaccgtaacggttaccgtagggtccgtggtaaccc

SEQ ID NO: 36172 - DNA, 704 bp, Homo sapiens
  misc_feature: GYAE6OF01BJQ2H.19.21.B10.1.454.CMB.1.raw
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (405)..(405): a, c, t, g, unknown or other
  misc_feature (405)..(405): n is a, c, g, or t
  modified_base (482)..(482): a, c, t, g, unknown or other
  misc_feature (482)..(482): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacgggacatcgtgatcgacccagtcctccgagacctcccgtggctgtcgtctcgtgggcgaggccggccacactacacgtcgacaagtaccacgacctaactaatttctttactacacgttaaccaataactaacgtaaaacttactaggtcttacggtaaccagacgtaacgacgaaccgaggaacncgtcctacgtaggcctntactctacttcggcgtactacgtaccggtaccgccggtccggccgtacgtacgtnttcggagtcggacgtacgggtcgtacggtacgaacgttcgtactttaccgacgttacctacctacgacctacgtacncgtaaccggcgtacggaccgagtagtagacgtagtcgtcgttagttactttacgttaacttacgtaaacctaagttaactttaatttaacgtttaacgttcgtttcggtacgttaccggttacggaacccggttaaacgggtaccggttaaagggtacgttacgtaaccgaccgggttaaacgtaaaccggttcgggtaccgttaggaacccgttgaacccg

SEQ ID NO: 36173 - DNA, 676 bp, Homo sapiens
  misc_feature: GYAE6OF01CJ17P.19.21.B10.1.454.CMB.1.raw
tcagtactctcgtgcacgaccggtgctcgatttagtgtcgtcgcaagagaggaggggggaggtacaacaggcaggcaggggcagcaagatggtgttgcagacccaggtcttcatttctctgtgctctggatctcgtggtcgcccgacggggacatcgtgatcgaccagtcctccagacctcccgtggctgtcgtctcgtggggcgacggccgggaccaccataccaacgtgacaacgtccacgaccaactaacttctttaacacgtacgttaaccaaaataataacgtaaaacttatacgtcgttacgaaccagacagacgacgagacacgtcctacgtagctacgtctagtacttacgtcggactacgtaccggtaaccgggtacgtcccgggtaccagtaccgttcgtccggcgcgtacgggccggtcgacggactagttacttccaccgtctacccgaccgtactaccgacgtccacgtcgacgaccggtaggtacctaggtaaacgtggtacggttaccgtagtttaacgttttatacgtaacgtaacttaacgttaaatttactttaacgttacgttacgttcggtaacggtaccgttacggtaaccggtaacggtaacgtacggtagactaacgtgaaacccgttagtaacgtgaggacctaggctaccg

SEQ ID NO: 36174 - DNA, 825 bp, Homo sapiens
  misc_feature: GYAE6OF01C6N5X.19.21.B10.1.454.CMB.1.raw
  modified_base (343)..(343): a, c, t, g, unknown or other
  misc_feature (343)..(343): n is a, c, g, or t
  modified_base (566)..(566): a, c, t, g, unknown or other
  misc_feature (566)..(566): n is a, c, g, or t
tcagtactctcgtgcacgaccggtgctcgatttagtgtcgtcgcaagagaggaggggggaggtacaacaggcaggcaggggcagcaagatggtgtgcagacccaggtcttcatttctcttgttgctctggatctcgtggtcgcccgacggggacatcgtgatcgacccagtctccagacctcccgtggctgtcgtcctcgtcgggcgacggccgggccaccactacaaacgtgacaacgcacgacctaactaacttcttttaacactacgttacaaacaataacgtaaaactacttagcgttacggaccagcaagacgacacggacacgccctacgtagctcncgtactagttacgcgggacctaacgtaccggacccgggtaacggttcccgggttacccgtacgaacccgtattccggaaggtcgcggtaacggtccggggtcggacgggaaccgtaggtttaacttcccggaaccttacccgtaaccaaccgtacgttaacccgaaggacccgtaaaccggtccggttacgacccggaaggtaacccgttaggaaaacggttntaccgggttaggttaaccgtttaaaggtttttaactttaggttaaacggtaaacttaaaacgttaaaagtttaactttaaacttttaaccggtaccgttttaccgggttaaacggtaacccgggggtttacccggaaacccgggtaaaacgggggttaaacccgtaaaggggtttaaggaaccgtttaaacggtacccggtaaaacggttaaccccggtaaacggttagggtaccgggtaaccgttgggtaaacccccc

SEQ ID NO: 36175 - DNA, 761 bp, Homo sapiens
  misc_feature: GYAE6OF01ESGYC.19.21.B10.1.454.CMB.1.raw
  modified_base (746)..(746): a, c, t, g, unknown or other
  misc_feature (746)..(746): n is a, c, g, or t
tcagtactctcgtgcacgaccggtgctcgatttagtgtcgtcgcaagagaggaggggggaggtacaacaggcaggcgaggggcagcaagatggtgttgcagacccaggtcttcatttctcgtgttgctcgtggactctcgtcggtcgcccggacgggactactcgtagactaccgaccctagtcctaccgacgtaccgttcccgtggtcttggttcgtccgtcggtacggggaccgacgggcccggaccctaccgactaccgtaactcgaactaacgtaccacgtacctaacttactttacctttaagaccttacgtaacccaaagtaagtaaccgtaaaacttacgttagtccgttacggaaccagtacgaacgaccgaaccgtagaaccgtaccgtccctacggtacgccgttactaccttacgttacgttacggcgtactacccggtaaccggtaacccgggtaccggttcccggcgtacgaccgtacgttccggaggtacggacgtcgggacggtacgtacggatacgtttactccaccttaccaccgtacacgtcacgtccgacgttcgacgccggtacgaggtaatacgtcggtcgtagtttatttaacgtttagttactaacgttaacgtaaattatttaacttacgtttacgttacgttccgggtaacggtacccgtaacggaaaccggttaagggtcgttaaagactttaggaactacgtaacgtacggtgtaccgnggtaccgtacgaccg

SEQ ID NO: 36176 - DNA, 763 bp, Homo sapiens
  misc_feature: GYAE6OF01EALF7.19.21.B10.1.454.CMB.1.raw
  modified_base (262)..(262): a, c, t, g, unknown or other
  misc_feature (262)..(262): n is a, c, g, or t
  modified_base (402)..(402): a, c, t, g, unknown or other
  misc_feature (402)..(402): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccgacggggacatcgtgatcgacccagtctcagcctccctggctgtgtctcgtgggcgaggcggcctacatcaactgacaagtccagaccactaattcttttaacgacctagttaccaaanaatacgtaaaacttcgtagtcgttaggtaaccagacaagacgaacccgaggtaccacgtcccgtaccgtaggctcgaccttactagtttacgacggtctacgttacccggaaccggtacgtcccggggtcctagaccgtntacgaggtcggacgcgggtcggtacgtcgggaactaagttcttaccgacctctaaccgtaccgactaacgcgacccgtacggcccgtaagccggtacggaccgttaacggaaggttacgttacggtacggttatttaacgttttacgttaaccttaggttaaacctaaaccctttagttttaaatttaccgttttacgttaccgttttcccgggaaacgggtttaccggtttacccgggaaacccggggttaaagggttaaaaccggtagggggttaacggtaaagttaacccggttaacgggtaaaacggggttacccgttaacgggttccgggtttacgggtcccgtttaaaccgcccg

SEQ ID NO: 36177 - DNA, 665 bp, Homo sapiens
  misc_feature: GYAE6OF01AXGJR.19.21.B10.1.454.CMB.1.raw
  modified_base (225)..(225): a, c, t, g, unknown or other
  misc_feature (225)..(225): n is a, c, g, or t
  modified_base (410)..(410): a, c, t, g, unknown or other
  misc_feature (410)..(410): n is a, c, g, or t
tcagtactctcgtgcacgaccggtgctcgatttagtgtcgtcgcaagagaggagggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtgaacgccctcgcagaccctntcgctcacctgtcgccatccgtccggggacaggacgtcgcgtagcgacaggtgttgccgtttggcacgtcgggtacaggtccgaccgttcccagtccggaggtaggtcgtaggagtgggaccgtagggaacggtactagttatttcaagtcgtaccaacgacgtaggaaacttaacaaaatttancggtcaacctattcgttgttgacgtacgtcgacttaagaccgtaataccgtaaacgtacgaaccaacgtaataccggaaacgaaaccgtaacgttccctacccgtcgaccgacgtactaccggtccttaccgtcgttaccggtaccgtaccccgggtaaacggaacccgttaacgggggtacgtttaacttaacggtttacgtttacgggtaacgggaaacccggtacccgggacccccgtaaagttaaacccgg

SEQ ID NO: 36178 - DNA, 660 bp, Homo sapiens
  misc_feature: GYAE6OF01BHBF2.19.21.B10.1.454.CMB.1.raw
  modified_base (168)..(168): a, c, t, g, unknown or other
  misc_feature (168)..(168): n is a, c, g, or t
  modified_base (426)..(426): a, c, t, g, unknown or other
  misc_feature (426)..(426): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggactctctggtgcccgaggggacatcgtagatcgacccngtctcagacctcctgctgtcgtctcgtggacgagccgggaccacactcgaactcgacaacgtccagaccctaataacttcttttacacgtacgttaccaaacaatacaaaaacttacttaagcgtttacggacacgtacagacgtaccaaggacagtcccttaccgtaagctgactctaactttagcggtactacgtaccgtaacccggacgtccgggtacctggaccgtattcgaggtcggcgacggtcggtaccgngggtaccaggtcttaccgactcacctaccgaatccggacacgacgactacgacggtacgtacgtaagagtacgtgtaggtatacgtttagttactacgtacgtaataagttaatttattacgttacgttacgttaaccgggtacgttacggtaaccggtaacgggtaccgaagggttacgtaagttaccgaacgtacgttaaaccgtaaggttgtcccgtaggtacgtaacccg

SEQ ID NO: 36179 - DNA, 768 bp, Homo sapiens
  misc_feature: GYAE6OF01A76IZ.19.21.B10.1.454.CMB.1.raw
  modified_base (126)..(126): a, c, t, g, unknown or other
  misc_feature (126)..(126): n is a, c, g, or t
  modified_base (133)..(133): a, c, t, g, unknown or other
  misc_feature (133)..(133): n is a, c, g, or t
  modified_base (464)..(464): a, c, t, g, unknown or other
  misc_feature (464)..(464): n is a, c, g, or t
tcagtactctcgtgcacgaccggtgctcgatttagtgtcgtcgcaagagaggagggggggaggtacaacaggcaggcaggggcagcaagatggtgttgcagacccaggtcttctatttctctgttnctctggntctcgtggtcgcccgacgggacagtcgtgatcgaccctagtcctcacgtacctcccgtggtctgttcgtctcgtcggggcgacggccgggaccacactaccgtaacgtcgaccaacgtaccacgaccctaataatttacgttttaacactacttaaccaacttaaacgtaactaaaacgttcttacggtactttacggtaaccacgtacgaaacgtaacgaccgaacggacctaccggtacccttacggtacggtctacgtcttaacgtctttaacggcgtactaccggttaccggtaaccgggtacggttcccggaccgtacgtacccgngttacgcgtcggacgacggtcggtacgtcggaagtaccgtctaccgatccgactactcgtacgacgtacgcgtacgtcgcggtacgtacggtagtacgtacgttggtaccggtaacgtttacgttacttaacgtaacgtaacttaaacgttatttaaacgtttacgttaccttacgggttaaccggttaccggttacggtaacccggtaacggtaaaccgggtaaccgggttaagttaacggtagttaaacccggtacgtaaacggttaccgtaacggttcggtacggtaccgtagtaaccccg

SEQ ID NO: 36180 - DNA, 571 bp, Homo sapiens
  misc_feature: GYAE6OF01D1EQS.19.21.B10.1.454.CMB.1.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (537)..(537): a, c, t, g, unknown or other
  misc_feature (537)..(537): n is a, c, g, or t
  modified_base (544)..(544): a, c, t, g, unknown or other
  misc_feature (544)..(544): n is a, c, g, or t
  modified_base (564)..(564): a, c, t, g, unknown or other
  misc_feature (564)..(564): n is a, c, g, or t
tcagtactctcgtgcacgaccggtgctcgatttagtgtcgtcgcaagagaggaggggggagtacaacaggcaggcaggggcagcaagatggtgttgcagacccaggtcttcatttctctgttgctctggatctcgtggtcgcccgacgggacagtcgtgatcgaccctagtcctccgacgaccctcccgtggcttgtgtcgtacggtgggacgacggccgggaccacganaacgacgtcgactaacgcataccatattcgttatacgataccaagaataacgaaatctaactctacgacaganagacgactaggactacgctacgagntcgactgtaattgcgtanacgtacccgtacgacgtccgggactagactagtcgactgcgcgttcggngtacggtanatcgtacactcgtaacgactagtcanacgcacnggacacggtnaagntagttgatagttagttataccggttacaaagtataagttaattcctaagcgtagtccagtcccgaaagaacgttacgattcggaanaccgtanaacggcttacggagttcaanggtaacc

SEQ ID NO: 36181 - DNA, 827 bp, Homo sapiens
  misc_feature: GYAE6OF01CZTM3.19.21.B10.1.454.CMB.1.raw
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (595)..(595): a, c, t, g, unknown or other
  misc_feature (595)..(595): n is a, c, g, or t
tcagtactctcgtgcacgaccggtgctcgatttagtgtcgtcgcaagagaggaggggggaggtacaacaggcaggcaggggcagcaagatggtgtgcagacccaagtcttcatttctctgttgctctggatctctggtcgcccgacggggacatcgtgagtcgacccgagtctccagacctcccgtggctgtcgtcgtcggtggcgaggccggaccaccntacaacngactaacgcacgccaactaattcttttaanaacctacgttaccaaacaataacgtaaaacttacgttaagtcttacggaacagacgacgacgaaccgaacggacacgtccctaccggcgtcgtctcctactaacgtttacgtcgggactaaccgtaccgggtaacccggggtacggttccccggggtccgtaaccggaaccggtacccggggttacccggggacggtacgggtccggggttacgtaacgggtaacgacgttaccgtttaccactccgtacccgacctactaccgacgaccgtacgtaccgtacggacgtaccgggacttaagggaagttaacgggttgggtaccgttaaccgggtttnttttaacggttccgttacggttaacggtaccttaactttttaaacgttttttcctttttaacccgttaacccggtttccccggttacggggttaccggggttaaccgtaacccggggtaaacgggtaaccccgggtaagggggtaacgggttaaacgttaaacccggtcgggtaaaccgggaaacttcgggttaaacgggcggtaaccttaccggccgttaaaccgtcccgg

SEQ ID NO: 36182 - DNA, 847 bp, Homo sapiens
  misc_feature: GYAE6OF01ELQ3A.19.21.B10.1.454.CMB.1.raw
  modified_base (238)..(238): a, c, t, g, unknown or other
  misc_feature (238)..(238): n is a, c, g, or t
  modified_base (349)..(349): a, c, t, g, unknown or other
  misc_feature (349)..(349): n is a, c, g, or t
tcagtactctcgtgcacgaccggtgctcgatttagtgtcgtcgcaagaggagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccacatcaactgcaagtccagccactaattcttttanactagttaccaacaatgaaaacttcttagtccttaggtaccagacaacgaacgaaccctaagggaaccacggtccttaccgtagggacctcgccttactacttttaaccgngggtacctacgttcccggtaacccgggtaacgttcccgggggttacccctacggtaacccggtactttaccggaaggtttcgggacgtaacggtccggggttacgtacggggaactaacggttacttttaccgtacccttccgtacctaacccgtagttaccgaacggtaccgtaaccggtacccgttggacccgtaacgggtaccgttaacggaaacgttacggttcgggtacggttaacccgtttaagggtttttaacttttaaggtttacggttaaacccgttaaaaccgttaaagttttaacgttttaaacgttttaacgttaacccggtttttacgggttaaccgggttaacccggttttaccggggaaacccggttaaaaccgggggaaacccggttaaaggggttacgggtaaacgttaaccggttacccggaaaacgggttaacccggttaaaacgttccgggtttaacgggtccgtaccgggtaacccc

SEQ ID NO: 36183 - DNA, 672 bp, Homo sapiens
  misc_feature: GYAE6OF01B2Z4Z.19.21.B10.1.454.CMB.1.raw
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (622)..(622): a, c, t, g, unknown or other
  misc_feature (622)..(622): n is a, c, g, or t
  modified_base (630)..(630): a, c, t, g, unknown or other
  misc_feature (630)..(630): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctcttgtgctctggactctcgtggtcgacccggacgggacactcgtgactcgaccctagtcctccacgtcctcccgtggtctcgttcgtcctacggtcgggccgaggccggaccacgactacgacgtcgacgtaacgtccacgactaactactttactttacacgtactaccaaacaagtaactaaacttctagtctacgaccagacagaacgacgacgcacgtcctacgngtctcgctatacttcggngacttacgaccggtaccggtacgtcccggtctacgtccgtaactcgacggtcgaacggtcggtcggtacgtacggtatacggtctttaccgaccttcctaccgacttacgactcgccctacgtccgtagccggacgtaacggtatacggtagtcgttaagttacttttacgttaattaccgtagtaaacctaagtttaatacttttacgtaacgttcgtagggtacgtacggtacctaacgggtaaccgtacggtanaacggttnaaccggtcggaactacccggtgtaccgtgccgtcgtaacccg

SEQ ID NO: 36184 - DNA, 675 bp, Homo sapiens
  misc_feature: GYAE6OF01CN3SI.19.21.B10.1.454.CMB.1.raw
  modified_base (354)..(354): a, c, t, g, unknown or other
  misc_feature (354)..(354): n is a, c, g, or t
  modified_base (435)..(435): a, c, t, g, unknown or other
  misc_feature (435)..(435): n is a, c, g, or t
tcagtactctcgtgcacgaccggtgctcgatttagtgtcgtcgcaagagaggaggggggaggtacaacaggcaggcgaggggcagcaagatggtgttgcacgacccaggtcttctatttctctgttgctctggatctcgtggtcgcccgacgggactagtcgtgagtcgaccacgtcctaccaacgcctccgtgtcgttgttgtcgtcggtagggcggacggccgggaccacgtagtacaacgtctacgacgtaccaacacctaacttaattactttagtactacgttaactaataacgtaacgtaaacttacgtacgttacgttacggacctagacgaacgacgacaggtacnccgtcctcgtacgctacgtcttacttacgtgcggtactacgtaccggaccggtacggtcccgacgtcgacgtgttaccggngtgcggacggtcggtacgtacggtactagtcttaccgacttctaccaccgtacaccgtacgcctcggtcgagtaccggtaggtacgacggttaacgtgttacggttcgttacgttttaagtttacgttaacgttagtaaacgtaacttagtttaacgttactacggtttaccgtacgtcgggttacgtacgaggtaacggtagaaggttctaagctaagacgtcgtacgtgactgcctac

SEQ ID NO: 36185 - DNA, 930 bp, Homo sapiens
  misc_feature: GYAE6OF01EB6TG.19.21.B10.1.454.CMB.1.raw
tcagtactctcgtgcacgaccggtgctcgatttagtgtcgtcgcaaagagagagggggggaggtacaacaggcaggcaggggcagcaagatggtgttgcagacccaggtcttctatttctctgttgctctggatctctggtcgcccgagggacagtcgtgatcgaccccagtcctccgacgtacccttcccgtggtcgttcggttcgtccgttccggtcggggacgggtccgggcccgggaccccaaccgtacctaaccgtaacgtacgaccgttaccgaccggtacacccctaacgttaaccttttacgttttaaccaacggttaccttaaaccaaactagtaaacgttaaccttaacgtacgttacggttaccgtaaccgtaccagacggaaccgacggaaccggtcacccgcccgttaccggtacggtacttccgtaccgtacgtttacggttacgtaccggtacgtttaaccccgggttaaccccgggttaccggttacccgggttaccggtaccggtaccggtaccgttacggtacggtaccggtacggtacggggtaccgggtacggtacgggtacgtaacgtaccttacgttcctaccgtacccgtaacctacgtaccgtacgtacccgtacggtaccgtcggtaccggtaccgtaacggtaacggttaggttaacggttacggtcgtttaaggtttaaccgtttaacggtttaacgttaaccgttaacttaacgttaaactttaaacggtttaaccgtttaaccggttaccggttaaccggggtttacccggttaccgggttaacccgggtaaacccgggtaaccgggtaaccgggttaacgggttaaacgttaccgggttaacgtaaacggtaacggttacggttaacgggttaccggtacggttccggtacgtaacccgg

SEQ ID NO: 36186 - DNA, 667 bp, Homo sapiens
  misc_feature: GYAE6OF01EK65B.19.21.B10.1.454.CMB.1.raw
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (553)..(553): a, c, t, g, unknown or other
  misc_feature (553)..(553): n is a, c, g, or t
tcagtactctcgtgcacgaccggtgctcgatttagtgtcgtcgcaagagaggagggggggcagagtctgctgaattctggctgaccagggcagtcaccagagctccagacatgtctgtctccttctcttctcctgcccgtgctcgggcctcccactaggtcgtcctgtcacaagtacagctgcagcagtcaggtccaggctggtgacgccctgcacgccctctcgcnctctgtcnccagtcgcgggacagcgtcgctagcgactagttgttgtcgttggcgtacggttggggtaccacggtcctaccggtccccaggtcggaaggtcggttacgtagggtaggtcgggaggtaagggaacgtactacgttagtttacgacgtttaccgaaccctaacggtaacgggttaggtaaaactaaacgttaaatttacgacgtaccgtaacctagttcgttaggttcgaacgtacgtaccgtagtaacgaactaacgtaccgtaacggtacaaccgaacttaacgaaccgaaacctaaccgtacctttcccggacccngtaaccgtcctacgtaccgttaccttccgtccggaccgtacccgtaccggggacgttaggacggttagttattacgttcggaaggtacggaacccgtccgtaaccgtgtaaccg

SEQ ID NO: 36187 - DNA, 785 bp, Homo sapiens
  misc_feature: GYAE6OF01CEY5O.19.21.B10.1.454.CMB.1.raw
  modified_base (758)..(758): a, c, t, g, unknown or other
  misc_feature (758)..(758): n is a, c, g, or t
  modified_base (768)..(768): a, c, t, g, unknown or other
  misc_feature (768)..(768): n is a, c, g, or t
tcagtactctcgtgcacgaccggtgctcgatttagtgtcgtcgcaagagggagagggggaggtacaacaggcaggcaggggcagcaagatggtcgttgcagaccctaggtcttcatttcctcctgtgctacgtggactcgtcgtggtacgcccgacgggtacctagtcgtgagtacgaccctagtctccgacggtacctcccgtgggtctggttcggttcctcggttgggacggtacggccgggtaccctaaccacgtaaccaaacgttcgacctaaacggtccaaccgtaacctaactttaactttcttttaacacttaacgttaacctaactaaaggtaacgtaaaaccgttacttacgtaccgttaacggtaaccacgttaaccgaaggtaccgtaaccggtaacggactccgtaccctacgtcggtctacgttctcttacgttacgtggactaccgtaccggtaccggtacccggtccgggtacctacgtacgtcgtaccgtacggtcggccgtagggtcggtaggtacgggatacgttcgtttctacttcgtacgtaccatcgtaacgtcgtaacttccgaagtcgtacgtacgagttacgtacggtaggtacgtacgttttaatacgttagttacggttaacctaaagttaccttagttaacttccggttaacgtacggtaccggttacggtaaccgtcggtaaacgggtaccgttaggacgttacaaccgttaggtaaaccctaacggttntaccgggttntcccgtaggtaaccccg

SEQ ID NO: 36188 - DNA, 763 bp, Homo sapiens
  misc_feature: GYAE6OF01AVATC.19.21.B10.1.454.CMB.1.raw
  modified_base (155)..(155): a, c, t, g, unknown or other
  misc_feature (155)..(155): n is a, c, g, or t
  modified_base (523)..(523): a, c, t, g, unknown or other
  misc_feature (523)..(523): n is a, c, g, or t
  modified_base (540)..(540): a, c, t, g, unknown or other
  misc_feature (540)..(540): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggactctcgtggtcgcccgacgggacntcgtgactcgaccctagtcctaccgacgacctcccgtggcttgtcgtcgtcggtcgggacgacggcccggaccaccactaccaactcgacacgtccacgacctacttaatttctttaagacttaccgtaccaaacgtaataacgtaaacttcgttacgtaccgtacggaccagacgaacggtaccaaccgtacgacctaccggtcccttacggacggtcctacgtacccttaagtcgtttaaccgggcgaaccttccgtaccgggaacccgggttaccgtcccggggtacctacgaccgtcgtacggcgtacgggccgtacgggtccgtacggtagtaacgtacttccgttaccacgtacccgtaacncctaaggcgtaccgtancccggttacgcgaacggtacgtagtacggtaaactcggttcgggtacttaacgtttactttcgtaacttacgtaaacgtaactttagtttaacgttacccttaagtaccggttcgggtaaccggtacggttaaaccggaccggttaaacggtacggttaggtacccaaaacgtcggtacgaacgtacccggtttgggagttaccgggttcacccgttaaacgg

SEQ ID NO: 36189 - DNA, 786 bp, Homo sapiens
  misc_feature: GYAE6OF01BYX87.19.21.B10.1.454.CMB.1.raw
  modified_base (256)..(256): a, c, t, g, unknown or other
  misc_feature (256)..(256): n is a, c, g, or t
  modified_base (303)..(303): a, c, t, g, unknown or other
  misc_feature (303)..(303): n is a, c, g, or t
tcagtactctcgtgcacgaccggtgctcgatttagtgtcgtcgcaagagaggagggggaggtacaacaggcagggcgggggcagcaagatggtgtgcagacccaggtcttcatttctctgttgctctggatctcgtggtcgcccgacggggacagtcgtgatcgacccagtctccagacctccgtggctgtgtctcggtgggcgtacggccggacctaacatccaagtgacaacgtcagaccaatacttgtttaanactaagtaccaaagtaataacgaaaactcgttagacttacggaaccngtacgagtaacgaaccgaaggaccaccggtcccttaccgaggtccctagcctagtacgttacgcgggtactaccggtacccggtaaccggggaaccgttcccggggtacctaaggtaaccctagtaccggaggtcggaccgaacgggtttccgggacgtacgggacgtaagtttaacctccgtacgtaccgtaaccctactaacgcccgtaatcccgtagtacccgtagcccgtaaggtaccgtaaaggtaacgtcggttacggacggtttaatttaacggtttttaacttcggtaaacgtaaattaaacctttaaatttaaccgtttaaagttccggttttaaacgtccggggttaacggttaccgggtaaaccgtaaaccgggaaacgggtaacgtaacgggggtaattaaccggttaaacgacggttaaaccggaaacgttagggtaccggtacgtacggtaaccctaacggtaaacccc

SEQ ID NO: 36190 - DNA, 1082 bp, Homo sapiens
  misc_feature: GYAE6OF01EF870.19.21.B10.1.454.CMB.1.raw
tcagtactctcgtgcacgaccggtgctcgatttagtgtcgtcgcaagagaggaggggggaggtacaacaggcaggcaggggcagcaagatggtgttgcagacccaggtcttctatttctctgttgctcgtggatctcgtggtcgcccgacggggactatcgtgacgtcgaccctagtcctaccgacgtaccctcccgtggtcttggtcgtccgtcggtgggcggacggccgggaccactactaccaacgtcgactaacgtccacgaccctaacttaactttacttttaacaaccgtaccgttaaccaaacgtaacttaaacgtaaaaaccttccgttaacgttccggtttaaccggtaaccgtaaggtacgtaaacgggaaccgtaaaaccccggtaacgggtaccgtaaccggtaccccgttaccggttaaccggtccgttacgttaccctttaccgttaacgtttttaccggacggggttaaccccttaaccggttaaccccggggttaaccccggggttaacccgggtttacccccgggggttaccccttaacgggtaaaccccgtttacgtaaccggttacgggtaccgggaccggttaacggggtaccgggttaacccgggtggggtaaaccgtaacgtttacccgtttaccgtacccgttacccgtaacccgtaacccgtacgtacgtacccgaaccgtcccggttcccggacggtacccggtacgggttaccgtaaaggtaacggtttacgggttaccggttaacgggtttaacccgtttttaaagggtttttactttaacccgggttttaaccgtaaaccccggtttaaaaattttaaacggtttttaaaacccgttttacgtttttaacccgggtttaacccgggttttaaccggggttaacccgggttaaccccgggtttaaaccggggaaaccggggttaaaaccggggttaacccgggttaaaagggtttccggaaaaccgttttacccggtaaaccgggaaaacgggggttttaaacccctaggggtttaccccggtttaaggggccccgttaacccggtaaaccccgg

SEQ ID NO: 36191 - DNA, 801 bp, Homo sapiens
  misc_feature: GYAE6OF01EQJYY.19.21.B10.1.454.CMB.1.raw
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccgacggggacagtcgtgatcgacccagtcctccagacctccctggctgtgtctcgtgggcgaggccgggaccaccgatcaactcgactaacgtccacgacccaactaattacttttaactaactacgttaccaaactaaataacgtaaaaaccttacgttacgtcgttacggtaaccagacaaggacgaaccgaggaccacgtccctaccgtaggcctcgactactactttacgcggtactaacgttcccggtaacccggggtaccggttccccggggttaccctacggtaacccgtacgttacgaagggtcggaccgtacgggtccgggttacggtacgggtaactacggttactttacccgactttacccgtaacctacccgtaactccgtaaacgtcccgtacggtcccgtacggacccggtagggacctttaagggaaagttgttaccgggttacggttaacgtttaacgttttacgtaccgttacgttacctaaggttaacctttaagttttttaccttttcccgtacggtttcccggtaccgggttacggttacccggttaccgggtaaaccggtacggggtaaaccgggttagggttaaacaaccgttagaaaccgggtacgtaaccggttgggagttaccgtccggtaacc

SEQ ID NO: 36192 - DNA, 747 bp, Homo sapiens
  misc_feature: GYAE6OF01ESIJ0.19.21.B10.1.454.CMB.1.raw
  modified_base (371)..(371): a, c, t, g, unknown or other
  misc_feature (371)..(371): n is a, c, g, or t
  modified_base (517)..(517): a, c, t, g, unknown or other
  misc_feature (517)..(517): n is a, c, g, or t
  modified_base (573)..(573): a, c, t, g, unknown or other
  misc_feature (573)..(573): n is a, c, g, or t
tcagtactctcgtgcacgaccggtgctcgatttagtgtcgtcgcaagagaggaggggggaggtacaacaggcaggcaggggcagcaagatggtgttgcagaccccaggtcttcatttctctgttgctcgtggatctcgtggtcgcccgacgggacatcgtgatcgacccagtcctaccacgaccgtcccgtggtcctgtcgtcgtcgtgggcgacggccggaccaccactacgtaactcgacgtacgtccaacgcccaataactttcgttttaacaccgtacgtttaaccaactaaacgtaaacgaaaaccttaacttaacgtcgttcgtaccgaagacaacgacgaacgaacggacacgacccttacgtnaacggcctacggtacttactaggtttaccacgggtaccgtaccgtccgttaacccggggtaccttacccggggtaccctagttacccggtaagtttaccgacggtagggccggttcggtacggggtacttaaggtacttacgtacntttaccgacgttacctacgacctaagtacctacgccagccgtaggacgtacggtanacggttaaggtacggtttacggttacggtttacgttaaggtttaaacgttacgtaaacttaagtaaactttacttaagtttaccgtttacgttacggtacggttaacgtaaccggtaccggttacggaacggtacggtaaggtagtacaacgtactacgacgtaagtcgtagcg

SEQ ID NO: 36193 - DNA, 731 bp, Homo sapiens
  misc_feature: GYAE6OF01DB7T7.19.21.B10.1.454.CMB.1.raw
  modified_base (588)..(588): a, c, t, g, unknown or other
  misc_feature (588)..(588): n is a, c, g, or t
  modified_base (713)..(713): a, c, t, g, unknown or other
  misc_feature (713)..(713): n is a, c, g, or t
tcagtactctcgtgcacgaccggtgctcgatttagtgtcgtcgcaagagaggagggggggaggtacaacaggcaggcaggggcagcaagatggtgttgcagacccaggtcttcattttctcttgttgctctggatctcgtggtcgcccgacgggacagtcgtagatcgacccagtcctaccgagtacctccctggtctggtgtcctcggtggggaccgaggccgggaccaaccgatacgaactcgaacgtaacgtccaacgaccaataacttattttaacactaacgttaaccaaaactaaagttaacgaaaaccttacgttagtaccgttaacggtaaccagtacaaacggacgtaacggaaggtaccaacgcccttaacggacgtcctgtacctacgtaacgtttacgcgggaacctacgttaccccgggtaccgggtaacgttccccggggtaacctacggaaacccgttataccgagggttacgaccggtacgggtcgggttagacgggttaaacaacgttacgtttaccaacgtcctaaccaactacgtcaacggcacgtacgtgacgtagtacgtagaacgngttagcgtacttaagttaatgttacaactaaacgttattaactttaagtattacggtagtacggtaccgttacgggaacgtaacgggaacgaagggtcaaagttaccagtaaacgtaacgtaagnggtaacgccgttagaccg

SEQ ID NO: 36194 - DNA, 770 bp, Homo sapiens
  misc_feature: GYAE6OF01EVTMP.19.21.B10.1.454.CMB.1.raw
  modified_base (376)..(376): a, c, t, g, unknown or other
  misc_feature (376)..(376): n is a, c, g, or t
  modified_base (729)..(729): a, c, t, g, unknown or other
  misc_feature (729)..(729): n is a, c, g, or t
  modified_base (764)..(764): a, c, t, g, unknown or other
  misc_feature (764)..(764): n is a, c, g, or t
tcagtactctcgtgcacgaccggtgctcgattttagtgtcgtcgcaaagaggaggaggggggagtacaacaggcaggcaggggcagcaagatggtgttgcagacccaggtcttcatttctctgttgctctggatctcgtggtcgccggacgggactagtcgtgatcgaccctagtcctccgacgtacctccgtggtcttgtcgtcgtacgtgggcgacggccggaccaacgtactacgaacgtcgaacgtacgtaccgacgacctaactactttcttttaacgtaactacgttaccaaataagtaacgtaaaacttccgttagtcgttacgtaacacgacaagacgtaccgaggaccgacgtccgtactaggctcncgtcttaacgttcgacgggtactaccgttccgggaaccggtaccggttaccgggtctacggtaaacgtcggttacgagggtcggtaaccggtacggggtccgggttaacggtacggtaaacggttacgtttacctttacggaccctttacgtaaccctaccgtaaacgtccggaaggtaaccctcgggtacccgtggaacgtacggtccgttaaaggtaactcgggttagttcggttaaacgtttaggttttaactacggtttacgtaaacgtaagtttaattacgttaacttaacggttacgttacggtacggttacggtaacggaccggtaaacggtacgtagggtaactntaccgtacgaacgtaccgttgtccgtacgccgttnaacccg

SEQ ID NO: 36195 - DNA, 705 bp, Homo sapiens
  misc_feature: GYAE6OF01AHJFG.19.21.B10.1.454.CMB.1.raw
  modified_base (686)..(686): a, c, t, g, unknown or other
  misc_feature (686)..(686): n is a, c, g, or t
tcagtactctcgtgcacgaccggtgctcgatttagtgtcgtcgcaagagggagagggggaggtacaacaggcaggcaggggcagcaagactggtgttgcagacccaggtcttcatttctctgttgctctgatctctggtcgaccacggggacagtcgtagatcggacccagtctccagtacctcccgtggctgtcgtcgtacgtgggccgtacggccgggtcctacgacgaccggactagtacctaacgtcacggccagtacttacctttactacgtacgttaccgaactaagtacgaaaacgttccgttaggtcttaacgggtccaacggacgtacacgtaacgacggtacaccgtacctaccgtacgtaccgtcgtaccgtagttaacgttcgtacggtacctaaccgttaccggaaccgggtacgttcccggacgtacggtaaccgtgttaccgtaaggtccggtccgtaaggtacggttccgtacggactaccggtactttccgactccgtaaccacgtacgtcgacgactcgtacgcgtacgtacggtacttaagcgtaagtcggtattccgaaggttttactcgttacgacgttaacgtattaacttagttaaccgttagtacggtacgtacgaccgtaggtaacggacggtagtacgtcgaacgtacgacgtaacgttnacgtacggtctaacggtcc

SEQ ID NO: 36196 - DNA, 848 bp, Homo sapiens
  misc_feature: GYAE6OF01CWBMD.19.21.B10.1.454.CMB.1.raw
  modified_base (838)..(838): a, c, t, g, unknown or other
  misc_feature (838)..(838): n is a, c, g, or t
tcagtactctcgtgcacgaccggtgctcgatttagtgtcgtcgcaagagaggaggggggagtacaacaggcaggcaggggcagcaagatggtgttgcagacccaggtcttcatttctcgtgttgctctggatctctggtcgcccgacggggacagtcgtagagtcgaccctagtcctccgaacgcctcccgtggtcttggtgtccgtcgtcggggacgacggccgggacccaactataccaacgtcggacctaacgtcccaacgaccaactttaactttccgttttaaactaccgtaaacgtttaacccaaaactaaacgtaaacgtaaaaaccttacgtttaaacgtccgtttaacgggaacccaagtacgaaacggaacggaaccggaaacggtaccgtaaccggcccttacggtacgtccgttagtccttacgtaacgttttacggacggggactacggtacccggttaaacccgggacgtttaccccggggtaccgtacgaaccgttaacgttcgacggtccgggtaaccgtcggggtacgggttacccgtaagggggtacctaacggttaaccttttcccaaacgtttcccgttaaccacgttaccgacggttaaccacggtaccggttccgcggtaccggaaccggtgttaaacggaacgtagttgggtacgttagtttaacgttttaacgttattacggtaaactaattaacgttttaattacgttttaatacccgggtttaggttccgggttaaaccgttccggaaacggtaaacgggtaacgtagggttataaggtacctaaggtaacggtacttaagggtggtaacgntacggtaacc

SEQ ID NO: 36197 - DNA, 161 bp, Homo sapiens
  misc_feature: GYAE6OF02GCDA7.19.21.B10.1.454.CMB.1.raw
  modified_base (148)..(161): a, c, t, g, unknown or other
  misc_feature (148)..(161): n is a, c, g, or t
tcagtactctcgtgcacgaccggtgctcgatttagtgtcgtcgcaagggtaccgaaggtggagatcaaacgaactgtggctgcaccatctgtcttcatcttcccgccatctgacacgagagtactgagcggctggcaaggcgcatagnnnnnnnnnnnnnn

SEQ ID NO: 36198 - DNA, 147 bp, Homo sapiens
  misc_feature: GYAE6OF02IYP6Z.19.21.B10.1.454.CMB.1.raw
  modified_base (147)..(147): a, c, t, g, unknown or other
  misc_feature (147)..(147): n is a, c, g, or t
tcagtactctcgtgcacgaccggtgctcgatttagtgtcgtcgcaagggaccaaggtggagatcaaacgaactgtggctgcaccatctgtcttcatcttcccgccatctgacacgagagtactgagcgggctggcaaggcgcatagn

SEQ ID NO: 36199 - DNA, 147 bp, Homo sapiens; identical to SEQ ID NO: 36198
  misc_feature: GYAE6OF02GTVBC.19.21.B10.1.454.CMB.1.raw
  modified_base (147)..(147): a, c, t, g, unknown or other
  misc_feature (147)..(147): n is a, c, g, or t

SEQ ID NO: 36200 - DNA, 160 bp, Homo sapiens
  misc_feature: GYAE6OF02FMICL.19.21.B10.1.454.CMB.1.raw
  modified_base (147)..(160): a, c, t, g, unknown or other
  misc_feature (147)..(160): n is a, c, g, or t
tcagtactctcgtgcacgaccggtgctcgatttagtgtcgtcgcaagggaccaaggtggagatcaaacgaactgtggctgcaccatctgtcttcatcttcccgccatctgacacgagagtactgagcgggctggcaaggcgcatagnnnnnnnnnnnnnn

SEQ ID NO: 36201 - DNA, 151 bp, Homo sapiens
  misc_feature: GYAE6OF02IKXHO.19.21.B10.1.454.CMB.1.raw
  modified_base (147)..(151): a, c, t, g, unknown or other
  misc_feature (147)..(151): n is a, c, g, or t
tcagtactctcgtgcacgaccggtgctcgatttagtgtcgtcgcaagggaccaaggtggagatcaaacgaactgtggctgcaccatctgtcttcatcttcccgccatctgacacgagagtactgagcgggctggcaaggcgcatagnnnnn

SEQ ID NO: 36202 - DNA, 583 bp, Homo sapiens
  misc_feature: GYAE6OF02JHTRU.19.21.B10.1.454.CMB.1.raw
  modified_base (267)..(267): a, c, t, g, unknown or other
  misc_feature (267)..(267): n is a, c, g, or t
tcagtactctcgtgcacgaccggtgctcgatttagtgtcgtcgcaagtaggtaggtaggggggaggtacgaaacaggcagggcccagggggctagcgaagatgggtgttgcaggaccccagggtcttcactttcgtctaggttgcttctggatctctggtgcccgacgggggacagtcgtaggatgacccttagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcacatcagcacgcctgcgaggctagaagtagtggtggactaggtttattagtttcgtactaaactaattatttaattattacgttcgtaggtaccgttcggaccgaacgggtaaccgtaagggtaggtaattacgtacgaagtacggtaaccgttggtacggtctcggacc

SEQ ID NO: 36203 - DNA, 147 bp, Homo sapiens; identical to SEQ ID NO: 36198
  misc_feature: GYAE6OF02G4FPG.19.21.B10.1.454.CMB.1.raw
  modified_base (147)..(147): a, c, t, g, unknown or other
  misc_feature (147)..(147): n is a, c, g, or t

SEQ ID NO: 36204 - DNA, 823 bp, Homo sapiens
  misc_feature: GYAE6OF02IOFZA.19.21.B10.1.454.CMB.1.raw
  modified_base (257)..(257): a, c, t, g, unknown or other
  misc_feature (257)..(257): n is a, c, g, or t
  modified_base (349)..(349): a, c, t, g, unknown or other
  misc_feature (349)..(349): n is a, c, g, or t
tcagtactctcgtgcacgaccggtgctcgatttagtgtcgtcgcaagaggagaaggggggaggtaccaacagggcaggccagggcaggcaagactcggtgttcgcaggacccaggtcttcactttcctctgtttcgctctggatctcgtggtagccgacgggacactcgtgtatcgacccagtctccacgtacgtccctggctgtcgtactctgggcgagcggccacatcactgcaagtccacgccagtatctttanacattaccaactaattgaaactacttaacgacttacggtaccagcaagaccgaacctaggactagtctcgtaagggctgactcgactttacnggggtcatcctacccgggtaatccggggtaccctcgaaccgtagttccgaaggttcggacgaagggtcccgggttaccgtacgggggtaaacccaagggttacctttttaccccgaacgttacccttacccgaacccgtaacttaccgaacggtaccgaacggtaacccgttggaacccgtaacgggttcccgtttaagggaaacggttaacgttcgggttacggtacccgttaaaggtttttacgttaaccggttacggtttaaccgtaaacggttaccgttaaggtttaaacgtttaaaacggtttaaacccggtttacggggttacccttacggttacggaacccggttttttaccggggaacgggttaaaccgggggtaccccgttaaacggggttacggggtaaccgtaccggtttaacccgtaaaccggggtaaaccctttcgggttaccgggttccgttaacccggg

SEQ ID NO: 36205 - DNA, 560 bp, Homo sapiens
  misc_feature: GYAE6OF02HQUWC.19.21.B10.1.454.CMB.1.raw
  modified_base (246)..(246): a, c, t, g, unknown or other
  misc_feature (246)..(246): n is a, c, g, or t
  modified_base (323)..(323): a, c, t, g, unknown or other
  misc_feature (323)..(323): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagcgggccacgatacgaactgacaagtccagccacaattctttanacagttaccaacaatagaaaactcttagcttggtaccagcagagaccaggacagcctctaggctgctctatttacgnggctatccgtaccgggaactcccggggtccctgaccgtattcgaggtcggcgaggtcgggtctaggggactaggtacttttccacgttctacaccatcacgcacgcctgcgaggtctagaagagtggtggctagtttattagttgtacaactaattattattactacttcgtggtacgttacggaccgtaaggacctaaggtgaatagtacgaagtacgtaacgtggtcgtctgacc

SEQ ID NO: 36206 - DNA, 151 bp, Homo sapiens; identical to SEQ ID NO: 36201
  misc_feature: GYAE6OF02GMM1R.19.21.B10.1.454.CMB.1.raw
  modified_base (147)..(151): a, c, t, g, unknown or other
  misc_feature (147)..(151): n is a, c, g, or t

SEQ ID NO: 36207 - DNA, 158 bp, Homo sapiens
  misc_feature: GYAE6OF02FZCTD.19.21.B10.1.454.CMB.1.raw
  modified_base (148)..(158): a, c, t, g, unknown or other
  misc_feature (148)..(158): n is a, c, g, or t
tcagtactctcgtgcacgaccggtgctcgatttagtgtcgtcgcaagggaccgaaggtggagatcaaacgaactgtggctgcaccatctgtcttcatcttcccgccatctgacacgagagtactgagcgggctggcaaggcgcatagnnnnnnnnnnn

SEQ ID NO: 36208 - DNA, 147 bp, Homo sapiens
  misc_feature: GYAE6OF02GBWYA.19.21.B10.1.454.CMB.1.raw
  modified_base (147)..(147): a, c, t, g, unknown or other
  misc_feature (147)..(147): n is a, c, g, or t
tcagtactctcgtgcacgaccggtgctcgatttagtgtcgtcgcaagggaccaaggtggagatcaaacgaactgtggctgcaccatctgtcttcatcttcccgccatctggcacgagagtactgagcgggctggcaaggcgcatagn

SEQ ID NO: 36209 - DNA, 528 bp, Homo sapiens
  misc_feature: GYAE6OF02GSVZ9.19.21.B10.1.454.CMB.1.raw
  modified_base (409)..(409): a, c, t, g, unknown or other
  misc_feature (409)..(409): n is a, c, g, or t
tcagtactctcgtgcacgaccggtgctcgatttagtgtcgtcgcaaggaggagagggggtcaggctggaactgaggagcaggcagggggcagcaaggactggtgttgcagacccgaggtcttcatttctctgttgctctggatctctggtgcccacggggacatcgtgatgacccagtctccagactccctggctgtgtctctgggcgagcgggccaccatcaactgcaagtccagccacaatcttttatacagttccaaacaatgaaaactacttagcttaggtaccagcagagacctaggacagcctcctaggctgctcattactgggcactctacccgggaaatcccggggtacctggacccgattcgagtggcgagccgggtctgggacagatttcactctcacntcagcagcctgctagctgaagatgtgctagtttatagtgtacaactaatattattacgtacttcgtaggtacgttcggacctaagggacctaaggtggatagtacgagtacgtactcgg

SEQ ID NO: 36210 - DNA, 147 bp, Homo sapiens; identical to SEQ ID NO: 36198
  misc_feature: GYAE6OF02HSL96.19.21.B10.1.454.CMB.1.raw
  modified_base (147)..(147): a, c, t, g, unknown or other
  misc_feature (147)..(147): n is a, c, g, or t

SEQ ID NO: 36211 - DNA, 593 bp, Homo sapiens
  misc_feature: GYAE6OF02GDIA3.19.21.B10.1.454.CMB.1.raw
  modified_base (258)..(258): a, c, t, g, unknown or other
  misc_feature (258)..(258): n is a, c, g, or t
  modified_base (472)..(472): a, c, t, g, unknown or other
  misc_feature (472)..(472): n is a, c, g, or t
tcagtactctcgtgcacgaccggtgctcgatttagtgtcgtcgcaagtaggtaggagggggaggtacaaccaggcaggcagggcagcaagatggtgttcgcagacccaggtcttcatttctctgttgctctggatctctgtgtccacggggacatcgtgactgaacccagtcctccacgactccctggctgtgtctctgggcgaggccgggccaaccgagtcgaaactcgcgaacgtccagccaactaattcttttanacagttccaacaatacgaaaactacttagtcttacggtaccagcagtacgaccgtaggacacgcctccgtacggctagctctatttacgtgggactagtcgtaccgggaactcccggggtaccctagaccgtagttcgagtacgacaggcggtcgtaggactagtacttcgactcgtaccaccatcgacgcgacgtcctacgcagctagaacgngtacgtggactaggtttatatgtacaaactattattatactacttcgcgtacgttacgaccgtaaggtacctaaggtgtaacgtattacgacgtaacgtaacgtggtacggtgtcgtaccg

SEQ ID NO: 36212 - DNA, 742 bp, Homo sapiens
  misc_feature: GYAE6OF02H6N35.19.21.B10.1.454.CMB.1.raw
  modified_base (345)..(345): a, c, t, g, unknown or other
  misc_feature (345)..(345): n is a, c, g, or t
  modified_base (379)..(379): a, c, t, g, unknown or other
  misc_feature (379)..(379): n is a, c, g, or t
tcagtactctcgtgcacgaccggtgctcgatttagtgtcgtcgcaaggagagggagggggaggtacaacaggcaggcaggggcagcaagatggtgttgcgagaccccaggtctttcatttctctgttgctctggatctcgtggtggccccaggggacatccgtgatgacccagtcctccagacctccctggctgtgtctcgtgggcgagccggccaccatcaactgacaacgtccagccaactattctttatactagttaccaataagtagaaaacctactagccttggaccagacacgaagaccaggactagcctaccgtaggctgacctcgtacgttttacgnggcaacgtcccgtaccgggaacttccggggtccncggtaacgattcgacgtcggaccacgggccggtctagggacctagtactttcccgactcctacgaccctagtacgacgtcgaacgtcctagtacgtaaggtccgttaggaaacgtagttacggtacggaaccgtttttttttaagtacgtttaagttaccgtttagtaaaaccgttaagttaacgttttaaacgttaccgttaacggttaccgggtttacgggttaaccccggtttccggggaaaccccggttaaacgggggtaacccttaaaggggttacgggtaaccttttaaccggacccggttacgggaaacccggttaaccggtttacggtaccgggttacccgtagtaaccccccgg

SEQ ID NO: 36213 - DNA, 517 bp, Homo sapiens
  misc_feature: GYAE6OF02IXKYS.19.21.B10.1.454.CMB.1.raw
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (384)..(385): a, c, t, g, unknown or other
  misc_feature (384)..(385): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (514)..(514): a, c, t, g, unknown or other
  misc_feature (514)..(514): n is a, c, g, or t
tcagtactctcgtgcacgaccggtgctcgattttagtgtcgtcgcaaggaggaggagggggggaggtacaacaggacaggcaggggcagcaagatggtgttgcagacccaggtcttcatttctctgttgctctggatctctggtcgccgacggggacagtcgtgatgacccagtctccagactcctggctgtgtctgtgggcgagcgggccacatcgactgcaagtccagccacaatctttanacngttccaanatgaaactcttggcttgaccngataganaccaggtacagtcctcgagctgactcatttnggcatctaccggatccggggtccnggaccattcagtcgnagcggtnggacngtatttcactcgtcaacgtnnancacgcncncgagngtagagagtgtcgtacgtagttattattagtactaataattattattatacttacgtagtacgtacgtacgaacggtaacgtacgtagtatatagacgacgtacgtagtcgtgngac

SEQ ID NO: 36214 - DNA, 664 bp, Homo sapiens
  misc_feature: GYAE6OF02HNFAF.19.21.B10.1.454.CMB.1.raw
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (361)..(361): a, c, t, g, unknown or other
  misc_feature (361)..(361): n is a, c, g, or t
  modified_base (410)..(410): a, c, t, g, unknown or other
  misc_feature (410)..(410): n is a, c, g, or t
  modified_base (501)..(501): a, c, t, g, unknown or other
  misc_feature (501)..(501): n is a, c, g, or t
tcagtactctcgtgcacgaccggtgctcgatttagtgtcgtcgcagtaggtaggagggggaggtacaacaggcgaggcaggggccaggcaacgaagtcggttcgttgcgagacccaggtcttcatttctctgttgctcgtggactctctgggtacgcccggacggggacatcgtggtacttcggtaccctagttctaccgagtacctcccgtggcgtggtgtctcgtcgggcggaggcggggccacggagtctagtcgcacgtcggacgcanatcttanagcgttcacatgaaactctagtctggtacagacagagaccgtaggccacgccgtcctaggcgtaggcctcgtaagtttcggnggacctaagtaccgtaaccgggaatccgggtaccagaccgtattaacgnggtcggcgacggtcggtacgtaggacggacgtactttccgacttcgtacactagtcaacgcaacggcctagccgtaaggtctacggtaaanagtagtaggacttagtttaagtagtacgtactaacgtaattattacgttagtccgttagggttaccgtaacgttccgggaacggtaacgggaacggtaaggttagaacggttaacgtaacggttaccggaaggtaccgtacgggtacgtaccgttacgaaccg

SEQ ID NO: 36215 - DNA, 147 bp, Homo sapiens; identical to SEQ ID NO: 36198
  misc_feature: GYAE6OF02I9N6D.19.21.B10.1.454.CMB.1.raw
  modified_base (147)..(147): a, c, t, g, unknown or other
  misc_feature (147)..(147): n is a, c, g, or t

SEQ ID NO: 36216 - DNA, 624 bp, Homo sapiens
  misc_feature: GYAE6OF02HA2KM.19.21.B10.1.454.CMB.1.raw
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
  modified_base (314)..(314): a, c, t, g, unknown or other
  misc_feature (314)..(314): n is a, c, g, or t
  modified_base (380)..(380): a, c, t, g, unknown or other
  misc_feature (380)..(380): n is a, c, g, or t
tcagtactctcgtgcacgaccggtgctcgatttagtgtcgtcgcaagaggaggagggggcagagtctgctgaattctggctgaccagggcagtcaccagagctccagacaatgtctgtctccttcctcttcttcctgcccgtgctgggcctcccataaggtgtcctgtcacaagtacagctgcagcagtcaggtccaggctggtnaagccctgcagaccctntcgctcacctgtgccattccgtccggggacagagtcgactacgcgacagtcgttcgcttggctagttgggtcaggcacgtccccagtcgagngtctagagtggctggaagctagttatttcattcgtaccaaacgtacgtagaaactactaaagtttncgccaactagttctagttagagtagtcgacttagaactaatacaaacgttagacaacactacggaaacgtaacctacgtttacctacccgtagaccgtagtccgttacggtaacccgttagtaccggtacgtaacccgtttaccccgggaaagggttacccggtaacggggttacgttaacgttaacgtttaaccgtcgggttaaacggaaccggtaacccgggtaccccctaagttaacccgg

SEQ ID NO: 36217 - DNA, 583 bp, Homo sapiens
  misc_feature: GYAE6OF02GIOVC.19.21.B10.1.454.CMB.1.raw
  modified_base (241)..(241): a, c, t, g, unknown or other
  misc_feature (241)..(241): n is a, c, g, or t
  modified_base (321)..(321): a, c, t, g, unknown or other
  misc_feature (321)..(321): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttaanacagttccaaacaatagaaaaactacttaagctttaggtaccagcagagaccaggacagcctcaggctgctcatttacgnggcatccgtacccgggaatcccggggtaccctgaccgtattcgagtggcgagcgggtctggacagtctttacactctacacctatcagcagcctgacaggtactagaagtattggtggtactaagttttattaagttcgtaactaaacgtaattaatttaattaacttacgtttacggtggtaccggttacgaccgaagggtaaccgtaagggtaggaataacgtcgaacggtacgtaacgttggtacggtccgtagtaacc

SEQ ID NO: 36218 - DNA, 338 bp, Homo sapiens
  misc_feature: GYAE6OF02IM9N7.19.21.B10.1.454.CMB.1.raw
  modified_base (225)..(231): a, c, t, g, unknown or other
  misc_feature (225)..(231): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (262)..(338): a, c, t, g, unknown or other
  misc_feature (262)..(338): n is a, c, g, or t
tcagtactctcgtgcacgaccggtgctcgatttagtgtcgtcgcaaggagaggaggggggaggtacaacaggcaggcaggggcagcaagatggtgttgcagacccagggtcttcattttctctgttgctctggatctctggtgcccacggggacatcgtgatgaccccagtctccagactccctggctgtgtctctgggccgagcgggctggcaaggcgcatagnnnnnnngnatcanatactgctcatncngtantcgatnnnnnnnnnnnnnnnnnnnnnnnnnnnnnnnnnnnnnnnnnnnnnnnnnnnnnnnnnnnnnnnnnnnnnnnnnnnnn

SEQ ID NO: 36219 - DNA, 677 bp, Homo sapiens
  misc_feature: GYAE6OF02F3D3C.19.21.B10.1.454.CMB.1.raw
  modified_base (254)..(254): a, c, t, g, unknown or other
  misc_feature (254)..(254): n is a, c, g, or t
  modified_base (353)..(353): a, c, t, g, unknown or other
  misc_feature (353)..(353): n is a, c, g, or t
tcagtactctcgtgcacgaccggtgctcgatttagtgtcgtcgcaagaggagagggggtcaggcctggaactgaggagcaggcgagggcagcaagatggtgttgcaggacccaggtcttcgatttctctgttgctctggatctctggtgcccgacggggacatcgcgatgacccagtctccagactccctggctgtgtctctgggcgagcgggccaccatacaactgcaacgtccacgccaacaattcttttanactacgttaccaaacaatacgaaaacttacttacgtcgttacgtaccagccaagacgaccgaggacacgcctaccgtaggctcgacttactatttacgngggactacgtccggttaaccccgggacgttcccggggtccctaggacccgttacttcgaggtcggcgagggtccgggtccgtagggacaagtttacttttcaccttcgtaccaacccgtagtaccgaacggtccctacggtcccgtaggaccgaagggtcctaaggtaacgtaggttcggtaaggtcgtttaaagtttttacgttaagtttaccgtactaaaactaaattttagtttaacttacgtttacttcgggtaccggttacgggtaccgacggtaacggtacgtaaagggtgtaacttacggacgacgtacgtacgtgg

SEQ ID NO: 36220 - DNA, 540 bp, Homo sapiens
  misc_feature: GYAE6OF02GMSC1.19.21.B10.1.454.CMB.1.raw
  modified_base (241)..(241): a, c, t, g, unknown or other
  misc_feature (241)..(241): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgacaagtccagccacaattctttanacagttccaacaatgaaaactacttagcttaggtaccagcagagaccaggacagcctcctaggctgctcatttactgggctatcctacccgggaatccggggtccctgaccgtattcagtggcagcggtctgggacagtactttcgactctcacatcagcagcctgcaggctgaagacgtgtgctagtttattatagtacaaagtaacttatttaataattacgttcgtacggtacgttcgaccgaagggaccgtaaggtggaattacgtacacggaactacgtaggtggactgtaccg

SEQ ID NO: 36221 - DNA, 603 bp, Homo sapiens
  misc_feature: GYAE6OF02IJ71C.19.21.B10.1.454.CMB.1.raw
  modified_base (252)..(252): a, c, t, g, unknown or other
  misc_feature (252)..(252): n is a, c, g, or t
  modified_base (440)..(440): a, c, t, g, unknown or other
  misc_feature (440)..(440): n is a, c, g, or t
tcagtactctcgtgcacgaccggtgctcgatttagtgtcgtcgcaagaggagaggggggaggtacaacaggcaggcaggggcaggcaagagtggtgttgcagacccaggtcttcatttctctgttgctcctgggactctcctggtcgcccgacggggacatccgtgactcgaccccagtctccagacctccctggctgtgtctcgtgggcgagcgggccacatcactgacgagtccagccataatcttttanacacgttaccaacaatagaaaactacttagcttggtaccagcagacgaccaggacagcctccgtaggctgctactatttacgtgggctactccgtaacccggggaatcccgggggtccctaggacccgtattcgaggtcggcacggtcgggtctaggggacagtactttcactctacacatcagctancctgcgaggctagaagtagtggtgactagtttacttattacgtactaaactaatttattatttaattacgtttacgtagtaccgttacggaccggtaacgggtaccgtaagggtcgtaagttacgtacgtaacggacgtaacgttggtacggtcttagacccg

SEQ ID NO: 36222 - DNA, 668 bp, Homo sapiens
  misc_feature: GYAE6OF02HNSTJ.19.21.B10.1.454.CMB.1.raw
  modified_base (251)..(251): a, c, t, g, unknown or other
  misc_feature (251)..(251): n is a, c, g, or t
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
tcagtactctcgtgcacgaccggtgctcgatttagtgtcgtcgcaagagagacggggggaggtacaacaggcaggcagggggcagcgaagatggtgttgcagacccaggtcttcatttctctgttgctcctggactctctggtagcccgacggggacatcgtgatgacccagtctccagactaccctggcctgtgtctctgggcgagcgggccaccgatcaactgacaagtccagccaacaattcttttanactacgttaccaacaatagaaaactacttagcttacggtaccagcagacgaccgaggacngcctacctaggctgctatatttacnggcatccgtaaccgggtacgtccggggtccctcgtacgacttcgacgtggacgaggtcgggtcgtgggacagtactttacgactcgtacacctagtacacgcctacgcctaggacctagggtcctaaggaacgtacgttgggtacgttccttaaggtttttactacgtttaaccggtacaaacgttaatttacgtttaaacttaacttaacggtttcggtacggttacccgggtttacgggaaccggttaaacggggaaccgtaaggggtacgtaagttaaccgaccggtaagtaaccggtacgttagggtaccgggtactacggtaacccc

SEQ ID NO: 36223 - DNA, 720 bp, Homo sapiens
  misc_feature: GYAE6OF02F7GRG.19.21.B10.1.454.CMB.1.raw
  modified_base (191)..(191): a, c, t, g, unknown or other
  misc_feature (191)..(191): n is a, c, g, or t
  modified_base (377)..(377): a, c, t, g, unknown or other
  misc_feature (377)..(377): n is a, c, g, or t
tcagtactctcgtgcacgaccggtgctcgatttagtgtcgtcgcaagagaggagggggggaggtacaacaggcaggcaggggcagcaagatggtgttgcagacccaggtcttcattttctctgttgctctggatctctggtcgcccgacggggacatcgtgatcgacccagtctcagactccctggctgtntctcgtgggcgacggcggccaccataccaactgacaacgtccacgaccaactaactttacttttaacactacgttaccaaactaataacgtaaaacttacttaacgtactttaggtaaccagacaacggaacgaaccgaacggaacgacgaccctacgtacggctacggccttactaatttacggngggacaacgtaccggtaacccgggtaacggttcccggggtccctacggaccgtattaccgaggtcggacgagggccgggttgacggggacagttactttcacttcacacctagtacgagccagccgtagacgacggtactaaggaacgtaggttggtacggtactttaaggttttaactttaacgtacgttaaccaaaacttaattttaattttaactttaaacgttacgttttaccgggtaggttaaccgggttaccggaaccggtaaaccggggtaacgtaagggtacggtaacttacgtaacaacggtaacggtaacgtggtaacggtacgtacgaaccg

SEQ ID NO: 36224 - DNA, 150 bp, Homo sapiens; identical to SEQ ID NO: 36106
  misc_feature: GYAE6OF02FJXTX.19.21.B10.1.454.CMB.1.raw
  modified_base (147)..(150): a, c, t, g, unknown or other
  misc_feature (147)..(150): n is a, c, g, or t

SEQ ID NO: 36225 - DNA, 892 bp, Homo sapiens
  misc_feature: GYAE6OF02G2HTH.19.21.B10.1.454.CMB.1.raw
  modified_base (245)..(245): a, c, t, g, unknown or other
  misc_feature (245)..(245): n is a, c, g, or t
tcagtactctcgtgcacgaccggtgctcgatttagtgtcgtcgcaagaggtaggaggggggaggtacaacaggcaggcaggggcagcaagatggtgttgcagacccaggtcttcatttctctgttgctctggatctctggtgcccgaggggacatcgtgatgacccagtctccagactccgtggctgtgtctcgtagggcgagcggccacatcaacgtgcaagtccagccaataattcttttaanactagttaccaaactaagtacgtaaaaaccttacttaacggtctttacgggtaacccagtacgaacgacgaacccgagggtaacacggtcccctacgtaacggtccgtgccttacgtaacgtttacgcggggtactaacgttacccggtaacccggggtaacgttccccggggttaccctacgggtaaccgttagttccggaaagggttcggaccggtaacggtccggggttaccgtaggggtaacctaacggttacctttacccgaccgttaccgtaccccgaacccgtacgtacccgaacgggtacccgtaccgtacccggttacgacccggtaaaccgggttccgttaaacgggaaacggttaacgggttcgggttacggttaacgtttaaacgtttttttacgttaacgggtttacccgtaaaccggttaaaaactttaaggttttaaccgttttaaagttttaacccgggttttaaccgtttaggggtaacccgggtttaacccggggttacccggtaaccgggtaaaacgggggttaaccccgtaaagggggtttaccggtaaactttaaccgggtaaccgttaaacgggtaacccgtttaacgggttcgggtttacccggttaccgtacggtaacccccg

SEQ ID NO: 36226 - DNA, 677 bp, Homo sapiens
  misc_feature: GYAE6OF02IV69N.19.21.B10.1.454.CMB.1.raw
  modified_base (244)..(244): a, c, t, g, unknown or other
  misc_feature (244)..(244): n is a, c, g, or t
  modified_base (496)..(496): a, c, t, g, unknown or other
  misc_feature (496)..(496): n is a, c, g, or t
tcagtactctcgtgcacgaccggtgctcgatttagtgtcgtcgcaaggaaggagagggggagtacaacaggcaggcaggggacaagcaagatggtgttgcagacccaggtcttcatttctctgttgctctggatctctggtcgcccgacggggacatcgtgatcgacccagtctccagcctcctggctgtgtctcgtgggcgagcggccacatcaactgcaacgtccagccactaattctttanactacgttaccaactaatacgaaaactcgttaagtccgttaggtaccaagtcaaggaacgaccgtaaggacacggccttaccgtacggctacgtcctacttacgtttacgcggctacgtaccggtaaccgggtaacgtcccgggtacctcgaacctagttcgacggtcgtacgacgggtcggtcgtacgggactaacggtctttacctacgtccgtaccgactacgtactacgtcgaccgtccgtcgaacgngtacgtcggaaacttgtacggtacgtacgtttaagtttattacgttacgtaacgaaacttaagttactttaacttagtacccgttggtacgttacctacgggtaacgtaaccgggaacggttaacgtacgggtaactacgtaaccgtaagtacccgttaagtcggttactacgcgtaaccg

SEQ ID NO: 36227 - DNA, 923 bp, Homo sapiens
  misc_feature: GYAE6OF02I284S.19.21.B10.1.454.CMB.1.raw
  modified_base (890)..(890): a, c, t, g, unknown or other
  misc_feature (890)..(890): n is a, c, g, or t
tcagtactctcgtgcacgaccggtgctcgatttagtgtcgtcgcaagaggaggaggggggaggtacaacaggcaggcaggggcagcaagatggtgttgcagaccccaggtcttcatttctctgttgctctggatctctggtgcccgacggggacatcgtgatgacccagtcctccagacctccctggctggtcgtcgtcgtcgggcgacggccgggccaccagtacaactcggacaacgtccacgaccaacgtaattcttttactactaacgttacccaaactaactaagtaaaaccttacgttacgtaccgtttaggtaccccaaggaccgaaggtaaccggaacccgaacgggaacccgaaccggtacccctttacccggtaacggtaccgtttcggacctttaccgtttaacgtttacccggttcgggtaacctacggttaccccggtaaccccgggggttaacccgggttaccccggggttaccccgttaagggtaccccgttaacgtttaccggtacggttacccgggaccgttacgggtacccggggttccggtacggggtaaaccgttaaccgttaccgttttacccgtaccgtttacctacccaccgtttaaactcccggatacccgttcgacccgttaaggcccggtagggtaacccgttggaattaagttccgggtttaaacgggcttttaaagggttttccttaagggtttcaaaccttaaaccgttatttaaccgtttaacgttaccgtttaaccggtttacgggttaacggggttaacccgttccggggaacccgtttaaaggggggtaaccccgttaaaggggttacgtaaccccgttaaggttaaccccggtacgtaaaccccggggtttaacgnggggtttaacccgccggttaacggtacccccgg

SEQ ID NO: 36228 - DNA, 735 bp, Homo sapiens
  misc_feature: GYAE6OF02J1TU8.19.21.B10.1.454.CMB.1.raw
  modified_base (382)..(382): a, c, t, g, unknown or other
  misc_feature (382)..(382): n is a, c, g, or t
tcagtactctcgtgcacgaccggtgctcgatttagtgtcgtcgcaagaggaaggagggggggaggtacgaacgaggcaaggcaggggcagcaacgatggtgttggcacgacccaggttccttccacttttctctcgttgctctaggatctctggtgcccacggggacagtcgtgatcgacccagtcctccaggactccctggctcgtgtctcgtgggcgacggcggccaccagtccaactgacaagtcacgccaacaacttactttaatactacgttccaaactaatacgaaaacttactaacgcgttacggtaacccagcctaaggtacgaaccgaaggacacgtacctaccgtaaggctaggacttcgtaacttttacgngggacctacgttacccggtaccggggtaaccgttcccgggggtacccttaggtacccggtacttccggtaggtcggcggacggtacggggtcgtacggggactaggttactttaccgacttacctacgtaccgtatacgaacgtcccaaggccacgggacgtaacggccttaagacgttatccggtgtaccgttatttagtttagacgtaactaaattacgttaatttaacttacttcggtaacgttcgggttacccggttagggaccgttaacggaaccggttggtaccggtaaagtttccgtaaccgagtttaaccgggacgttacgggttccggaccgtaccggtaaccc

SEQ ID NO: 36229 - DNA, 823 bp, Homo sapiens
  misc_feature: GYAE6OF02JCWJ0.19.21.B10.1.454.CMB.1.raw
  modified_base (244)..(244): a, c, t, g, unknown or other
  misc_feature (244)..(244): n is a, c, g, or t
  modified_base (332)..(332): a, c, t, g, unknown or other
  misc_feature (332)..(332): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacggggacatcgtgatgacccagtctccagactcctggctgtgtctcgtgggcgaggcgggccaccatcaactgacaagtccagccactaattctttanactacgttccaaactaatacgaaaactacttagtcttggtaccagcagacgaccaggacaacgcctccgtaggctggctctattacgngggctacgtcccgtaacccgggtaacgttcccgggggtccctaggaaccgtattccgaggtggcgacggtcggggtctaggggacctaaggtacttttccaacgttcctacccgtaaccctacttaaccgaacggtacccgtaacggtaccccgtaggtacccggaacgggtccgttaaacgggaaacggtacggtttacggggttacgttaaccgtttaacgggttttttaaagtttaacgttttacggtaaacccgtaaaacggtttaaaatttttacgttttaaacgtttaaaccgtttaaccggttttaccgggtttaacggggtttaacccggtttttacccgggacccgggtttaaaaacggggggttaaccccgttaaagggggttttaacgggtaaactttaacgggttaaccccggtaacgggttaaacccgggttaaaccggtttacggggttacggtacccggtttacggtaacccccgg

SEQ ID NO: 36230 - DNA, 743 bp, Homo sapiens
  misc_feature: GYAE6OF02I3SGY.19.21.B10.1.454.CMB.1.raw
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (501)..(501): a, c, t, g, unknown or other
  misc_feature (501)..(501): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacggggacatcgtgatcgacccagttcctccacgtacctcccgtggtcttgtcgtctcgtgggcgaggccggaccacatacacgtgacaacgtccacgccaactaacttacttttaacgactacttaaccaaactaaagtaactaaaaccttattacgtacgttacggtaccagacgaacgacgaactacggacaccgtcctacgtagcctcgacttactagtttacggngactacgtacccggtaaccggtacggtcccgggtacctacggaaccgtnttacggnggtacgacggtacgggtacgggttacacggggtaactaacgtttcgttaccctaccgtctaaccctaacncgttacgacctacgaccgtcgtaacgtcggacggttaccgaagtaggtacttacgggtcggttaactttaacggttttagttaacttacggttaaactaaactttaaagttaacttttaagttacggttacgtttacggggaacgtttaccggttaccggaacggtaaacgggtaggttaacgtaacgtaagtaccgtaagtaacggtaagttaccgtacggttacgtaccgtactaacccg

SEQ ID NO: 36231 - DNA, 723 bp, Homo sapiens
  misc_feature: GYAE6OF02HAFJ9.19.21.B10.1.454.CMB.1.raw
  modified_base (254)..(254): a, c, t, g, unknown or other
  misc_feature (254)..(254): n is a, c, g, or t
  modified_base (704)..(704): a, c, t, g, unknown or other
  misc_feature (704)..(704): n is a, c, g, or t
tcagtactctcgtgcacgaccggtgctcgatttagtgtcgtcgcaagaggaggagggggagtacaacaggcaggcaggggcagcaagatggtgttgcagacccaggtcttcatttctctgttgctctggatctctggtcgacccgacggggacatcgtgatcgacccagtctccagacctcctggctgtgtctcgtgggcgacggccgggaccacagtcaactcgacaacgtccagacccaatatttctttaanaccacgttaccaaactaatacgaaaacttacttagtacgtacggtacacgacgagaacgaacgtaaggactcgccttaccgtaggctagtcctacgtaactttacgcgggtacctagttaccccggtaacccggggtacgttcccggggtaccctacggtaaccttacgttcggaaggttcgggacgacggggttcggggtaaccgtagggtaacgtagttaaccgttttccgaacccgtcctaacgtaaccgtacgtaccgaacgtaccgtaccggcgttcggacgtaacggtacgtaagacgttcgtaggtcgttacttaaggttttacacgttacgttaacaacttagtttaactttagttacgttacggtacggttacggaccgttaacggaccggtaacgggtaactaacggttgtaaaccttggaccgtaagccggttaaccgngggtacctacgacgttacg

SEQ ID NO: 36232 - DNA, 751 bp, Homo sapiens
  misc_feature: GYAE6OF02G6OU4.19.21.B10.1.454.CMB.1.raw
  modified_base (370)..(370): a, c, t, g, unknown or other
  misc_feature (370)..(370): n is a, c, g, or t
tcagtactctcgtgcacgaccggtgctcgatttagtgtcgtcgcaagaggaggagggggaggtacaacaggcaggcaggggcagcaagactggtgttgcagacccaggtcttcatttctctgttgctctggatctctggtgcccaggggtacatcgtgatgacccagtctccagactccctggctgtgtctactgggccaggcgggccacgatcgaacctggcaagtccagtccacaattcctttttaagacaggtttaccaaactaacgtagaaaaactcttaagcctttaggtaaccccagaccgaaggtacgaaccaaggtaccaagcccttccgtaacggcctaggccttacgaatttttaaccgnggggtacctacgtaccgtaacccgggaatcccggggtaccctgggaaccgtattaccgaaggttggaccgtaagggcggggttcccgtaggggaaacctacggttacttttaccgaaccgtttcctacccgtaacccgtagttaccaacggtaccgtaaagtcccttagggacctaacggggtacttacgggaaaagttcgtacgtagggacctttaagtttaacgttacttaccgacgtaaacttaaggttactttaatttaaccggtactttaaccgggacgggttaaccgtttacgggaaccggtaaacgggtcgtaaagggttagacttaacgtagaccggtaacgtaaccgttggtccggtacttacccgtaaccg

SEQ ID NO: 36233 - DNA, 804 bp, Homo sapiens
  misc_feature: GYAE6OF02FZDT0.19.21.B10.1.454.CMB.1.raw
tcagtactctcgtgcacgaccggtgctcgatttagtgtcgtcgcaagaggagagggggagtacaacaggcaggcagggcagcaagatggtgttgcagacccaggtcttcatttctctgttgctctggatctctggtgcccacggggacatcgtgatcgacccagtcctccgagacctccctggctgtgtcgtcgtgggcgagccgggaccacactcgaactgacaagtccagaccactaattctttaagactacgttccaaactaatacgaaaacttacttacgtacctttacggtaccagacgtaaggacgtaaacccgacggtaaccacggtaccctaccggtaacgggtccgtcggtacctacgttaacgttttaccggtagggaccttaaacgttccgggttaacccggggtaaacgttcccccggggggttaccctacgggtaaccgttaacttaccggaaggttcggtaaccggtacggtaccgggggtccgttaacgggggtaaacctaacgggttaccttttaaccgacgttaccctaaccgtacctaacgtaccgacgaccgaacgttccgtacggacaacgggtctaacggaaacgtgtacggtacgagttttacggtttaatttacggttaacgttacgtaaacttaaagtttacgtttaactttaacgttacgtttacgttacggttaccggttaccggacgtaaaccggggttaacttaacgggttacgtaagttaacgtaccggaagttaaccgttacggttcggttacccggtacgtcggtaaacccgg

SEQ ID NO: 36234 - DNA, 805 bp, Homo sapiens
  misc_feature: GYAE6OF02IDT19.19.21.B10.1.454.CMB.1.raw
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (449)..(449): a, c, t, g, unknown or other
  misc_feature (449)..(449): n is a, c, g, or t
tcagtactctcgtgcacgaccggtgctcgatttagtgtcgtcgcaagaggtaggagggggtccaggctggaaactgaggagcaggcaggggccagcaagatggtgttgcagaccccaggtcttcagtttctctgtttgctactggatctcgtggtcgcccgacgggactagtgtgatcggacccgagttccnccgagaccttcccgngggctttgtacgttcgttacggtcgggaccgtagcccgggaccaacgtactacggtaccttaggacgtaacgtcccgtcggacctaacgtacgttccgttttaacgacgttaacgttaccaaacgtaagtaacgtaaaacgttacttaggtcgttacggtaccgtaacgtcgaacggtacgaaccgtacggaaccgtccgtaccttaccgtaacggtcgtaggtcctaacgtagtttaccgnggtactaccgttccggaaccgggtacggtacccggggtacctacggacgtacgttacggtacgtcggttaaccgacggtacgggtcgtacggtacgttagttacgtacccgtacgttacctaccgaagtccttaggtacctacggtcgtaccgtggacgtacgggacgtaacgttggtacgtcgggttcgttagttacggtttttactacgtttagttaaccgtaacgtaacgttaacgttacgtttaaccgtacggttacccggttaaggtccccggtttaccgggaacggttaaacgggacccgtttaaggtacggtaacctttaggaccgtttaaccggacgtacgtaccggg

SEQ ID NO: 36235 - DNA, 785 bp, Homo sapiens
  misc_feature: GYAE6OF02J01HN.19.21.B10.1.454.CMB.1.raw
  modified_base (241)..(241): a, c, t, g, unknown or other
  misc_feature (241)..(241): n is a, c, g, or t
  modified_base (369)..(369): a, c, t, g, unknown or other
  misc_feature (369)..(369): n is a, c, g, or t
  modified_base (454)..(454): a, c, t, g, unknown or other
  misc_feature (454)..(454): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagtactctcgtgcacgaccggtgctcgatttagtgtcgtcgcaagagaggaggggggaggtacaacaggcaggcaggggcagcaagatggtgttgcacgacccaggtcttcatttctctgttgctctggatctctggtcgcccgacgggacagtcgtgatcgaccagtcctaccagacctcccgtggtctgtcgtcgtcggtgggacgcggccggggacccaccgtactaccaaccgtnaaccgtaagtcccacgaccaactaactttactttaactacgtaacgttaccaaactaaagtaaacgtaaaaccgttacgttagtccgttacggtaaccagacggtaacgaacgtaaaccgaggtaacnccgtaccgtaccgtacggctagcctactacgtttcgaacggctaactaccggtaccgggaacggttcccggtacgtacgacttanccgtgtacgcgtaggccgggtanagacgtancgttactacgtcacacgntaccganccgtcacgtacncgtacggtagtacggaacgtagttgggtcgtaaacgtttacgttaacgggttacttaacggttaaccttaaaacttaacggttaacttttaaaccgttacccgttttaacggtacggtaaacggggttacccgggtaacggtaacccggttaacggggtaaacccgttaaggtttaacgggtaaacccgtttggtaaacccggtaaacgggttaacccgtaaacggttcgggttacgtaacccccgtagtttaaacccccggg

SEQ ID NO: 36236 - DNA, 857 bp, Homo sapiens
  misc_feature: GYAE6OF02HILE4.19.21.B10.1.454.CMB.1.raw
tcagtactctcgtgcacgaccggtgctcgatttagtgtcgtcgcaagagaggaggggggcagagtctgctgaattctggctgaccaggcagtcaccagagctccagacaatgtctgtcctccttcctcttcttcctcgcccgtgctcgggccctcccagaaggtgtcctgtcacaagtacagctgcagcagtcgaggtccaggtactggtacgaacgtcccgtcgcaacgtccccttctccgcctactaccgttgtcgacctacgttccggtaccggggaactacggtacggttcgacgtacgcgaaccgttggttggttcgtaccggttcggccgtacggtcggggtaccacggtaccgtaccgtaccccgtaggttacggacggtaacggtttcgaacggtacgggttccgggtaacggttacggggtaaacgttaacgttacgttttaacctttaccgtaaacggttaccgttaaccccgtaaacggttaacggtaacgggtaaaacgttaaaccttaaaagttttccgacggtaacccttaaccgtacgtttaccgggttagttaccggtaaagggtacgtaccgttaaacgtcggtaaactaaactaccggtaacgttaacgacaaacgtctaaacggtaaaccgtaaccgtttaccgtttcccggactcggtaacccgtaacgtcccggttaaccgtaccttacggggtttactaacccgggtaccccggttaaccggggtacccggttaaacgggtacgttaacccggtttttaagttttaacccggtaacggttcggggtaaaaccggaaccccgggtttaaaccccggacccttaaacgggttaaccc

SEQ ID NO: 36237 - DNA, 790 bp, Homo sapiens
  misc_feature: GYAE6OF02I9MKM.19.21.B10.1.454.CMB.1.raw
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctcgtggtcgcccgacggggacatcgtgatcgacccagtctccacgcctcccgtggcttgtcgtcgtcgtcgggcgacgccgggccaccgactccaactcgacctacgtccacgccaactactttacgtttatacgtacgttaccaaacgtaataacgaaaacttacttagtccgtttacggaaccacgtacgacgaaccgtaccgaacggacgaccgttaccctaccgtaacggtcgtacgccttacgtttacgttacgtacgggtacctaaccggtacccggttaacccggggaaccggttcccggggtaccctaccggtaaccgttacgttaccgtacgggtcggtacggtacggtcccggggttacggttacgggggtacctacggtttactttaccgaccgttacctaccgtacctaacgtaccgtacgtccgacgttaccggtacgacggtacggtacgttaaggtaacgtggttaccgggtacggttaccgttacgtttaacgtttacgttacgtaacgttaaacttaagtttaacttagtttaaccttacggttaacggttacggttaccgttacggtaaaccggtacgggtaaaccgtagggtacgtaagttacgtacgacggtacgtacgttaggtctacgcgtaccg

SEQ ID NO: 36238 - DNA, 802 bp, Homo sapiens
  misc_feature: GYAE6OF02HYZTF.19.21.B10.1.454.CMB.1.raw
  modified_base (178)..(178): a, c, t, g, unknown or other
  misc_feature (178)..(178): n is a, c, g, or t
  modified_base (788)..(788): a, c, t, g, unknown or other
  misc_feature (788)..(788): n is a, c, g, or t
tcagtactctcgtgcacgaccggtgctcgatttagtgtcgtcgcaagagaggagggggagagtctgctgaattctggctgaccagggcacgtcaccagacgctccagacaatgtctgtctccttctcttctcctgccgtgcgtcgggccctccagaggtcgtcctgtcaacaagtacngtctagcagacagtacgacggtcacggtacgtggtacgaaccgcctcgacacgtaccctcgtcgcctacctacctgactacctagtccggtacgggaactaggacgtcgtacgacgcgacgtggttgttcggtcgtcggacgtacggacggtacgaggtaccaaccgtccgtacgtacggagtacggtacgttacggacggttcggacgggtaacgggtaacgtacttacgtttaacgttaccgacgttaaccggtaccgtaaacggttacgggtaacgtaaacttaaaccggttaaacgtttaacgaccgtaacccgtattttaaaccgggttcgttttaacgggtaacggtaaggttaaccggtaccgtacggttacgaaactaacggttaaccgtaaacgacctaaagtaaccgtaagtaaaccgaaacgtttacgttaacccggtttcctacgtaaccgcggaaccgtttctaaccgtcggtttacccgtaggtcccgttaaccggtccggggttaacgggaaccggggttttacggtaactttaacggtttaacggttacggtaaacgggggtaccggaacccggtttaaccccgaacgggtttntaacgtaaacccgg

SEQ ID NO: 36239 - DNA, 683 bp, Homo sapiens
  misc_feature: GYAE6OF02GTI7A.19.21.B10.1.454.CMB.1.raw
  modified_base (218)..(218): a, c, t, g, unknown or other
  misc_feature (218)..(218): n is a, c, g, or t
  modified_base (352)..(352): a, c, t, g, unknown or other
  misc_feature (352)..(352): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacgggggacattcggtgatgacccagtctccagtacctccgtggctggtgtctcgtgggcgagccggccaccntcaactgacacgtccagccactattcttttacgactacgttaccaactaatacgtaaaacttcttagtcctttaggtaccagtcaggacgtaccaggtacacgtcctcgacgtctcggcctactacgtttacgngggtactacgttaccgacccggggtaagttccccgggggtccctacggaccgtagttaccgagggttccggacgttagggccgggttacgttacggggactaaaggttccgttttaccacgttccttaccgactacgtcgaacgtcgtaacgtccgttacgacggacggtacttacggaagttacgtgtacgtatactttgttagtcgtaactaacgttacttaatttctacgttcgttaacgtaggttacccgttacggacggtaacgggtaaccgtaaggtcgtaacgtactggaacggttacgtagcgttacgggtcttaccggtaac

SEQ ID NO: 36240 - DNA, 888 bp, Homo sapiens
  misc_feature: GYAE6OF02GYBLJ.19.21.B10.1.454.CMB.1.raw
tcagtactctcgtgcacgaccggtgctcgatttagtgtcgtcgcaaggagagagggggaggtacaacaggcaggcaggggcagcaagatggtgttgcagacccaggtcttcattttctctgttgctctggatctctggtcgacccgacggggaccagtccgtagactcgaaccctagtcctaccgagtacctccctggctgtcgtcctgtcgggcgacggccggaccacgactccaaacgtcgacgtaacgtccacgacccaaagtactttacgtttaacaaccgtacgttaacccaaaataaacgttaacgtaaaaaccgtttaccttaaggtccgttttaacggaaccccgaagtacccgaaggtaacgaacccgtaggacccaggttcccctaccggtaacggtcttacgccttacttaacgtttccgacgggactacgtaccccggtaacccggggtacgttcccggggtacccctaaggtccgttaacgttccggtaaacggttcgggacccttacggggaccggggtttacgaaacgggttaaccgtacgtacgtttttacccgaaacgtaccgtacccgtaaccctaacgttaaccgacggtaccgtaccggtacccgtagtacccggtaacggtacgtaacggtaaacgtaggttaccgggtaacggttttaaccgttaaaacgggtttttcttaaacgtttaaccgtaaacttaaacgtttaacttttaaacgtttacctttaaacgtttaacggttaccgggtttaccgggtaaccggtttaccgggaaccggttaaaccgggtaaccggttaagggttaactaacgtttaacgacggtaacgacggttaacgttacggaacggtacgtacgtaaccg

SEQ ID NO: 36241 - DNA, 838 bp, Homo sapiens
  misc_feature: GYAE6OF02H1S5C.19.21.B10.1.454.CMB.1.raw
  modified_base (235)..(235): a, c, t, g, unknown or other
  misc_feature (235)..(235): n is a, c, g, or t
  modified_base (477)..(477): a, c, t, g, unknown or other
  misc_feature (477)..(477): n is a, c, g, or t
tcagtactctcgtgcacgaccggtgctcgatttagtgtcgtcgcaagagaggaggggggaggtacaacaggcaggcaggggcagcaagatggtgttgcagacccccccccaggtcttctatttctctgttgctctggatctcgtggtcgcccgacggggacatcgtgactcgacccacgtctccacgcctccgtggctgtgtctcgtgggcggacggccggaccacactactacncgacacgtaccacgaccaactacttcttactacacgtaccaaactaataacgtaaaacttactagtaccttaggtaccagacgtagaacgacgacgacaccgtcctcgtagcgtctctacttagttcgacggtcctacgttaccggaccccgggtaacgggttccccgggtaccgtacggtaaccgttagtacggtggcggtacggtacggtcggggtcgtacgggtacgtattactttccncctacctaccgtaaacctgaccgtacgacccgtacggtccaggtaccgcggttacttaaacgggagttacgtacgggtacgggtacgtttttaagggtttaccgtttaccggtaccggtatttaccgggttaaaccttttttaacgtttttcccttttttaactcccggtttaaccccgtttagggggtttaaccccggtttacccggggttaaacccggggtaacggggtaaaccccggtttacggggggttaaagggggttaaacccggtaaaccgggttaaaccggttaaccgggggtaaaccccgtttacggggtttcgggtaaaccccgggggttttcaaaccggggtttaccccc

SEQ ID NO: 36242 - DNA, 774 bp, Homo sapiens
  misc_feature: GYAE6OF02HW7BX.19.21.B10.1.454.CMB.1.raw
  modified_base (739)..(739): a, c, t, g, unknown or other
  misc_feature (739)..(739): n is a, c, g, or t
tcagtactctcgtgcacgaccggtgctcgatttagtgtcgtcgcaagagaggaggggggaggtacaacaggcaggcaggggcagcaagatggtgttgcagacccaggtcttctatttctctgttgctctggatctctggtttcgacccgacggggacagtcgtgactcgacccagtctaccgagacctcccgtggtctgtgtctcgtgggacgacggccggaccacactacaactgacagtaccagccaactaattactttatactacgttaccaaataactacgaaaacttactacgtacttacgtaccgagacgacgacgaccgtaagacacgtaccctacgaggtctgtaccttactacgtttacggtcgactacgtaccgtaaccggggtacgtccggggtacctcgtaaccgtacgtacgtacggtcggacgtacgggtaccggttacgtacgggtaacgtacgtacctttaccgtaaccttaccgtacccaaacgtaccgttaagaaccgtaccggtaccgtaacccgtacggtaacccgtaaggggttaacccttaaaggtaacggtaaccgttcggggttaaccgggtaactttttaaacggttttaatttaccggtaacgttaaaccaaattttaaacggttaacttaactttaacggttacgtttaacggttacggttaaccggttcgaaaccggttaacgggtaacgtaaacggtgtaactaaccggntaacggtacgtacggtgtaacggtcgtacgtaccc

SEQ ID NO: 36243 - DNA, 803 bp, Homo sapiens
  misc_feature: GYAE6OF02HKFA6.19.21.B10.1.454.CMB.1.raw
tcagtactctcgtgcacgaccggtgctcgatttagtgtcgtcgcaagaggagagggggggaggtacaacaggcaggcaggggcagcaagatggtgttgcagacccaggtcttcatttctctgttgctctggactctcgtggtacgcccgacgggacctagtccggtgagttacggaccctaaggtcctccgaacgtaccttcccgtggactggttacgttctcggtacggggccgtaacggccgggtaccaaccgtaactaccgaacgttcgaaccgaacggtaccaacgacctaactaacttttcgtttaaactacgtaaccgttaccaaacgtaaacgtaacgtaaaaccttacgtaacgtacgttaccggtaaccacggtacaacgtaacgacccgaacggacctaccggtaacccgtactacggtacgtcgaccgtttacgtaacgttcgtacggtaccttacggtacccggtaaaccgggtaccgtcccggggtaccctggaaccgtgtacgtggacgtcgagggtaccggttcgtaaggaccgttaagtctttaccgtaacgtaccgacctaacgtactaccgtacggtacctaccgtccggtagtacgtacggtacgaacgtaacgttacggagtcgtatttacggtttaataccgttaatacgaaagtttaaaccttattaagttacctaaggtttcgaacgggtccggtaacgacgggtaaacggtaccgtaagggacgttaagtacgaacgtaaccgtacggttaaaccgtgggtaccgtacgtactaaccgg

SEQ ID NO: 36244 - DNA, 698 bp, Homo sapiens
  misc_feature: GYAE6OF02HZPON.19.21.B10.1.454.CMB.1.raw
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (287)..(287): a, c, t, g, unknown or other
  misc_feature (287)..(287): n is a, c, g, or t
  modified_base (341)..(341): a, c, t, g, unknown or other
  misc_feature (341)..(341): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcattctctgttgctctggatctctggtcgcccgacggggacatcgtgatgacccagtctccgagacctcccgtggctgtcgtctcgtgggcggagcgggccacatacactgacagtcacgcaactattctttanactagtaccaanaatacgaaaacttctagcgttacgacaganaacggagaccaaggacactaccgtacctaggcttcgacctcgtaactttacggngactacgttcccggaaacccgggtacgttccccggggtacctacggaacctacgtacgacggtcggacgtaaccggtcgggttacgtacggggtaacctaaggttccttttaacccgacctaccgtacccaaccgttaacgtcgacgctacgggtacctaggacgaccgtacgtaacggaagtacggtggtacgtacgtaaggttttagtaacgtttacgaaccgtaaattactttaatttaacgttacgttacgttcgggttaacggtacccggttacggaacccggtaacgggaacgttaacggtcgggtaattaacgtgtacgtaacggttgtacgggttcgacgtatacccgg

SEQ ID NO: 36245 - DNA, 706 bp, Homo sapiens
  misc_feature: GYAE6OF02JYOKW.19.21.B10.1.454.CMB.1.raw
  modified_base (170)..(170): a, c, t, g, unknown or other
  misc_feature (170)..(170): n is a, c, g, or t
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (306)..(307): a, c, t, g, unknown or other
  misc_feature (306)..(307): n is a, c, g, or t
  modified_base (367)..(367): a, c, t, g, unknown or other
  misc_feature (367)..(367): n is a, c, g, or t
  modified_base (542)..(542): a, c, t, g, unknown or other
  misc_feature (542)..(542): n is a, c, g, or t
  modified_base (696)..(696): a, c, t, g, unknown or other
  misc_feature (696)..(696): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctcgtggtcgcccgaggggacatcgtgactcgaacccngtcctccagacctcccgtaggctgtgtctcgtacgggcgaggccggccaacctataccaagtnacacgtaccagtcccaataattctttaancgtacgttaccaacaagtacaaaactnttacgcttacggaaccnnccgtaaggaccaccgacggacacggtcctacacggtctcgaccttagtaacttttacggnggaaccctacggttacccggtaaaccgggtacggtttaccccgggactaccgacccgttattcgtaacgggcggtcgtacggtaccgggtgtaacggtaacgacgtttatttaccacgtaccttaccactaagtcccggatccgttaaacccggtaacgcgtaggtacacggtanaagttcggataggtatttcgtaatccgtataatacgttaattacttaccgttagtttaccggacgttacccgggttacgtaacggtaacggggacgttaacgggtagggtacttacgtaacgggtaccgaacttggacggtttacaccgggttntaaacccggg

SEQ ID NO: 36246 - DNA, 846 bp, Homo sapiens
  misc_feature: GYAE6OF02F5SWU.19.21.B10.1.454.CMB.1.raw
  modified_base (159)..(159): a, c, t, g, unknown or other
  misc_feature (159)..(159): n is a, c, g, or t
tcagtactctcgtgcacgaccggtgctcgatttagtgtcgtcgcaagaggagaggggggagagtctgctgaattctggctgaccagggcagtcaccagagctccagacaatgtctgtctccttcctcttcttcctgcccgtgctgggcctccacaggtntctgtcactaagtacagctgcagcagtcaggtccagggacctgggtacgaaccgccctcggcaaccggtaccctctaccgcctctacctggtcacctagtccgtccggggatagcggttacgctaggacgacgtagttcgttgtcgttcggaccgtaccgtgggtacaccgggtcctaccgtccccagtacggagtacggtcgtaacgaggttcggcggtaggggactaactatttaactacggtactttacggtaaccaaacggtaggtaagtaaacgttaaacttaaacggttcgtacgtaaccgtaacccgtttacgttaccggtttagttaaccgggtaacgtaccgggttaaaccgttaacggttacggtaaacctaaacgttaaccggttaaaccgggtaaacttaaccccgttaaagaaaccggttaaacggtaaaaacccggtaaacccgttaaccgtttaaccccgtttacccgggaacgtaacccgtaacggttaacccgttaacccggtttaccccgttaccgggttaccgtaccgtacccccgggtaacgggtaacccgggttaaacccgggtaaccggtttaacggttaaggttttaacccggtttaaccgggttacgggtaacgggtaaacccgggtaccccgtaacccccgttaaaggtacccggttaaccg

SEQ ID NO: 36247 - DNA, 700 bp, Homo sapiens
  misc_feature: GYAE6OF02GRWE4.19.21.B10.1.454.CMB.1.raw
  modified_base (217)..(217): a, c, t, g, unknown or other
  misc_feature (217)..(217): n is a, c, g, or t
  modified_base (252)..(252): a, c, t, g, unknown or other
  misc_feature (252)..(252): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
  modified_base (666)..(666): a, c, t, g, unknown or other
  misc_feature (666)..(666): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctgggactctcgtggtcgcccgacggggacatcgtgatcgaccagtctccgagcctccgtggtctgtgtctcgtgggcgaggcggaccacntccagtgactagtccacgaccaatacgttctttanacgtaacgttaccaaacaagtataaaacttacgttacgtccgttacgaaccngaacncggtaacgaaccgaggacacgtcccncgttaaggctacgacctataacgtttccgaggtaccacggttacccggtaccgggtaaccgccccggggttacccnggtaaccgtacttacggnggttaccggcggaacgggtccgggttacgacggtaactacggttactttccgccgttacctaccgacctactaacgacgtaccgtaccgccgtcgtaccggacggtacgtacgtaaggtacgtcggtacgtaccgttaagttttacgtacttagtaactaattaacgttaacgtttaataccgttacgttcgtacggttaccgtacgacggaacggtaacggacgttagaacgttanacgtaacgacggtaacgtcgacggtcctgtaccg

SEQ ID NO: 36248 - DNA, 679 bp, Homo sapiens
  misc_feature: GYAE6OF02JEOIB.19.21.B10.1.454.CMB.1.raw
  modified_base (245)..(245): a, c, t, g, unknown or other
  misc_feature (245)..(245): n is a, c, g, or t
  modified_base (466)..(466): a, c, t, g, unknown or other
  misc_feature (466)..(466): n is a, c, g, or t
tcagtactctcgtgcacgaccggtgctcgatttagtgtcgtcgcaagagagacggggggaggtacaacaggcaggcagggggcagcgaagatggtgttgcagacccaggtcttcatttctctgttgctctggatctctggtgcccacggggacatcgtgatgacccagtctccagactccctggctgtcgtctcgtgggcaggcggccaccatcaactgacaagtccagccactaattcttttanactacgttccaacaattagaaaacctcttacgcttcggtaaccagcaaggacgtaccaggacacgtccctaccgtaggtcctacgtcttactagttttaccgtgggtacctacgttccgttaaccccggggaacgttccccgggggtaccctacggacccgtacttcgacggttcggcaggtcgggtctaggggactaggtctttcacgtctaccacctancgagcacgccgtagaccgaggtacgtacgagtacgtacggttcgggtacttaaggttttacttaattcggtaacctaaactacgttttaattaatttaacgtacgttacggttacgggtaccgttacggaccggtaagggtcccggttaaaggttaggtaactacgttacgaacgggttactaacggttaggaccgggtaccttacggacccc

SEQ ID NO: 36249 - DNA, 569 bp, Homo sapiens
  misc_feature: GYAE6OF01BLJNO.48.56.F01.1.454.CMB.1.raw
  modified_base (252)..(252): a, c, t, g, unknown or other
  misc_feature (252)..(252): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgngcagtgggtccagcagcgcccgggccgttccccgcactgtaatatatgaggacattcaaagaccttcgtcggggtccctcctcgattctctggctcatcgacaggtcctccaactccgccctccctcttcatctctgaactgaagactgaggacgaggctgtcttttactcgtctacgtcctctgagtcggcagcgtcgtaggttcgtcgttcgggcgggacggaccgactacgtcggtaaccgttacgtcggtacacggcccgaacggccgtacccgtccccccgtcggtcccaccgttccgtccggttccccccg

SEQ ID NO: 36250 - DNA, 692 bp, Homo sapiens
  misc_feature: GYAE6OF01AFUNT.48.56.F01.1.454.CMB.1.raw
  modified_base (251)..(251): a, c, t, g, unknown or other
  misc_feature (251)..(251): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcgggtctccggggaagacggtaagcatcacctgcacccgcaccagtggcgacattgccagcaactttgngcagtggtccagcagcgcccggccgttcccccgcactgtaatatatgaggacattacaaagaccttcgtgggtcccctcctcgtattctctggcctccatcgacacggtcctccgaacctccgtccctcccttcttactacttctcgtacgtaacgtacgaacgtactagggacgggacggacggtcgttacgttccgttttactcgttaccgtacgttccctagtcggtacgtcggacgtacgccgtacgttacgggtttccgttccggtttccggggaccgggtacccggaaccgtaccgtaccggttaccggttaacccggtttcggtacccgggtaccgtacccgggtacccctaccggggttacccttccccccgggtaccccccggtttcggtacccccttacccggttcccggtttccccggttaccccccccg

SEQ ID NO: 36251 - DNA, 546 bp, Homo sapiens
  misc_feature: GYAE6OF01BLTZS.48.56.F01.1.454.CMB.1.raw
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctcggggtccctcctcgattctctggctcatcgacaggtcctccaactccgcctccctcttcatctctgaactgaagactgaggacgaggctgtcttttacgtgtcagtcctctgatcggcagcgctagttgtcgttcgggcgggaggacccacgtacgtcgtaccgttagtcggtcacgcccaacggcctcgtcccccgtcgtcctacctccgtcgttacccccg

SEQ ID NO: 36252 - DNA, 547 bp, Homo sapiens
  misc_feature: GYAE6OF01BN4RH.48.56.F01.1.454.CMB.1.raw
tcagagtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctcggggtccctcctcgattctctggctccatcgacaggtcctccaactcccgcctccctctcatctctgactgaagctgaggacgaggctgtcttttactgtcagtcctctgatggcagcgctagttgtcgttcgggcggacgggccactacgtcgacccggttacgtcggtacacgccccgaaggccctccggccccccttcggtcctccgtccttccccgg

SEQ ID NO: 36253 - DNA, 548 bp, Homo sapiens
  misc_feature: GYAE6OF01D317D.48.56.F01.1.454.CMB.1.raw
  modified_base (252)..(252): a, c, t, g, unknown or other
  misc_feature (252)..(252): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgngcagtgggtccagcagcgcccgggccgttcccccgccactgtaatatatgaggacattcaaagaccttctcggggtccctcctcgattctctggctccatcgacaggtcctccaactccgcctccctcttcatctctgactgaagactgaggacgaggctgtcttttactgtcacgttctctgatggcagcgcagttgtcgttcgggcggacgggaccacacgtgacccgtttagtccggtacacggccccaaggccctccggccccccttcggtccacttccgtcgttccccccg

SEQ ID NO: 36254 - DNA, 569 bp, Homo sapiens
  misc_feature: GYAE6OF01DSOK1.48.56.F01.1.454.CMB.1.raw
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagccgcccgggccgttcccccgccactgtaatatatgaggacattcaaagaccttcgtggggtcccctcctcgattctctggctccatcgacacgtcctcaactccgccctccctcttcatctctgaactgaacgactgaggacgaggctgtcttttactgtctagtcctctgtatggcagcgtcgtaggtttgtcgttcgggcgggacgggaccaccacgtcgtaccgttagtccggtacaccgcccggaacggtcccgtccggtcccccgttaccggtccaccttccgttcgttacccccc

SEQ ID NO: 36255 - DNA, 518 bp, Homo sapiens
  misc_feature: GYAE6OF01BCKOC.48.56.F01.1.454.CMB.1.raw
  modified_base (162)..(162): a, c, t, g, unknown or other
  misc_feature (162)..(162): n is a, c, g, or t
  modified_base (414)..(414): a, c, t, g, unknown or other
  misc_feature (414)..(414): n is a, c, g, or t
  modified_base (485)..(485): a, c, t, g, unknown or other
  misc_feature (485)..(485): n is a, c, g, or t
  modified_base (506)..(506): a, c, t, g, unknown or other
  misc_feature (506)..(506): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaacngactcagtcccactccgtgtcggggtctccggggaagacggtaagcatcacctgcaccgcaccagtggcgacattgccagcaactttgtgcagtggtccagcagcgccgggccgttccccgcactgtatatatgagacattcaaagaccttcgtcgggtccctctcgtattctctggctcatcgactcgtcctccaactccgcctccctcttcactctctcactgaagactgaggacgagctgtctttacgngtctactctctgagtgcagcgctacgttctcgttcggcggacggaccacgacgtcgtaccgttagcggtcncgtccgaggctcgccctgtcnctcgtcgtcccc

SEQ ID NO: 36256 - DNA, 538 bp, Homo sapiens
  misc_feature: GYAE6OF01ESS5O.48.56.F01.1.454.CMB.1.raw
  modified_base (254)..(254): a, c, t, g, unknown or other
  misc_feature (254)..(254): n is a, c, g, or t
tcagagtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccatccgtgtcggggtctccggggaagacggtaagcatcacctgcacccgcaccagtggcgacattgccagcaactttgngcagtgggtccagcagcgcccgggccgttcccccgccactgtaatatatgaggacattcaaagaccttctggggtccctctcgattctctggctccatcgacaggtcctccaactccgcctccctctcatctctgactgaagactgagacgaggctgcttattactgtcagtcctctgatggcagcgctagttcgtcgttcgggcggtacgggacccacgacgtcgtacccgttagtccggtcacgccccaaggtcctccgcccccgtcggtccaccgttcccg

SEQ ID NO: 36257 - DNA, 558 bp, Homo sapiens
  misc_feature: GYAE6OF01AR2NQ.48.56.F01.1.454.CMB.1.raw
  modified_base (421)..(421): a, c, t, g, unknown or other
  misc_feature (421)..(421): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgcactgtaatatatgaggacattcaaagaccttctggggtccctcctcgattctctggctccatcgacaggtcctccaactccgcctccctcttcatctctgaactgaagactgaggacgaggctgtcttttacngtcagtctctgatggcagccgcgtagttcgtcgttcgggcggacgggacccacgacgtgtacccgttagtccggttacacggcccgaaggtcctccggtccccccgtcggtaccaccgtccgttccggttccccccg

SEQ ID NO: 36258 - DNA, 575 bp, Homo sapiens
  misc_feature: GYAE6OF01BJ0Z5.48.56.F01.1.454.CMB.1.raw
  modified_base (332)..(332): a, c, t, g, unknown or other
  misc_feature (332)..(332): n is a, c, g, or t
  modified_base (451)..(451): a, c, t, g, unknown or other
  misc_feature (451)..(451): n is a, c, g, or t
tcagagtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggaagaccgtaagcatcacctgcacccgcaccagcggcgacattgccagcaactttgtgcagtgggtccagcagcgcccgggccgttcccccggcacctgtaaactatactgaggacattaccaaagaccctttntcggggtcccctcctcgattctctggctccatcgacaggtcctccaactcccgcctccctcttcatctctcgaactgaagactgaggacgaggctgctttattactgtctacgtccttntgagtggacagcgctaggttgtccgttcggcggtacgggacctacgaccgttcgaccggtttagccggttcgacggtacccgaacgggcctccgacccccgttcggttcccgtacgttccccgg

SEQ ID NO: 36259 - DNA, 731 bp, Homo sapiens
  misc_feature: GYAE6OF01EI34V.48.56.F01.1.454.CMB.1.raw
  modified_base (253)..(253): a, c, t, g, unknown or other
  misc_feature (253)..(253): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattcgccagcaactttgngcagtggtcagcagcgcccggccgttccccgcactgtaatatatgaggacattcaaagtccttcgtcgggtccctctcgattctctcggctccatcgactacggtcctacctaacctcccgcccttcccctctttccacttccttacctacgtaaccgttagaaacgtacgttacggaacgggtaaccggtaacgggtccttggttacccttttttacgtcgttactacggttcccttacgtagtacgtcgggacgacggtccggtacgttacgtttcggttccggtttaccggggaccggggtaaccgggtaacccgtaaccgttaccgttaccgggttaacccggtttacgttaccccggggttacctaacccgggtacccccggtaaaccggggtcccttacccccgggtacccccccgtttcccggggttaccccttacccggtttcccgtttcccccggtttaaccccccccg

SEQ ID NO: 36260 - DNA, 636 bp, Homo sapiens
  misc_feature: GYAE6OF01DN98R.48.56.F01.1.454.CMB.1.raw
tcagagtatacatacacgaccggtgctcgatttagcagacgtctgaacacacaaaggggggtagctcaggaagcagagcctggagcatctccactatggcctggactccactacttctcaccctcctcgctcactgcacaggttcttgggccactttttaaactgactcagccccactccgtgtcggggtctccggggaagacggtaagcatcacctgcacccgcaccagtggcgacattgccagcaactttgtgcagtgggtccagcagccggcccgggcccgttccccgccactgtaatactatgaaggacattacaaacgtcctttcgtcggggttcccctcctcgacttcctctggcctccatcgacacggtcctaccaacctcccgtcctcccctcttccattctcgttagaacgttagaacgtacgtaggaacgggacgaggtcttacgtctttttactcgttctacgttccctcttgtacgtgggcaggcggactaggtttcgtaccggtttcgggacgggtacggccctaacgtaccgtcggtaccgttagtccggtaccacggaccccgtaaggtcccgtcccggtcccccgttacggtccctaccgttcccttcccggttcccccc

SEQ ID NO: 36261 - DNA, 603 bp, Homo sapiens
  misc_feature: GYAE6OF01A4NN0.48.56.F01.1.454.CMB.1.raw
  modified_base (240)..(240): a, c, t, g, unknown or other
  misc_feature (240)..(240): n is a, c, g, or t
  modified_base (474)..(474): a, c, t, g, unknown or other
  misc_feature (474)..(474): n is a, c, g, or t
tcagagtatacatacacgaccggtgctcgatttagcagacgtctgaacacacaaagggggtggtagctcaggaaggcagagcctggagcatctccactatggcctggactccactacttctcaccctcctcgctcactgcacaggttcttgggccacttttaaactgactcagccccactccgtgtcggggtctccgggggaagacggtaagcatcacctgcacccgcaccagtggcganattgccagcaactttgtgcagtgggtccagcagccgcccggggcccgttccccccgccactgtaatatatgaggacattcaaagaccttcgtcggggtccctcctcgattctcgtggctccatcgacacggtccctccaacctcccgccctccctacttcatcctctcgaactgaagctggacggacggaggctagtctttattacgtgtcctagtcctcgtcgagttcggacncgcgtcgtagttcgttacgtcgggacgggacgggtaccaccgtaacgtcggttaccggttacgtccgggtacaccggtaccccgaacgggtccgttccggccccccgttccgtccgtaccgttccccgg

SEQ ID NO: 36262 - DNA, 684 bp, Homo sapiens
  misc_feature: GYAE6OF01BH24A.48.56.F01.1.454.CMB.1.raw
tcagagtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccactccgtgtcgggtctccggggaagacggtaagcatcacctgccacccgcaccagtcggacgacattgccagctaaccttttggtgcgtagtggggtccaggcaggccgccccggggcccgttccccccgccacgttagtaatagttatggaggactattacaaacgtacctttcgtcggggtcccctctcgtatttctctggcctccactcgactacggtccctaccaaccgtcccgtccctccccttcttaccacttcctcgttagacctaggaacgtacgtcggaagggtacggaggtcctgtacctttattaccgtcgtcaccgttccttgtgtacgtcggacgacgcgtcgttagggtttcgttaccgggttccgggaccggggaacggtcccgtaacgacccggttacggtacccggtttacgtcccgggtaccgacccggtacccgaacggggtcccttaccccggtacccccgtttcggtaccccgttcccgttccccgg

SEQ ID NO: 36263 - DNA, 703 bp, Homo sapiens
  misc_feature: GYAE6OF01AOQTC.48.56.F01.1.454.CMB.1.raw
  modified_base (256)..(256): a, c, t, g, unknown or other
  misc_feature (256)..(256): n is a, c, g, or t
tcagagtatacatacacgaccggtgctcgatttagcagacgtctgaacacacaaaggggggtagctcaggaagcagagcctggagcatctccactatggcctggactccactacttctcaccctcctcgctcactgcacaggttcttgggcctacttttaaactgactcacgccccactccgtgtcggggtctccggggaagacggtaagcatcacctgcacccgcaccagtggcgacattcgccagcaactttgngcagtgggtccagcagccggcccgggtcccgttccccgccactgtaatatatgaggacattacaacgtaccttcgtcggggtcccctccgtcgtacttctcgtcgcctcacgtcgacgacggtcctaccaacctccgccctcccttcttcctatcctacgtacgaacgttcgaagtactaggacgggacgtagggtcttcgttaccttttacgtcgttaccgtacgttcctcgttacggtacgtcgggccgtagggcccgtacgttaacgggttttcggttccggtttacggggacggggtaccgggaaccctaaccgtaccgtttaccggttacccgtttaaccggttccgggtaccgaaccggcccggtaaccggtcccgtacccgggtcccccccgttaccggttaccctacccgttcccggtttccccggtttacccccccgg

SEQ ID NO: 36264 - DNA, 765 bp, Homo sapiens
  misc_feature: GYAE6OF01DB6IL.48.56.F01.1.454.CMB.1.raw
  modified_base (268)..(268): a, c, t, g, unknown or other
  misc_feature (268)..(268): n is a, c, g, or t
tcagagtatacatacacgaccggtgctcgatttagcagacgtctgaacacacaaagggggtggtagctcaggaagcagagcctggagcatctccactatggcctggactccactacttctcaccctcctcgctcactgcacaggttcttgggcctaactttttaaactgactcacgccccactccgtggtcggggtctccggggaagacggtaagcatcacctgccacccgcaccgaggtcgcgactattcgccagtactaactttgngcaggtcggtccagcacggccgcccgggtcccgttccccgcactgtaatatagtaggacgtactacttacgaaacttccgttcggtccgggtccctcgttactacttcgtcgtcggtccttaccacgtccgaaccgtacggttcccctaccgtaacccgttccccgtccctttccccttcctttacctaccgttccgttacttaacggtaacgtacggtaacgtacgtggggtaaacggacggtacggtcctagttactttaacgtttcgtcgttaccgtacgtttccctgtaggtcgtacggtaccgacgtcggttagttacgggttttcggtttacccgggtcggggtaacgggtacccggtaaaccgtacccggttacgtaacccgggtttaaccgttaccggttaacccgggccgtaacccgggtaccccgtacgggtcccccgttaaccccggtccccccggtttacgggtacccgttcccggtttccccgg

SEQ ID NO: 36265 - DNA, 658 bp, Homo sapiens
  misc_feature: GYAE6OF01AHR4V.48.56.F01.1.454.CMB.1.raw
  modified_base (253)..(253): a, c, t, g, unknown or other
  misc_feature (253)..(253): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgccacccgcaccagtggcgacattgccagcaactttgngcagtcgggtccagcacgccgcccgggccgttccccgcactgtaatatatgaggacattcaaacgtaccttcgtcggggtcccctccgtcgtacttcctcgtcggcctccatccgactacggtccctaccgaacctcccgacccttcccctcttccacttcctactcgtaacctagaacgtacgtaggagggaccgtaggtcttcgtacctttacttaccgtcgttaccacgttccctcgtggacgtcggcacggcgtcgtacggtttgtccgttcggggaccggtaacgggacccacgtacgttacggtacccggtttagtcccgggttacaccggaccccgtaacgggtccccgttcccggaccccccgttaccggtaccctacccgttcccgttacccccgg

SEQ ID NO: 36266 - DNA, 755 bp, Homo sapiens
  misc_feature: GYAE6OF01BI2KV.48.56.F01.1.454.CMB.1.raw
tcagagtatacatacacgaccggtgctcgatttagcagacgtctgaacacacgaaagggggtagcgtcaggaagcagagcctggagcatctccactatggcctggactccactacttctcacctcctcgctcactgcactaggttcttcgggcctaacttttaaactcgactcacgcccctacgtccggtcggtacgggggtcgtaccgggggaagacggtaacgcactccaccgtgccacccgcaccgaggtcggaccgacgtacttcggaccagtacctaacgttttggacgtcgtaggttcgggtaccaggccgacggcccgggccccgggtcccgttcccccgcctacgttcgtaatactagtaggacggtactagttacgaaacgtacctttcggtccgggtccctcgtacgtacttccgtcgtcggcctcacgtccgacgtccggtaccctaccgaaccgtcccgtaccttcccttcttactactccgtcgtacgaacgtacgaacgtacgtacgggaacgtacggtacgtcttcgttacgttttacgtcggttactacggttcctcggtacgtacggtcgacgtacggtccgtcggttacgggttcggttccggtacggggaccgggtaccggacccgtaacgtccgttaccgggtaccggttacgcccggttacgaccggtcccgtacggtcccgttcccggtaccccggttccggtaccttcccggttccgttccccgttaccccc

SEQ ID NO: 36267 - DNA, 861 bp, Homo sapiens
  misc_feature: GYAE6OF01BBF2O.48.56.F01.1.454.CMB.1.raw
  modified_base (121)..(121): a, c, t, g, unknown or other
  misc_feature (121)..(121): n is a, c, g, or t
  modified_base (820)..(820): a, c, t, g, unknown or other
  misc_feature (820)..(820): n is a, c, g, or t
  modified_base (837)..(837): a, c, t, g, unknown or other
  misc_feature (837)..(837): n is a, c, g, or t
tcagagtatacatacacgaccggtgctcgatttagcagacgtctgaacacacaaagggggtggtagctcaggaagcagagcctggagcatctccactatggcctggacctccactacttcnccaccctctcgctcactgcacgtacggtttcgtcggtaccttaacctttttaactcgaactcgaccgacccctaccgttccggtcgggttccggggtccggtaccggggaacggtacggtaacgcgtacctcctaccgtcgacccgacccgaccgaaccgtgggtaccggacgaacgttcgttaccgaccgaacgtactttaacgtttggacgtacggtagggttaccggggtaccacggaccgaccgggtcccccggggtacccccggggttcccgttccccccggaccgttaacgtttaacgttaaacttacgtacggttaacggaaccggtaacttaaacgtacgtaaacccggttccggttttacccggtccgggttcccttaccgttcgttaaccgtttccgtaccggtcggtcccttacgtaccgtacggtaaccggtacccgtttaccccaacccgttaccccgtccccgtacccctttacccgttctttaacctcttaccgttacgtaacgtaacgtaacgtacgtacggtaggtaacgggacgtggtaccgttctttacttgttaccgttactacccgttagttacccgttagcgtttaacggcgtcgtaacgggtcttaacggtttaccggttacgttcggaccggggtacgaccggtaccacggtaccgttacgtacggtgtacccgnacccggtcaccggtccncccgttacctcgctccgttacccg

SEQ ID NO: 36268 - DNA, 651 bp, Homo sapiens
  misc_feature: GYAE6OF01DVZ2P.48.56.F01.1.454.CMB.1.raw
  modified_base (167)..(167): a, c, t, g, unknown or other
  misc_feature (167)..(167): n is a, c, g, or t
  modified_base (265)..(265): a, c, t, g, unknown or other
  misc_feature (265)..(265): n is a, c, g, or t
tcagagtatacatacacgaccggtgctcgatttagcagacgtctgaacacacaaagggggtggtagctcaggaagcagagcctggagcatctccactatggcctggactccactacttctcaccctcctcgctcactgcacaggttcttgggcctaacttttaaacngactcacgccccactccgtgtcggggtctccggggaagacggtaagcatccacctgccacccgcaccagtcggcgacagttcgccagctaacttttgngcagtcgggtccagcagccgcccgggcccgttcccccgccactcgtaatatatgaggacattacaaagtaccttcgtcgggtccctcctcgtattctctcggctccagtcgacgacggtccctccactcccgccctcccctcttctactcgtctacgtaactggaacgtacgttaggaagggacgtacggcttacgttctttttaactcggttaccgtacgtcccttcgtagtacgtacgggtcaacggtcgtacgtacggtttcgttccgttaccggggtcgggaaccgggtacccaacgtaccgtacgttacccggttacgtccgggtacctcggacccgaaggcccgtccgtcccccgtcggtccctcgttccgttacccccg

SEQ ID NO: 36269 - DNA, 850 bp, Homo sapiens
  misc_feature: GYAE6OF01A2PJI.48.56.F01.1.454.CMB.1.raw
tcagagtatacatacacgaccggtgctcgatttagcagacgtctgaacacacaaaggggggtagctcaggaagcagagcctggagcatctccactatggcctggactccactacttctcaccctcctcgctcactgcacaggttcttgggcctacttttaaactgactcagccccactccgtgtcggggtctccggggaagacggtaagcatcacctgccacccgcaccagtggcacattcgccagctaactttgtgcagtgggtccagcaggcgccccgggccgttcccccgcactcgtaatactatggacgactattacaacgaccttcggtcgggtcccctctcgtacttctcgtcggtcctaccacgtacgaccgtacggttacccctacccgtaaacccgttccccggtaccccctttccccctttccgtttaccctaacctttccccgttaccctttaacggtaacccgtttacgggtaaaacggtaccgttaggggaaacgggtaacccgggtacgggttaccgtttaccgggtttacccgtttttttacgtaccggtttaccgttaccggtttaccccgtttacggttacggtacgggttccgggggtaccgtaacgggtaccccgggttacgtttaaccggggtttttcggtttaccgggtttcccggggggtaaccggggtacggggtaaccccgtaaccgttaccgggttaccggttaacccgggttacggttcccgggtaccgtaacccggcccggtaaaccggtccccggttaccccggcccccccggtttacggttaccccgtaccgtttcccggttaccccggtttacccccccg

SEQ ID NO: 36270 - DNA, 907 bp, Homo sapiens
  misc_feature: GYAE6OF01E43IV.48.56.F01.1.454.CMB.1.raw
  modified_base (164)..(164): a, c, t, g, unknown or other
  misc_feature (164)..(164): n is a, c, g, or t
  modified_base (287)..(287): a, c, t, g, unknown or other
  misc_feature (287)..(287): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggcctacttttaaacgngactcacgcccactccggtggtcggggtctccggggaagacggtaagcatccaccgtgaccgaccccgcaaccgtaggtcgggaccgaactagttccggacccgtaagccgtaaacgttttgnggtacctagggtcggtaccgagaccgacggcccggccccggggtcccgtttcccccggacctaaccgtttaggtaaaaccttaacgttaacgtacggtaacggtaaccgtaacgttaaccgtaaaaccggtacccgttttccgggttaccgggggttcccccttacccggtttacgtaaccgttcccgttaccggtacggcccttaccgtacggtacccgtaccgggtaaccggttacccgttaccccgaaaccgttccccgtacccctttacccctcgttacccactttcctaccgttacggtaacccgtaggaaaccggtacgttaacgggaccgggaacggttaacgggtccgttaggttacccgtttttaacgtcggttacccggtaacccgtttccgttaccggtacggtacgttaccgggaccgttacgggtaccggttccggttaacgggttttccggttacgggttacccgggtaccggggtaaccgggtaacccgacgtaaccggttacgggtaaccccgttaggtacccggtaccgaccggtacccgaccggtccgttacccccgcccgtttaccggacccgttaccctttcgtcccccggttacccccg

SEQ ID NO: 36271 - DNA, 948 bp, Homo sapiens
  misc_feature: GYAE6OF01CT0LA.48.56.F01.1.454.CMB.1.raw
  modified_base (209)..(209): a, c, t, g, unknown or other
  misc_feature (209)..(209): n is a, c, g, or t
  modified_base (262)..(262): a, c, t, g, unknown or other
  misc_feature (262)..(262): n is a, c, g, or t
tcagagtatacatacacgaccggtgctcgatttagcagacgtctgaacacacaaagggggtagctcaggaagcagagcctggagcatctccactatggcctggactccactactttctcaccctcctcgctcacctgcactaggttcttgggcctaacttttaaactgactcagccccactccgtgtcgggtctcggggaagacggtancatcacctgaccaccgcaccgagtcggcactattcgccagcctaactttggtnacgtaggttcggggtaccaaggccgtaacggccccgggcccccgggggttccccgtttacccccccggaccccgttaacctttacggttaaaaccttaattaacggttacggaacgggtaaccttaacgtttaaccggaaaaccggttaccccggtttttccggtccgggggtttcccccctttaccgttaccgttaacgtttccgttcccgttacgggtcccttacccgtaatcccgggaacctaccgggttccccctaaccgtaaccccgtccccgtcccccttcccttactttccgtaacctttccgttacttacggtaacccgttaaggtaaaccgggtaaccgtacggggaaacgggtacccggtacggttctttaccggttttacctttttaccggtcgtttacccgttaccgttaccccgtttaggttcgggtacgttacgggtcccggtaacgggtcccggttaacggtttacgggttttccggttcccggggttttaccggggaaccggggtacccggggtaaaccctacggttaacccggttcccgggttaaccggtttccgggtacccgttaacccggacccgggtaaacccggtaccggttccccgttacccccggtccccggtttacccggacccgtttacccgtttcccgtttaccccggttaacccccccg

SEQ ID NO: 36272 - DNA, 790 bp, Homo sapiens
  misc_feature: GYAE6OF01AXVIP.48.56.F01.1.454.CMB.1.raw
  modified_base (121)..(121): a, c, t, g, unknown or other
  misc_feature (121)..(121): n is a, c, g, or t
  modified_base (167)..(167): a, c, t, g, unknown or other
  misc_feature (167)..(167): n is a, c, g, or t
  modified_base (237)..(237): a, c, t, g, unknown or other
  misc_feature (237)..(237): n is a, c, g, or t
  modified_base (660)..(660): a, c, t, g, unknown or other
  misc_feature (660)..(660): n is a, c, g, or t
tcagagtatacatacacgaccggtgctcgatttagcagacgtctgaacacacaaagggggtggtagctcaggaagcagagcctggagcatctccactatgggcctggactccactacttcncaccctcctcgctcactgcacaggttcttgggcctacttttaaacngactcacgcccacgtccggtggcgggtcgtacgggggaacgtacggtaagcatcgacctgaccgacccgnaccaggtcggcgaacagttcgaccgaacgtctaaacgtttggtacgcagggttacgggtccaggccacgggcccggtcccggggtccccgtttaccccccgacgaccgttattaaacgtagttaacggtacggaacgggtaacctacgttttaaccgaaaaccggttacccgtttttccgggttccggggtaacccccttccgttccggtttaattcccttacggtccgggttccttaacgaccgtacggtaccgtacgggttacccctaaccgttaaccggttccccctcccgtttacccctttctacctacttcccggttaacttacgtaacgtcgtaaacgtacgtacgggacggaacggacgtcgtattaccgttactttacggactcgtacctttacgtcgtacgtacgtacgggacnccggtactcggtttacggttcggtaggttccggacgggttaccgggaacctcgtacgcgttaaacggtcgacggtacctaccgacggtacccggtcttacccgggtcccaccgggtccttcccggtaccg

SEQ ID NO: 36273 - DNA, 790 bp, Homo sapiens
  misc_feature: GYAE6OF01DA4IV.48.56.F01.1.454.CMB.1.raw
  modified_base (75)..(75): a, c, t, g, unknown or other
  misc_feature (75)..(75): n is a, c, g, or t
tcagagtatacatacacgaccggtgctcgatttagcagacgtctgaacacacgaaaagggggtagctcaggaagnagagcctggagcatctccactatggcctggactccactacttctcaccctctcgctcactgcacgtaggttcgttcgggccttaacttttaaaactgtacctcgaccgcccctactccgtcggtccggggtaccgtccggggaaagacggtagactctccacctcggccacccgccgaccgtggtcgacgtactacgtcgccagtacctaagtttcggtgcgtacggtcggtaccgacgccggaccggcccgggccccgggtccccgttacccccgaccgtacgttacgttaaacgtacgttacgtaacggaacggtaactaacgttaacgtaaaaaccggtcccgtttttcgggtcccgggtttccccgttaccctttacggtaacctttccgttaccggtcggtccttaccgtcgtaaccgtaccgtaccgttaccctacccgtaacccgtccccgtccccttacccttctccttacttctacgtactaacgtaacgaacgtacgtaggacggtacggtacggtcgttacgttacgttttcgtcgtccgttaccgttccgtcgttacggtacggtcgcgtacgtcgtacgtaggttcgttcgggtcgggtacggtacgtaccgacgtaccgtcgtacggttacgcgtacgaccggtacccggaccgtcccgcccgtccccgtaccgtcctaccgttcccgtcccgttaccccg

SEQ ID NO: 36274 - DNA, 692 bp, Homo sapiens
  misc_feature: GYAE6OF01AOIEP.48.56.F01.1.454.CMB.1.raw
  modified_base (545)..(545): a, c, t, g, unknown or other
  misc_feature (545)..(545): n is a, c, g, or t
tcagagtatacatacacgaccggtgctcgatttagcagacgtctgaacacacaaatggggtggtagctcaggaagcagagcctggagcatctccactatggcctggactccactacttctccaccctcctcgctcactgcacgagttcttgggcctacttttaaactgactcacgccccactccgtggtcgggtctccggggaagtacggtaagcatcacctgccacccgcaacccgtggtcggacactagttcgaccgagtacctaacgtttgtcgacgtacggtcggggtaccaaggcgtacggccggtccccgggtcccgttccccccgactaccgtgttaaactagtacgtcgaacggtactataaccggtaacgtacccgtttcgtccggggttccctaaccgttcgttaccgtttaccttcgtacggtcctaccctagtaccgacgtaaccggtcctaaccgaaccgttcccgcccttaccttctctacgtctcgttacgaacgttacgaactacggtacgacggtacgtacgtccgtnttaccgtttaagttctacgtaccgtcgtccttcgtacgtagttcggacgcgtaccgtcgtacgttgttccgtcggacggcgacctacgactcggtacgttacggtcgtacgtaccgacgtacgccctacgcccgttacgtcctaccg

SEQ ID NO: 36275 - DNA, 717 bp, Homo sapiens
  misc_feature: GYAE6OF01C5DKB.48.56.F01.1.454.CMB.1.raw
  modified_base (88)..(88): a, c, t, g, unknown or other
  misc_feature (88)..(88): n is a, c, g, or t
  modified_base (166)..(166): a, c, t, g, unknown or other
  misc_feature (166)..(166): n is a, c, g, or t
tcagagtatacatacacgaccggtgctcgatttagcagacgtctgaacacgacaaagggggtggtagctcaggaagcagagcctggancatctccactatcggcctggactccactactctcacctctcgctcactgcacaggttctgggacctaacttttaaacngtactcaacgtccccaccttccggtggtccggggttacgccgggaagaccggttaagcctatcccactcgaccacccggactaccgaaggtcggaccaatattcgaccgaggacttaaacgtttgacggtacaggtcggtccgaagaccgaggcccggcccgggtcccgttccccgaccactaggtaactattagacggacggtaactacttaacaaaacggtccttggtaccggtccctactacgtacttcgtcttacggcttccgattacgaccgtaacggtccctacccgtaaaccgtcccggtcctccccgttacgttacctaactcgtacgttacgaacttagaacgaccgtaggacggacggtacgacgttacgacttttaaggtaccttaggtaccttaacggtccgttaactaggtacgtacgaccgtacggaacgtccggtaagtttccgtaccggttacggacggaacggtacccaagttccgacgttaacgttaatccgacgacgtcgaaccgtccttacggccctccgatccggtaacc

SEQ ID NO: 36276 - DNA, 944 bp, Homo sapiens
  misc_feature: GYAE6OF01DHMJL.48.56.F01.1.454.CMB.1.raw
  modified_base (179)..(179): a, c, t, g, unknown or other
  misc_feature (179)..(179): n is a, c, g, or t
  modified_base (306)..(306): a, c, t, g, unknown or other
  misc_feature (306)..(306): n is a, c, g, or t
tcagagtatacatacacgaccggtgctcgatttagcagacgtctgaacacacaaagggggtggtagctcaggaagcagagcctggagcatcctaccactatggcctggactccactacttctccaccctcctcgctcactgcacgtacggtttcgttcgggaccttaaacttttaaacncgtacctcaccgccccacgtccgtggtccggggtcgtaccgggggaagacggtaagctacgtccacctgaccacccgacaccgaggtcgggacgactagttcgaccgaacgtacttaaccgttttgngaccggtaacgggttcgggtacccgaggaccgaccgggtcccggggtcccccgggggttaccccggtttcccccccggaacctaaccggttaacgttaaacgttaacgtttaacggtacgggaacgggtaacttaacgtttaaaccgaaaccggttcccgtttaccgggtcccggggtttcccccttaccggttaccgtacgtttcccttacggtccggtacccttaccgtacgttacccggaccgtaccggttacccctaacccgtaaccccttccccgtcccctttcccttacctttaccgtaccgttacttaccgtaacgtaacgttaggaaacggtacgtacggggacgggtaaccggtacggtacctttacgttacccgttttagttaccgttcgtaccggttacccgttccgttacgtacgtacgggtacaccgggtggtaccccggttagttaccgggtttcgggtaccgggttaccggggacccggggaccgtaaaccccgtaccgttaacgggttacccggttaacccgttcgggggttacccgaccgtaccccggggttaacccgtacccggtacccggttacccccggttcccccggttcggtcccgttttcccggttaccccccgg

SEQ ID NO: 36277 - DNA, 803 bp, Homo sapiens
  misc_feature: GYAE6OF01B3M0G.48.56.F01.1.454.CMB.1.raw
tcagagtatacatacacgaccggtgctcgatttagcagacgtctgaacacacaaagggggtggtagctcaggaagcagagcctggagcattctccactatggcctggactccactacttctcaccctcctcgctcactgcacgtaggttcgttcgggcctaactttttaaaactgacctcacgccccactccggtggtcgggtccgtaccggggaagacggtaagcatccacctgcccacccgcaccgagtggcactatcgccagctaacttgtgcgtaggtcggccagccgagcccggccccggggtccccgttacccccgccctacgtacgttaaatagtacgtaggaacggacctaacgtttaacgaaaaccgttcccgttttccggtccgggttcccctcgtaccgtactttccgtcgtacggtccctaccgtacgtacccggaccgtaccggttccccctaaaccctaacccgttcccccgtccccgttacccccttttctttaccctacgtttacccttacgttacgtaaccggttaacgtaacggtacccgttaaggggaaccggacgggtaacgtccgtttacgtttaccggttttactcggttaccgttaccggttcccttacggtacgtacgtccggtacgtaccggtcggtccgttacggtttccgttcgggtaccggggacgtacccgggaacctaccgtacggttaccgttaccggttacggtccgaaaccggtccgtaccggaccgttcccgtcccgtcccgttggtcccctcgtttacccgtcccccg

SEQ ID NO: 36278 - DNA, 755 bp, Homo sapiens
  misc_feature: GYAE6OF01B673Z.48.56.F01.1.454.CMB.1.raw
  modified_base (166)..(166): a, c, t, g, unknown or other
  misc_feature (166)..(166): n is a, c, g, or t
  modified_base (612)..(612): a, c, t, g, unknown or other
  misc_feature (612)..(612): n is a, c, g, or t
  modified_base (694)..(694): a, c, t, g, unknown or other
  misc_feature (694)..(694): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcactaggttcttgggacctaacttttaaacngactcacgcccctacgtccggtcggtcggggtccgtaccggggaagacggtaagcactccacctcgccacccgcaccgaggtcggacgactattcgccaagtacctaacgtttgtgcgtaggttcggtaccagccacggcccggtccccgggtacccgttcccccgactacgtacgtaatactagtacgacggtactattaaccgtaaacgtccgtttacggtccgggttaccccttcgttacgtacttccgtacgtccgtaccgtcgtaacgtacccgtacggtacccggttccctaacccggtaaccgttccccgttacccttcccttacccttactacgttccttacgtacgaaccgtagtaaacgcgtacgggaaggacgtacggtcgttacttacctttacgccgttacgtacgttcccgtgtacggtagtccggtaacgngtacgttacgttcggttacgtcggtaccgggacggtaccggaccctacgtcgttaccgttacgaccggttcgaccggtaacnccggtaaccggtcccgtcccgtcccggttacctacgtacccgttcccgtcccgttaccccg

SEQ ID NO: 36279 - DNA, 514 bp, Homo sapiens
  misc_feature: GYAE6OF02JG7VB.48.56.F01.1.454.CMB.1.raw
  modified_base (508)..(508): a, c, t, g, unknown or other
  misc_feature (508)..(508): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgactgagactgagacgaggctgctttactgtcagtcctctgatggcagcgctagttgtcttcgggcggaggaccacactgaccgtagtcggtcagcccagctcgcccctcggtcactctnttcccc

SEQ ID NO: 36280 - DNA, 529 bp, Homo sapiens
  misc_feature: GYAE6OF02I6O89.48.56.F01.1.454.CMB.1.raw
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggtcgttcccccgccactgtaatatatgaggacattcaaagaccttctggggtccctcctcgattctctggctccatcgacaggtcctccaactccgcctccctcttcatctctgactgaagactgaggacgaggctgcttttactgtcagtcctctgatggcagcgcagttgtcttcgggcggacgggaccacacgtgaccgttatcggtcacgcccgaggcctcgcccctcggtccaccttctcgttcccccg

SEQ ID NO: 36281 - DNA, 623 bp, Homo sapiens
  misc_feature: GYAE6OF02IAU25.48.56.F01.1.454.CMB.1.raw
  modified_base (165)..(165): a, c, t, g, unknown or other
  misc_feature (165)..(165): n is a, c, g, or t
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (323)..(323): a, c, t, g, unknown or other
  misc_feature (323)..(323): n is a, c, g, or t
tcagagtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaacngactcagccccactccgtgtcgggtctccggggaagacggtaagcatcacctgcaccgnaccagtggcgacattgcagcaactttgngcagtgggtccagcagcgccccgggcgttcccccgcactgtaactatatgacggcattcaaagtccttcgngggtccctctcgatctctggcctcatcgacaggtcctcaactccgcctccctacttcatccgtctgaactgaacgactgacggacgtaggctgtcttaagttactgttacacgttcctctacgtagttcggactacgccgtacgtacgtttcgttccggttcggaccgggtacgggtaaccctacgtaaccgttacggtaaccccgggttttatcccgggttaccgtaacccgtacccgggtaaaccggttcccgttacccggtccccccggtttcggttacccgtaacccgtttcccgg

SEQ ID NO: 36282 - DNA, 521 bp, Homo sapiens
  misc_feature: GYAE6OF02G153Y.48.56.F01.1.454.CMB.1.raw
  modified_base (430)..(430): a, c, t, g, unknown or other
  misc_feature (430)..(430): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaacttttgtgcagtgggtccagcagcgcccgggccgttcccccgcactgtaatatatgaggacattcaaagaccttctggggtccctctcgattctctggctccatcgacaggtcctccaactccgcctccctcttcatctctgaactgaagactgaggacgaggctgcttttactgtcagtcctntgatggcagcgcagttgtcgttcggcggagggaccacgactgaccgttagtcggtcacgccaaggctcgccctcggtcactctcgttcccc

SEQ ID NO: 36283 - DNA, 542 bp, Homo sapiens
  misc_feature: GYAE6OF02F5WR8.48.56.F01.1.454.CMB.1.raw
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaactatatgaggacattcaaagaccttctggggtccctcctcgattctctggctccatcgacaggtcctccaactccgcctccctcttcatctctgactgaagactgaggacgaggctgtcttttactgtcagtcctctgatggcagcgctagttgtcgttcgggcggaggaccacactgtaccgttagtcggtacacggacccgaaggtcctaccgccccgtcggtccacgttccgtcgttaccccc

SEQ ID NO: 36284 - DNA, 570 bp, Homo sapiens
  misc_feature: GYAE6OF02IENVI.48.56.F01.1.454.CMB.1.raw
  modified_base (251)..(251): a, c, t, g, unknown or other
  misc_feature (251)..(251): n is a, c, g, or t
  modified_base (411)..(411): a, c, t, g, unknown or other
  misc_feature (411)..(411): n is a, c, g, or t
  modified_base (445)..(445): a, c, t, g, unknown or other
  misc_feature (445)..(445): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggagacggtaagcatcacctgcacccgcaccagtggcgacattgccagcaactttgngcagtgggtccagcagcgcccgggccgttcccccgccactgtaatatatgaggacattcaaagacctttcgtcggggtcccctcctcgattctctcggctccatcgacaggtcctcaactccgcctccctcttcatctctgaactgaagactgaggacgnggctcgtcttttactgtcagtcctcgtgatggcngcgcgtagttcgtcgttcggcgggagggacccacgtccgtacggtaaccgttacgtccggtacacggacccgaacggcccgtaccggcccccgttcggtccctaccgtcccttccgttacccccg

SEQ ID NO: 36285 - DNA, 591 bp, Homo sapiens
  misc_feature: GYAE6OF02GS58I.48.56.F01.1.454.CMB.1.raw
  modified_base (223)..(223): a, c, t, g, unknown or other
  misc_feature (223)..(223): n is a, c, g, or t
  modified_base (406)..(406): a, c, t, g, unknown or other
  misc_feature (406)..(406): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgnaccagtggcgacattgccagcaactttgcgcagtgggtccagcagcgcccgggccgttcccccggccactcgtaatatatgaggacattcaaagacctttcgtcggggtccctcctcgtacttctctggctccatcgacacggtcctacaacctccgccctccctctcatctctgactgaacnctggaggaccgaggctagtcttttacgtgttacgtacgttccctcgtgacgttggcacggcgctaggttgttcgttcgggacggacggacccacgctcgtaccgttacgtcgggtaccacggacccgaacggtccgtacccggtccccgttaccggtcctaccgttccgttaccgttaccccccg

SEQ ID NO: 36286 - DNA, 543 bp, Homo sapiens
  misc_feature: GYAE6OF02FK03B.48.56.F01.1.454.CMB.1.raw
  modified_base (254)..(254): a, c, t, g, unknown or other
  misc_feature (254)..(254): n is a, c, g, or t
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggcctacttttaaactgactcagccccactccgtgtcggggtctccggggaagacggtaagcatcacctgcacccgcaccagtggcgacattgccagctaactttgngcagtgggtccagcagcgccccgggccgttcccccgccactgtaatatatgaggacattcaaagaccttctggggtccctctcgattctctggctcatcgacngtcctccaactccgcctccctcttcatctctgaactgaanactgaggcgagctgtcttttacngttcagttccctntgatggcagcgtcagtttgtcgttcgggcggacggaccacacgtcgaaccgttgtcggtcacgtcccgaaggccgtccgccccgtcggtccaccttcgtccgttaccccc

SEQ ID NO: 36287 - DNA, 541 bp, Homo sapiens
  misc_feature: GYAE6OF02IMTJ5.48.56.F01.1.454.CMB.1.raw
  modified_base (437)..(437): a, c, t, g, unknown or other
  misc_feature (437)..(437): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagccttcgtggggtccctctcgattctctggctccatcgacacggtcctccaactccgcctccctcttcatctctgactgaagactgagacgagctgtctttactgtctagtcctctgatggcngcgctgttcgtcgttcggcggacggccacacgtcgaccgttacgtcggtcacggccctaacggcctccggtcccccgtcggtccacgttccgtccgttcccccg

SEQ ID NO: 36288 - DNA, 604 bp, Homo sapiens
  misc_feature: GYAE6OF02FUX0N.48.56.F01.1.454.CMB.1.raw
  modified_base (251)..(251): a, c, t, g, unknown or other
  misc_feature (251)..(251): n is a, c, g, or t
  modified_base (360)..(360): a, c, t, g, unknown or other
  misc_feature (360)..(360): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcgggtctccggggaagacggtaagcatcacctgcacccgcaccagtggcgacattgccagcaactttgngcagtgggtccagcagcgcccggccgttccccgccactgtaatatatgaggacattacaaagtccttcgtcggggtcctccgtcgacttctctcggcctccatccgacncggtccctaccaacctcccgccttcccctcttcacttcctctacgtaactgaaacgctagacggacgaggtcttcggtccttttacgtgttccagttcctcgtgagtcggctacgcggtactacgtttcgttcgttcgggcggtacgggaccacgtacgtcgtaccgttagtccggtacacggtaccccgaggtcccgtaccggtcccccgttcgggttacctaccttccgtccgttcccccgg

SEQ ID NO: 36289 - DNA, 546 bp, Homo sapiens
  misc_feature: GYAE6OF02I4D5V.48.56.F01.1.454.CMB.1.raw
tcagagtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggagacggtaagcatcacctgcacccgcaccagtggcgacattgccagcaactttgtgcagtgggtccagcagcgccccgggcccgttcccccgccactgtaatatatgaggacattcaaagtaccttcgtcggggtcccctcctcgtattctctcggcctccatcgacaggtccctcaacctccgcctccctcttcactctctcgtaactgaagctgaggacgagctgcttattactgtcacgttcctctgatggcacgcgcgtgttcgttcgtcggcggacggaccacgtacgtcgtacgttactcggtcaccgccgaggcctaccgccccgtcggtcctacttccg

SEQ ID NO: 36290 - DNA, 685 bp, Homo sapiens
  misc_feature: GYAE6OF02GU48A.48.56.F01.1.454.CMB.1.raw
  modified_base (254)..(254): a, c, t, g, unknown or other
  misc_feature (254)..(254): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcaccccgcaccagtggcgacattgccagcaacttttgngcagtggtccagcagcgcccggccgttcccccgcactgtaactatatgaggtacattacaaagtccttcgtcggggtccctccgtcgattctctggcctcatcgacgtacgtcctaccaacctccgcctccctcttcattcctctacgaactcgaacgtacgtggacgggtacggacggtccgttagttcccgtttttaacgtcggttaccgtacggtttaccccttcgttacggtaacgtttccgggacgtaacggccggttaccgttacgggttttcggttaccggtttccggggaaccggggtaaccgggtaacccgtacccgtaccgttaccggttaccggttaacgttccggtacgtaccggtacccgaacggtccgtaccccgtaccccgtccggtaccctaccgttccgttaccgttccccccg

SEQ ID NO: 36291 - DNA, 554 bp, Homo sapiens
  misc_feature: GYAE6OF02IB2TJ.48.56.F01.1.454.CMB.1.raw
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgccaccgcaccagtggcgacattgccagcaactttgtgcagtgggtccagcagccgcccgggcccgttcccccgccactgtaatatatgaggacattcaaagaccttctggggtccctcctcgattctctggctccatcgacaggtcctccaactccgcctccctcttcatctctgactgaacgactgaggacgaggctgtcttttacgtgttcagttcctcgttgatgggcagccgcgtacgttgttcgttcgggcgggacggaccacgacgtgaccgttagtccggtcacggcccgaaggccgtcgccccgtcggtccacgttccgttcgtaccccc

SEQ ID NO: 36292 - DNA, 600 bp, Homo sapiens
  misc_feature: GYAE6OF02GQ3H8.48.56.F01.1.454.CMB.1.raw
  modified_base (253)..(253): a, c, t, g, unknown or other
  misc_feature (253)..(253): n is a, c, g, or t
  modified_base (442)..(442): a, c, t, g, unknown or other
  misc_feature (442)..(442): n is a, c, g, or t
  modified_base (463)..(463): a, c, t, g, unknown or other
  misc_feature (463)..(463): n is a, c, g, or t
  modified_base (537)..(537): a, c, t, g, unknown or other
  misc_feature (537)..(537): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcgcccgcaccagtggcgacattgccagcaacttttgngcagtgggtccagcagccgcccgggccgttccccccgccactgtaactatatgaggacatttcaaagacctttcgtcggggtccctcctcgtattctctggctccagtcgactacggtcctcccaactcccgcctcccttcttcatcctctcgaactgaagactaggaggacgaggctgtctttttacngttcagttcctctgatcggcncgcgtcgaggtttcgtacgtttcgggcgggtacgggaccaacgtaccgtcgtaacccgtttagtccggttaccncggacccgtacgggccgttcccggacccccgttccggtccgaccgttccgtccgtttcccccg

SEQ ID NO: 36293 - DNA, 689 bp, Homo sapiens
  misc_feature: GYAE6OF02JE1GO.48.56.F01.1.454.CMB.1.raw
  modified_base (206)..(206): a, c, t, g, unknown or other
  misc_feature (206)..(206): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggcacttttaaactgactcagccccactccgtgtcggggtctccggggaagacggtaancatcacctgccacccgcaccagtggcgaacattgccagctaactttgtagcagtgggtccagcagccgccgggcccttcccccgcactgaatactagtggagactattacaaagaccttcgtcgggtcccctacctcgattctcgtggcctccatcgactacggtcctaccaacctcccgacccttcccttcgttacctacttcctactacgtaactacgaaaacgtactaggtaacgggaccgtaacggtcttacgggttaccttttttaacgtcgttacctacggttcccttacgtacggtaatccgggaactacggccgtaccgttaggtttcgttcgggttacccggggtacggggaacgggtaacccacgtaccgtacggtaaccgtttacggccggttaacgaccggtacccgtaaacggtcccgcccggttacccccggttccggtacctaccggttccgttccgttaccccccgg

SEQ ID NO: 36294 - DNA, 620 bp, Homo sapiens
  misc_feature: GYAE6OF02FR68P.48.56.F01.1.454.CMB.1.raw
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccactttttaaactgactcagccccactccgtgtcggggtctccggggaagacggtaagcatcacctgcacccgcaccagtggcacattgccagctaactttgngcagtgggtccagcagcgcccgggccgttcccccgcactgtaatatangaggacattcaaagccttgtcggggtcccctcgtcgacttctctcggctccactcgacacggtccctccaacctccgacccttccctcttcactcctctgtaactgaacacgtgtacggacggaggtctagtcttttactgttcacggttcctacgtgtacgtggcaggcgtcctaaggtttccgttcgttccggggcggtacgggacctacgtaccgtacggtaccgttacggtcggtaccgacggtccccgtaacggtccgttacccggtcccccgtttaccgggacctaccggttcccgtccggtttacccccccg

SEQ ID NO: 36295 - DNA, 842 bp, Homo sapiens
  misc_feature: GYAE6OF02G8VKP.48.56.F01.1.454.CMB.1.raw
  modified_base (163)..(163): a, c, t, g, unknown or other
  misc_feature (163)..(163): n is a, c, g, or t
  modified_base (233)..(233): a, c, t, g, unknown or other
  misc_feature (233)..(233): n is a, c, g, or t
tcagagtatacatacacgaccggtgctcgatttagcagacgtctgaacacacaaagggggtgtagctcaggaagcagagcctggagcatctccactatggcctggactccactacttctcaccctctcgctcactgcacaggttctgggcctaacttttaacngactcacgccccactccgtggtcggggtctaccggggaagacggtaagcatcacctgccacccgcaccgngtcggcgactattcgccaggtacctaacgtttgcgccgtaggtcgggttccaggcctaacggccggcccccgggggtccccgtccccccgaccgacttaggtaaactacgtagtcggaacggtacctaattaccgaaacgtacccgtttcggtaccggggtccctccgtacgtacttcgtcgtcggcctaccgattcggacgtacggttccctaccgtacctcccgtacccctcccgttcttaccgtacttccgtaccgtacgtaaccgtacggtaacgtacggttggaaacgggtaccggacggtcgtttacgggtaacctttacgttaccgttcggtaccttaccgttaccgttcgttaacgggtcgttacgggtaaccgtcgggtacccgttacggttacgggttttccgggttacccggtaccggggtaccggggaaccggttaacccgtacgtaccgggttttaacccgggtaacccggttttacccggtaaaccgggttcccggaaacccgggttaccccgggttaacgggttcccccggttaaccccggtttacccccccgggtttccggttaaccccgttacccggttttaaccccccggg

SEQ ID NO: 36296 - DNA, 647 bp, Homo sapiens
  misc_feature: GYAE6OF02IB42P.48.56.F01.1.454.CMB.1.raw
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
tcagagtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgccacccgcaccagtggcgacattcgccagcaactttgtgcagtgggtccagcagcgccccgggcccgttcccccgccactgtaatntatggacggacattacaaagtaccttcgtcggggtccctcctcgacttctctggactccntcgactacggtccctccaacctcccgtcccttcccttccttcacttccgttctagtaactgaacgactaggacggacggaggccttgtactttacttactcgtactacgttcctcgtagagtcggactcgcgtctacggtttcgttccgttcgggacgggtacgggaccctacgtaaccgttcggtaaccggtttacgtacccgggtaccgaaccggtacccgtaaccgggtccgtccccgtccccccggtttacccgggttcccgtacccgtttcccccgg

SEQ ID NO: 36297 - DNA, 849 bp, Homo sapiens
  misc_feature: GYAE6OF02HUFYK.48.56.F01.1.454.CMB.1.raw
  modified_base (297)..(297): a, c, t, g, unknown or other
  misc_feature (297)..(297): n is a, c, g, or t
tcagagtatacatacacgaccggtgctcgatttagcagacgtctgaacacacaaagggggtagctcaggaagcagagcctggagcatctccactatggcctggactccactactctcacctcctcgctcactgcacaggttcttgggcctacttttaaactgactcgacgcccccactccggtcggtcggggtccgtacgggggaagacggtaacgctacgtcacctgcacccgcaccgagtcggcgactagttcgaccagacctaacgtttgtacggacgtacgggtcgggtaccncggacgacggccggccccggggtcccgttccccccgcctacgacggttaatactagtcggacgactacgtacgtaaacgtaccgttcggccggggttccctacccttcggtaaccgtttctaccgtcggttcctaccgttacgtaccggtaccgtaccgggttaccccgtttaccccgtaaaccgtcccgttacccttccccgtttaccttacttacctccgtttaccttacgggtaacttaacggtaacgtacggttacggacccgggaaacggaccggtttcgttacgtttacgtttttaccggtacggttaccgttaccgttaccgtacgtttccggagggtttcgaaccggacggtccggttaccggttggtttacccggttcccgggttaccgggttaaccgggggaacctaaaccggaccgttaaccgtacccgggtttaccggtttaacgtcccggttacgaacccggtacccggtaacggttcccccacggtttccccccggtcttacccggttactttccccgggttacccctttaacccccc

SEQ ID NO: 36298 - DNA, 823 bp, Homo sapiens
  misc_feature: GYAE6OF02HCHMY.48.56.F01.1.454.CMB.1.raw
  modified_base (165)..(165): a, c, t, g, unknown or other
  misc_feature (165)..(165): n is a, c, g, or t
tcagagtatacatacacgaccggtgctcgatttagcagacgtctgaacacgacaaagggggtagctcaggaagcaggagcctggagcatctccactatggcctggactccactacttctcaccctcctcgctcactgcacaggttcttgggcctacttttaaacngactcacgccccactccgtggtccgggggtcctaccgggggaagacgggtaagcagtccgacctgccaccccgcaaccgagtcgggacgacagttcgcccgaagtcctaaactttggtacgaccgtaggttcgggggtacccaaggtaccgacggcccggacccccggggggtcccccgtttaccccccccggaccctaccgttacggttaaacgtaacgttaacgttacggaacgggtactaacgttacaaacggtacccgtttacggtccgggggttccctccgtacggtactttccgtccgtcgggtcctaccgtacgtaccggtacgtaccggttccctacccaaccgttcccggtacccttcccttaccttacacttcctccttacgtaacctacgacggtactcgggaacggacggtacggtctcggttacttttacgtcgttaccgtacgttcctgtacgacgtcggtaccgcgtccgtcgttaggtttccgttcgggttacgggacgggtaccggtaacccgttaccgtacggttccgggtaaccgtttaccggtccggggtacccaaccggggtacccgaacggtcccggttaccccggtacccccgggttcggtaaccctcccggttcccttaccccggttccccccg

SEQ ID NO: 36299 - DNA, 759 bp, Homo sapiens
  misc_feature: GYAE6OF02IU58T.48.56.F01.1.454.CMB.1.raw
  modified_base (199)..(199): a, c, t, g, unknown or other
  misc_feature (199)..(199): n is a, c, g, or t
  modified_base (300)..(300): a, c, t, g, unknown or other
  misc_feature (300)..(300): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaanacggtagcatcacctgccaccgcaccagtggcgaacagttgccagcctaactttgtgcaggtggtccagcagccgccgggccgttccccgcactagtaatntagtgaggactattacaaagtaccgttcgtcggggtcccctccgtacgtacgttccttcgtacggctaccgtataccgaccgtacggttccctacctaaccgtcccgtaccgttccccgttacttacctacgttccttaccgtacgtaaaccgtagtaaacgtacgtacggtacgggtacggtaacgggtcgttacgttcctttttaacggtcgttaccgttaccgttacccgttcgttacgggttacgtcgggtacgtacgggacctcggttagttttccgggtaccggtttaccggggaccgggtaacggttaccccgaaccgttaccggtacggttaacccggttttaccggtccgggtacccgtaaccggtaccccgtacgggttacccttccccgggtcccccttaccgggttaaccccgtaccctttaccccggttcccggtttaccccccgg

SEQ ID NO: 36300 - DNA, 649 bp, Homo sapiens
  misc_feature: GYAE6OF02H7T9B.48.56.F01.1.454.CMB.1.raw
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (539)..(539): a, c, t, g, unknown or other
  misc_feature (539)..(539): n is a, c, g, or t
tcagagtatacatacacgaccggtgctcgatttagcagacgtctgaacacacaaagggggtagctcaggaagcagagcctggagcatctccactatggcctggactccactacttctcaccctcctcgctcacctgcactaggttcttgggcctacttttaaactgtactcacgccccactccgtggtcggggtctcggggaagacggtaagcatcacctgccaccccgcacctaggtcggcgaactagttcgccgtaagcctaacgttttggcgacgagggttcgggtccaggccacggccggtccccgggtccccgttcccccggactacgtacgttaatactagtcgaggctattacgaaacgtccttcggtcggtcctcctctnttcgntcgcctcagtctacgcgtcctacctaccgccgtccctccctcgtctactccgtctagtacgtagaactagtcggaacgacggngtctacttntttacgcgtctacgtctgtcgtntcgtcncgcncgttagttcgtcgtaccgggnggaaccgtaacgctacgttccgtacggtacgtacggacccgtcggaacccgtaggtccccgtcccgttacccggtcccggttacctaccgtttccgtacccgttaccccc

SEQ ID NO: 36301 - DNA, 748 bp, Homo sapiens
  misc_feature: GYAE6OF02FMAIW.48.56.F01.1.454.CMB.1.raw
  modified_base (175)..(175): a, c, t, g, unknown or other
  misc_feature (175)..(175): n is a, c, g, or t
  modified_base (740)..(740): a, c, t, g, unknown or other
  misc_feature (740)..(740): n is a, c, g, or t
tcagagtatacatacacgaccggtgctcgatttagcagacgtctgaacacacaaagggggtggtagctcaggaagcagagcctggagcatctccactatggcctggactccactacttctcaccctcctcgctcactgcacaggttcttgggcctactttttaaactgactcacnccccactccgtggtcgggtcgtcggggagacggtaagcatcacctgccacccgcaccgagtcggcgacctattcgccagaccgtaacttttgtcggacgtaggtcggggtacctacgcgtaacggcccggtcccccggggtccccgttccccccgcctaccgttacggttaaataataacgtgacggaactattacgaaacgttccttcggtccgggttccccttccgtacgttatttcctcgttcgccttacacgtccgacgtacggtacccctactaacccgtcccgtcccctccccttcctttactaccgtttcccttacggttaccgtaaaccgtacggaaacgtaccgtaggaacggggtaacgggaaccggtcgttacgttaccttttaacgttacccgtgtttaccgtccggttcccttgttagttacgtcggggtactacggtccgtacgttcggtttcgttccggtcgggtacggggaaccggtaccacgtacggttcgtaccggtatccggtacgaccggtacgacggtccgtcccggttcccgtaccgttaccnccttaccg

SEQ ID NO: 36302 - DNA, 702 bp, Homo sapiens
  misc_feature: GYAE6OF02IRS9O.48.56.F01.1.454.CMB.1.raw
  modified_base (397)..(397): a, c, t, g, unknown or other
  misc_feature (397)..(397): n is a, c, g, or t
tcagagtatacatacacgaccggtgctcgatttagcagacgtctgaacacacaaagggggtagctcaggaagcagagccgtggagcatctccactatggcctggactccactacttctcaccctctcgctcactgccacgtaggttcgttgggcctaccttttaaactgactcacgcccacgtccgtgtcgggtcgtaccgggaagtacggtaagcatcacctagccaccgcaccaggtcgcgatatcgccagctagttgtgcaggtcggtaccagcgtacgccggcccggtcccccgttccccgcctacgtactaattagtactaggagactagttaccgtaaacgtccttacggtccgggttcccctccgttccgactttcgtaccgtcgtcccncgtacgtcaacggtcgttccctaccgaaccgttcctccccgtaccttcctctactacgtacgtacgtaacgtacgtaacgtacgtacgaggtaccggtacgttcgtacgtttactttacgttacgtcctaccgttcgttaccgttagtacgtccggttacgccgtaccgtcgttcgttacgttccggttcgggaccgggtacgaacccgagtacgtaccggttacgttcggtaccgtcgtacccgacggtaccgtcccgtaccgtaccccgttacgtcccgtccgtttaccgtcccttcccccgg

SEQ ID NO: 36303 - DNA, 615 bp, Homo sapiens
  misc_feature: GYAE6OF01D2E39.24.12.B01.1.454.CMB.1.raw
tcagactactatgtcacgaccggtgctcgatttagtagtgtagattcggcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctgtatcaacaacaccagcaaacgcccccaaactcatgtatttatgatgtacagtaatcggccctcgaggggtcttcgtgatcgtcttctctggctccgaggtctggcacgacgtcctccctgaccactctcgtcgggtcctccgaggtctggacggtacgacggtcgtgtacttatttagtgctagttctagtaggaactaagcgagcgtaacgtccgtttccggtcttaccggttacggtaaacggtcggggtaacccgtaacggggttaccctaccccggtttcccgtaccgggttaccaaaccccggtccccgaaaaccggtaccccccaaaccccctagttcccggttaacccg

SEQ ID NO: 36304 - DNA, 712 bp, Homo sapiens
  misc_feature: GYAE6OF01BYSCE.24.12.B01.1.454.CMB.1.raw
tcagactactatgtcacgaccggtgctcgatttagtagtgtagattcggcggggggggtctcaggaggcagcgctctcgggacgtctccaccatggcctgggctctgctattcctcaccctcctcactcagggcacagggtcctcgggcccagtctgccctgactcaacctgcctccgtgtctgggtctccgtggacagtcgatcaccatctcctgcactcgacaaccatcagtcgtaccttgattagtttattaagtttctcttcgtaggtactacaaacaaccaccgaaggacaaaccgcccctaaactctatacgtattatgattgtactagtacgtccggtaccgtggtacgggtcttcgagtacgtccgttcttcgtcggtcgtaccgtcgtacggtcgtacggaactaaccgtccggtcccttaccgtacgtacctagtttcccgtcggtcggcctaccggaggtcggtacggaacgggtacgcggtacgttacgtaacgtttatttcgtacgtacgttacgttaacgaggttacgaaccaaggcctaggtaccgacgttccgggttacccgatttaccggggtaacggtaccggggtaccgggtaaccggttaccggtacccgtacccggttccggtaccgggtaaccggaccccgtaacccgaacccgggtaacccccttaccctcgggttaacccttacccgg

SEQ ID NO: 36305 - DNA, 691 bp, Homo sapiens
  misc_feature: GYAE6OF01EZXK0.24.12.B01.1.454.CMB.1.raw
tcagactactatgtcacgaccggtgctcgatttagtagtgtagattcggcgggggggggtctcaggaggcagcgctctcgggacgtctccaccatggcctgggctctgctattcctcaccctcctcactcagggcacagggtcctgggcccagtctgccctgactcaacctgcctccgtgtcgtgggtcctcctggacagtcgatcaccatcctcctgccactgaccaaaccatcgagtcgtaccttgtattgttttaattaagttttcgtcttcgtggtatacaaaccaacacccgaggaccaaacgacccccaaatcatagtatttatgattgtactagtaacgtccggtcctcggtacgggtcttcgtgtactccgtcttctcgtcggtcctccggtagtcgtacggacctaaccgcccgtcccctcctacgaccctagttccgtcgtcggcctcggacggtcgtacgggacgggtacgacggtcgttacgtaacgtttatttacgttacgtactacgttcgaagtacggaacgtaacgcgacgtccgtacgttccgttaccggtcttacgggttacgggacgggtacgggtaaccggtaccggttcctacccgggttcccgtcgggtaaccctacccggaaccccgtaacccggaccccctaaccccggttcgtcccggttaacccg

SEQ ID NO: 36306 - DNA, 652 bp, Homo sapiens
  misc_feature: GYAE6OF01DRR40.24.12.B01.1.454.CMB.1.raw
tcagactactatgtcacgaccggtgctcgatttagtagtgtagattcggcggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgccaaccatcagtgaccttgattgtttatagttgtctctgtatcaacaacaccaggacaaacgcccccaaactcatagtatttatgtatgtacagtaactccggccctcgacgggtcttcgtgtactcgtcttctcgtcgcctcgacggtcgtcggaccaccgaccggtcccttcccgtacgaccctacttccgttaccgtcgggtccctaccggacgggtccgtaggaacgggaccggaggtccgttagtaacttagtttacgttcggacttaggttacagtacggaactaacggcgacgctacgtcccgttccggccttacggtaccgggacggtaccgggaaccgtaacgggttccctacccgggttccgtaccgggtaccgacccggtaaccccgaacccggacccccaaccccgtccgttccgtacccc

SEQ ID NO: 36307 - DNA, 663 bp, Homo sapiens
  misc_feature: GYAE6OF01DCHQ6.24.12.B01.1.454.CMB.1.raw
  modified_base (249)..(249): a, c, t, g, unknown or other
  misc_feature (249)..(249): n is a, c, g, or t
tcagactactatgtcacgaccggtgctcgatttagtagtgtagattcggcggggggggtctcaggaggcagcgctctcgggacgtctccaccatggcctgggctctgctattcctcaccctcctcactcagggcacgagggtcctgggcccagtctgccctgactcaacctgcctcgtgtctggtctctggacagtcgatcacatctcctgcactgcaaccatcagtcgacttgattgtttatagtttntctctaggtactacaacaaccaccgaggacaaaccgacccctaaatcctatagtaatttagtagtattgtacaagttaacgtccggcccgttacggacggggtccttacgtgtactcgtccttctcgtcgcctcgtaggtctggacaacgtccggtcctcctacgacctacgtcgtcgtcggtacctccggaggtccgtaggacggaacgggtcgtacttaggtactttagtttacgttcggtacttacgttacgtacggtaacggaacgtacggacgtacggccgtacgttcccggtaccgtcgttaaccggtacgggtaacggtacgggaacccgttacggtacccgtaccggttccggtacggtaccaacccggtacccgaacggaccccctaaccgtacttcggtaaccc

SEQ ID NO: 36308 - DNA, 741 bp, Homo sapiens
  misc_feature: GYAE6OF01CK3OF.24.12.B01.1.454.CMB.1.raw
  modified_base (214)..(214): a, c, t, g, unknown or other
  misc_feature (214)..(214): n is a, c, g, or t
tcagactactatgtcacgaccggtgctcgatttagtagtgtagattcggcgggggggggtctcaggaggcagcgctctcgggacgtctccaccatggcctgggctctgctattcctcaccctcctcactcagggcacgagggtcctgggcccagtctcgcccgtgactcaactgtcctccgtgtcgtgggtctccgtggactgtcgatcaccgntctcctgccactgccaacatcaagtcgtaccttgtagttagtttattaagtttcgtcctcgtgtactacaacaaccgaccaggaccaaacgaccccaatacacgtagtatttacagtaatcgtactaaggtaacgttccgaccgtacgggcgggttcttcgtagtgttaccgtcttcgtcgtcggtaacctcggtacggttaccgacggaacgtaccggtaccggtaacccgtcgtaacgaccgtacgtccggtttacggcggtaccccgttacggaacgtcccggtaggacggttaaccgggttaccctagtttaacgttcgttaccgttaggtacgttaccgtttaagcgggtaaacgacggaaaccgcggttaaccgcggttaacgttccccgggtacggtaccgtttaacgggttaccgaagggtacccggaaacgggttacccggtaacccttcggggaaccccttacgggactaaccccggaccgtaaccggtacccgtaacccgtacgtcccggtaaccc

SEQ ID NO: 36309 - DNA, 680 bp, Homo sapiens
  misc_feature: GYAE6OF01BEXQC.24.12.B01.1.454.CMB.1.raw
tcagactactatgtcacgaccggtgctcgatttagtagtgtagattcggcgggggggtctcaggaggcagcgctctcgggacgtctccaccatggcctgggctctgctattcctcaccctcctcactcagggcacagggtcctgggcccagtctgccctgactcaacctgcctccgtgtctgggtctccgtggacagtcgatcaccatctcctgcactgcaaccatcagtcgacttgattgtttatagtttgtctcgtgtatcaacaacaccaggacaaacgccccaaactcatgtatttatgtatgtactaagtaacgtccggtcccgtacggacggggtacttcgacggtacttccgtctttctcgtcggtcctcggtacggtctaggaccgaaccgacggtcccttcccgtacgacctacgttcctcggtcggcctaccggagggccctagggaccggacggtacggtcgtaagtacgtttaaatttcgttacgctacggtttaccgaagtcgtaaccgaagacccaggtccgtacgttcccggtcccggttacgttcggttaacggggaccggtaacggggtaacccgtaacggttacccggtacccggttccgtaccggtaccgaaccgggtaccccgaacggaccccctaaaccccggtagttcccggtaaccc

SEQ ID NO: 36310 - DNA, 768 bp, Homo sapiens
  misc_feature: GYAE6OF01DV432.24.12.B01.1.454.CMB.1.raw
  modified_base (554)..(554): a, c, t, g, unknown or other
  misc_feature (554)..(554): n is a, c, g, or t
  modified_base (568)..(568): a, c, t, g, unknown or other
  misc_feature (568)..(568): n is a, c, g, or t
  modified_base (651)..(651): a, c, t, g, unknown or other
  misc_feature (651)..(651): n is a, c, g, or t
  modified_base (755)..(755): a, c, t, g, unknown or other
  misc_feature (755)..(755): n is a, c, g, or t
  modified_base (758)..(758): a, c, t, g, unknown or other
  misc_feature (758)..(758): n is a, c, g, or t
tcagactactatgtcacgaccggtgctcgatttagtagtgtagattcggcgggggggggtctcgagggaggcagcgctcgtcgggacgtctccaccatggcctgggctctgctattcctcaccctcctcactcgagggcacgagggtctcgggcccagtctcgccctagacctacaaccgtcgcctccgtggtccgtggggtcctccgtaggaccgaggtcgaactccgaacctacttccgtccctagacctaacgtgaaccaaaccaggttccgaaggttccgtaaccgtttagtaaagtttaggtttttaaacgtttaaggtttccgttccttaccggttaggttaacaaaccaaaacaaaccgaaccgaacgggaaacctaaaccccggaaccccctaaaataccttaagtagtttaaattacgtaggtacttaggtacgtaaacggtaaccggttcccggacccgtagggaacgggttaccttaggcgtacgtccttaccgttgttccaggtcctacgtgtacgacggactaaccgcccgtactccgganaactcgtcgtcggnggtaccctgggtagacgtagggaccgggaagacgtatacgtacttaaaggttctagacggttactaggatacgaataacgggnactacggtaccgtcgtaccgtacgttacgggtaaggaccggtaacggaacggtccggtacctacggtcccgtacggaaccacccgtaacccggaccaaaccccncgngtccctacgg

SEQ ID NO: 36311 - DNA, 788 bp, Homo sapiens
  misc_feature: GYAE6OF01DJVEI.24.12.B01.1.454.CMB.1.raw
tcagactactatgtcacgaccggtgctcgatttagtagtgtagattcggcgggggggggtctcaggaggcagcgctcgtcgggacgtctccaccatggcctgggctctgctattcctcaccctcctcactcagggcacgagggtcctgggcccagtctcgccctgacctcaacctgcctcgtgtctggtctccgtggactagtcgatcaccatcctcctgacactcgaccaaccatcagtcgtacctttgtatttaggttttaattaaggttttcgttccgttccgttagttactaacaaaaccaaaccgaacccgaaggaaccaaaacctaaccccctaaactactaacgttagttaaacgtttagagtacgttagttacgaaacgttaaccgtccggtaccctacgggtacgggttccttagtgtacttccgtcttcgttacgtcggacctcgtagtcgtacggacgaaccctcccggaccttccctacacctcgtaccgtccggtcggccgttcgacggtacgtaggaacgggtcggaacgtactacgttaacgttaagtttagttacgtacgtaaggttacgaacggtacggaacgaaaccggtacggaacgtacgtaccggttcccgttaccggttacgttaaccggttaaccggggttaaacgggtacccgggtaaacccgtaaccggttacccggtaccccggttaccggttacccggtaaccgaacccggtaaacccgaaccccgggtaaccctaaaccccgtccgtaccgttaaccccg

SEQ ID NO: 36312 - DNA, 790 bp, Homo sapiens
  misc_feature: GYAE6OF01EQMHU.24.12.B01.1.454.CMB.1.raw
tcagactactatgtcacgaccggtgctcgatttagtagtgtagattcggcgggggggggtctcaggaggcagcgctctcgggacgtctccaccatggcctgggctctgctattcctcaccctcctcactcagggcacagggtcctgggcccagtctgccctgactcaacctgcctccgtgtctgggtctccgtggacagtcgatcaccatcctcctgcactgacaaccatcagtcgaccttgattagtttataagtttcgtcttccgtggtactacaactaacaccgagacaaaccgaccccaaactcaatgtatttatagatgtacgaagtaacgtccggtaccctcggtacggggtctttacgtcgtacgttccgttaccgtttccgttcgttcggggtaccttacccggtacgggtttaccggtaccgggtaaccgtaaacccggacccgggtcccccgttaccccgttaccgggtaaaccctacgtttccggttaccggtccgggtccgtaccggtacgggtcgtaagggacgggtaacggtacgggtcttacggtaacttagtttacgttcggtacgttacggtactacggtaacgaactaacggacctacggaccgttacggtccgttcccggttaccgttacgggttaccgggaaacgggttaccggggaaccgttaacccggggtacccgttaccccgggtttcccggtaaccggtacccgaacccgggtaaccccgaaacccggttaccccccgaaaccccgtttgtaccgttaacccccg

SEQ ID NO: 36313 - DNA, 919 bp, Homo sapiens
  misc_feature: GYAE6OF01CSP51.24.12.B01.1.454.CMB.1.raw
tcagactactatgtcacgaccggtgctcgatttagtagtgtagattcggcggggggggtctcaggaggcagcgctctcgggacgtctccaccagtggcctgggctctgctattcctcacccttcctcactcagggcacagggtcctgggccagtctgccctgacctcaacctgcccttccgtgtcgtgggtctcctggacagtcgatccaccatctccgtagcactgaccaaacctagtcaagtcgtacctttaggatttagtttaacgtttaaggtttcgttcctaccgtttagggtaacttacaaaaaccgtaaaccaacccgaagggaacccaaaaacggaccccccctaaaataccgtaattacggtttaaagtttattaggtaattacggttaaccaagttaaccggtaccggtacccccgtttaggaaccggggtcttttaaccgtcggaacttccggttaacgtttcctacggttcgtaccgtcccggtaaagggtccgttaccggaaccgtaaacccgacccggggtacccctttacccgtacggaaaccgtacctttccgaccgggttaacgggcccgtttccggaaacgggttcgttacggaaacggggtaacccggaagggtacccgttaggtaacctttaaggtttaaacggtttcggtaacccgtaaggtttaccaagggtttaaaccggggaacctaaaccgggtactagggaaacccggtttcggtaaccccggttccccggttcgggttaacccgggttttaaacggggaaaccggggtttaacggggaaacccgtacccgggggttaaaactccccgggttaaccggttccggggttaacccaaccggggtaccccccaaaacggggaccccctaaaccccgtcggttaacccgtaaccccg

SEQ ID NO: 36314 - DNA, 744 bp, Homo sapiens
  misc_feature: GYAE6OF01CQ34G.24.12.B01.1.454.CMB.1.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (349)..(349): a, c, t, g, unknown or other
  misc_feature (349)..(349): n is a, c, g, or t
  modified_base (441)..(441): a, c, t, g, unknown or other
  misc_feature (441)..(441): n is a, c, g, or t
  modified_base (593)..(593): a, c, t, g, unknown or other
  misc_feature (593)..(593): n is a, c, g, or t
  modified_base (602)..(602): a, c, t, g, unknown or other
  misc_feature (602)..(602): n is a, c, g, or t
tcagactactatgtcacgaccggtgctcgatttagtagtgtagattcggcgggggggggtctcaggaggcagcgctcgtcgggacgtctccaccatggcctgggctctgctacttcctcacccctcctcactcgacgggcacgacggggtccgtgggccccagtctcgccctgacctccaaccgtcgcctcgtgtcgtgggtctccgtggactggtcactcacctntcctcctgctactcgaccaaccntacgaggtcgtacttgtatttagtttattagtttcgtcctacgtagtactaccaaaccaaccaccgagtaccaacccgacccctaagtcatagtcttagntatgactaacgttacgcccgtccgagggtcggttctacgctacgttccgtctttacgcgttcgaccgttacggtcggtcgtaccggaaaccncccccgttacggtcccccttacgaaccgtccgttccgttaccggtgggtcccgggttaccgacggtacggggactaagggaacgggtaacgtcgggttaacaacgtttaacgtttaacgttcggttactcgttaacgtaagtaccggtaaanacgggtacnccgttacaccgttcggtaccggtcgtaaccggttcggtagggtaacccggacgtaacccgtacggtccccgtacgttcccgggtaacggccccgaaccggtaacccccgaccgttacccccgaccgttgacccgttaccccg

SEQ ID NO: 36315 - DNA, 717 bp, Homo sapiens
  misc_feature: GYAE6OF01ERPBT.24.12.B01.1.454.CMB.1.raw
  modified_base (394)..(394): a, c, t, g, unknown or other
  misc_feature (394)..(394): n is a, c, g, or t
tcagactactatgtcacgaccggtgctcgatttagtagtgtagattcggcgggggggggtctcaggaggcagcgctctcgggacgtctccaccatggcctgggctctgctattcctcaccctcctcactcagggcacaggggtcctgggcccagtctgccctgactcaacctgcctcgtgtcgtgggtctccgtggacaggtcgatccaccattcctcctgccacgtcgaccaaccatcgagttcgtaccttgtatttagttttaagttaaggttttcgtcttccgttaggtactaccaaaccaaccaacccgaggaaccaaaccgaccccccaaatactatagtaattttatgtatggtacaagtaacgtccggtccgtcggtagggtcttcngtactcgtcttcgtcgtcggcctcgtacggttcacgacaccgaccggtccctccgtacgacctactcgtacggtccggtacgtcccggtagggttacggacggtaacgggtacggacggtctacggttaacttaacgtttcgttcggtactaggttaccgaaggtaacggacaaggccgtagtacgtccggttaccgtaccggtccgtttacggaccggggttaggtaccgggtacccggtaacgttcccggtaccggttcccgttaccgggaccgtaacccgggtacccaaccggaacccccaacccgtcgtcgtaaccccg

SEQ ID NO: 36316 - DNA, 830 bp, Homo sapiens
  misc_feature: GYAE6OF01E2V6R.24.12.B01.1.454.CMB.1.raw
tcagactactatgtcacgaccggtgctcgatttagtagtgtagattcggcgggggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatccacatctctgcactgacaaccatcagtcgaccttgattgtttatagtttgtctctggtatacaacgaaccaccaggaccaacgaccccaatccataggtaactttatacgattcgtacgtaagtaacgtcccggtaccctacggtaacggggtctttacgtcggtacttaccgtcgttccgtacgtcggtaccgttaccgtacggttaccggtcggaaccgtaaaccggtacccgggtacccttaccccgttaaccgggaacccttaaccgttccggttaccggttaccggggttaccctacccgggtaacgggtccggttaagggaacgggtaacccggggtacgggacgttacgtaaaccgttttacgtttaaacgttcggtaacgttacggtttaacgaacggtaggtaaaccgaaggtaccacggtactaaccgggttcccgttacccgggtaccgtttaccggttaacggggtaaccggttaaccggggtaaaccgtaacccggggttaccccgtaacccgggtttcccggttaccccggtacccggaaaccccgggttaaacccccggaacccgggtaaacccccgttaaccccggtaaacccgttccggggttaaccccc

SEQ ID NO: 36317 - DNA, 922 bp, Homo sapiens
  misc_feature: GYAE6OF01DUXJ7.24.12.B01.1.454.CMB.1.raw
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
tcagactactatgtcacgaccggtgctcgatttagtagtgtagattcggcgggggggggtctcaggaggcagcgctctcgggacgtctccaccatggcctgggctctgctattccctcaccctcctcactcgagggcacgagggtcctgggcccagtctgccctgactcaacctcgcctcgtgtcgtcgggttctccgtggactacggtcgactccaacctactcctcctgacctactcgaaccaacctntacaagtctaccttgtattagtttattagtttntccttcgtgtactaccaacaacctaccgaagaaccaaccgacccctaaatctattagtatttagtagtacttacgtaactaacggttaaccgtcccggacccgtggtaccgggttcttacgatccgttcgtccttacgtcgtcggtacgtcgtacggtcgtacgacctaccgtacccgtcctcccgtactacctcgtaccgttcggtaccggtccgaccgtacggtacggtaagggacccgggtacggtacgacgtttaacgtacgtttaacgttcgttaacgtacgttaacgttacgtaacgggtacctaaacggtacggtaaccggtaccggttacgtaccccggtttacccgggtttaaccccgggtttaacgggtttaccccggggggtttaaaaccggggttaaaacccgggggtacccgggtttaaaaacccccgggggtaccggggttttacccccccgggttaaaccccggggttacccccgggggtttaaaacccgggtttaaccccccccgggtaaacccggggggtaaaccccccgtttacccccgggggggtttaaccccccccccggttccccccgggggttttaacccccccggttaacccccgggtttttaaaccccccccggg

SEQ ID NO: 36318 - DNA, 804 bp, Homo sapiens
  misc_feature: GYAE6OF01DVSCH.24.12.B01.1.454.CMB.1.raw
  modified_base (243)..(243): a, c, t, g, unknown or other
  misc_feature (243)..(243): n is a, c, g, or t
  modified_base (678)..(678): a, c, t, g, unknown or other
  misc_feature (678)..(678): n is a, c, g, or t
  modified_base (752)..(752): a, c, t, g, unknown or other
  misc_feature (752)..(752): n is a, c, g, or t
tcagactactatgtcacgaccggtgctcgatttagtagtgtagattcggcgggggggggtctcaggaggcagcgctcgtcgggacgtctccaccatggcctgggctctgctattcctcaccctcctcactcgagggcacgaggggtcctcgggccctagtctcgccctgacctcaacctcgcctcgtgtcgtgggtcctcgtggacagtcactcacctactcctctgctacgtcaccaaaccntacgacgttacgtaccttaggtattttacgttttaagttaacggttttcgttccttacgtggttaacacctaaaaccaaccgaaccggacggaaacccaaaccccgtaaaccccccgtaactactaacgtttagtttaacgtttagtagttaacttacgtacgttaacgtaccggtccgtcccggttacgggacgggttcctttcggtaacgtcgttccgttcgtttccgtcggtcggtccgttaccggtaggtccgtacggtaacccgaacccgtcccggtaccccttacggtacctacgttacctccggtcccgggttacggtcccggtcggtacgggtcgggtaagggaaccgggcgttacggccgtttaaacgtagttttacgttacggccgttaacgtacgttaacgtacggaacgaacaggcccgtaanccggttaccgttccggtacggttccgtaccggggtagaccgggttacgtaaaccggtccggacgtttaccccgngttccccggagacccccgaaccggtacccgacctacccgggtatccgtcccc

SEQ ID NO: 36319 - DNA, 685 bp, Homo sapiens
  misc_feature: GYAE6OF01CK9WA.24.12.B01.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (670)..(670): a, c, t, g, unknown or other
  misc_feature (670)..(670): n is a, c, g, or t
tcagactactatgtcacgaccggtgctcgatttagtagtgtagattcggcgggggggggtctcagggaggcagcgctcgtcggggacgtctccaccatggcctgggctctgctattcctccaccctcctcactcgagggcacaggggtcctgggcccagtctcgcctgactcaacctgcctcgtgtcgtggtctcgtggactgcgatcacatctctgcnctgacctaacntcagtcgtacttagtattagtttacttagttcgtcttacgtagtactacaaactaaccgaccgaacggaaccaaacccgacccctaagtctacttagttattatcggtatacgtacgtaacgtacgtccggacctagggtacggtcttacgtcgtacttccgtacttcgtcgtacggtctcggtcgtcgacgaacctaccgtccgtccgtcgtaccgtactacggtccgtcggtacgtcctaggacgtacgaggacggggtactcgggtacttacgtaactttagtttcagtacggtaccttagggacgtacgactaagccgtagcttaccgggtccttacgggacttaccggggtacggacggttaaccgggactttaaccggtccgtcccggttaggacccgtacccaaccgggtccccgaaaccacccgtttacccnggtacccctacccgg

SEQ ID NO: 36320 - DNA, 885 bp, Homo sapiens
  misc_feature: GYAE6OF01A5GJE.24.12.B01.1.454.CMB.1.raw
  modified_base (215)..(215): a, c, t, g, unknown or other
  misc_feature (215)..(215): n is a, c, g, or t
  modified_base (238)..(238): a, c, t, g, unknown or other
  misc_feature (238)..(238): n is a, c, g, or t
tcagactactatgtcacgaccggtgctcgatttagtagtgtagattcggcggggggggtctcaggaggcagcgctctcgggacgtctccaccatggcctgggctctgctattcctccaccctcctcactcgagggcacgaggggtcctgggcccagtctgccctgactcaacctgcctccgtgtctgggtctcgtggactagtcgactcaacctntcctccgtgcactgaccaacctntacgacgtctaccgttgtatttggtttaattacgtttgtccttccgttaggtacctaacaaaacctaacgaacccgacggaacctaaacccggacccctaaactactaacggttattaaccgttttaagtgtaacgttacggtacgtaaacggtaccggtacccggtccgtacgggtacggttccgttagttcgtaacttccggttacttccgtacggtccggtactccggtaacgtcggtccgtaaaccgtaccgtcccggttacctacccgtacgtacccgttacgttacccggttccgtccgggtacctacccggtacggtacggtcgggtaaacggtaccggtaacgtccgggttacttaacgttacgtttacgtacggttacgtacgttaaccgggtaacgtaaccggaacgttaacggacgtaacccggtacggttaaccgttaaccgggttccccggttacggtttaaccccgggttaagggtaacccggggtaaccggttaaaacccgggtcccgggtttaaccccgttaaccccgggtacccgggttacccgtaaccggttaacccccggaaacccgttaacccccggtaaaccccccggttaaaccggttcccggttaaaacccccgtttccccggg

SEQ ID NO: 36321 - DNA, 774 bp, Homo sapiens
  misc_feature: GYAE6OF01CZFH4.24.12.B01.1.454.CMB.1.raw
  modified_base (566)..(566): a, c, t, g, unknown or other
  misc_feature (566)..(566): n is a, c, g, or t
tcagactactatgtcacgaccggtgctcgatttagtagtgtagattcggcgggggggggtctcaggaggcagcgctctcgggactctccaccatggcctgggctctgctattcctccacccctcctcactcgagggcacgagggtccgtcgggcccagtctcgccctgactccaacctcgccctcgtcgtcgtgggtctccgtggacacgtcgatccacctactcctcctgacacgtcgacctaaccctatacgtagtacgtacctttagtatttagtttaagttaacgtttcggtaccttacgtagttaacaccaaaaccgtaacccgaacccgaacggaaccaaaaccccgaaccccctaaactactagttacggtaatttacgatagttcgtaacgtaactacgtcccggtaccgtagggtacggtacctcgtagtacgttccgtcgttcgtcgtccgtccgttaccgtagttccggacgtaacccaccggtacccgtccctaccgtacgtacctctacggtcgtccggtaccaggtacggtacgtagggaggtaacccggtntagtacttagtttactagtcggtacctagtaaccgtagggaactacgaacggcctaccgtacggtacccgttccggtccggttaacgttaacccggggtaggtaaccggggtaccgtaaacccggtcccggttaaccggttccccgacggtacccggacccgaaaccgtacccccggaaacctcccctaaccggtcgtccttaccccg

SEQ ID NO: 36322 - DNA, 659 bp, Homo sapiens
  misc_feature: GYAE6OF01CP2U5.24.12.B01.1.454.CMB.1.raw
  modified_base (89)..(89): a, c, t, g, unknown or other
  misc_feature (89)..(89): n is a, c, g, or t
  modified_base (126)..(126): a, c, t, g, unknown or other
  misc_feature (126)..(126): n is a, c, g, or t
  modified_base (160)..(160): a, c, t, g, unknown or other
  misc_feature (160)..(160): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (648)..(648): a, c, t, g, unknown or other
  misc_feature (648)..(648): n is a, c, g, or t
tcagactactatgtcacgaccggtgctcgatttagtagtgtagattcggcgggggggggtctcaggaggcagcgctcgtcgggacgtcnccaccatggcctgggctctgctattctccaccctccncactcgagggcacgagggtcctagggcccagtcncgcctagacctacaacctgcctccgtgtcgtgggtcctcgtaggacngtcgactcacntcgtacngcacgnaacctaacngtcgatcacttagatttacggttattaggttctcgtacgtagtaactacaaacaaccgaccgacggtaaccaaaccacccctaaacgtataagtgttaacttanagtatcgtaataacgttaaccnccgggtacctagggtacggttcttacgtcgtacgttcctcgttcgtaacggttccaccggttaccgagtccggtacgaaccgttaacgcccggtccacgttaacgctacgttccgcgtacgcgacgacggtacaggaacggacacggtacgtatactaagtgtacctagtatacgaagtacgaatcgaagtcgacgtacgtcgtacgtaccgtactaaggggattaaccggactacggtacccgaccgttgccggaacaccgaccgggactaacccggaacngtaacgtaccg

SEQ ID NO: 36323 - DNA, 725 bp, Homo sapiens
  misc_feature: GYAE6OF01AL9LB.24.12.B01.1.454.CMB.1.raw
  modified_base (152)..(152): a, c, t, g, unknown or other
  misc_feature (152)..(152): n is a, c, g, or t
  modified_base (156)..(156): a, c, t, g, unknown or other
  misc_feature (156)..(156): n is a, c, g, or t
  modified_base (169)..(169): a, c, t, g, unknown or other
  misc_feature (169)..(169): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (716)..(716): a, c, t, g, unknown or other
  misc_feature (716)..(716): n is a, c, g, or t
tcagactactatgtcacgaccggtgctcgatttagtagtgtagattcggcggggggggtctcaggaggcagcgctctcgggacgtctccaccatggcctgggctctgctattcctcaccctcctcactcgaggcacgtgggtcctcgggccngtcncgcctgctcactnccgtcgtgtctggtctcctggtactgtcgactcaccgtntcctcgtgaccctacgtcgaccaaactntacgtgtacgtaccttgttactttagttttaagttagttcgtcttaccgtagtacaccgaacaaccgtaccgacgaccgaaaccgtcccgtaaactcgtactacgttaagttacgtacgagttacgtaacgtaaccggttaccgtccggtaaccgtcgggtacgttaccgttcgtaaggtccgttccgttacgtttccgtccggtttcggtacccggttaccgtacggtccgtaaccggtaaccctaaccccgggttccctacccgtacccggtacgtaccttaccggttccgtcccggttaccggtaccgtcggtaccgtcggttaagggaacgggttcggtacgtacgtttaactactttacgttaacgcgtaacgtcgtactacggagacggtcaagcgtacgtcgtaccgtcgtccgttacggacgagtaccgcgtaccgtctcggccgtacgaccgacgtacccgaccaccgtcncgtctaccg

SEQ ID NO: 36324 - DNA, 858 bp, Homo sapiens
  misc_feature: GYAE6OF01BQLEN.24.12.B01.1.454.CMB.1.raw
tcagactactatgtcacgaccggtgctcgatttagtagtgtagattcggcgggggggggtctcagggaggcagcgctcgtcgggacgtctccaccatggcctgggctctgctattcctccaccctcctcactcgagggcacgacggggtccgtcggggccccaggtcctcgcccctgacctccaacctgcctccgtgtcgtggtcctcgtggacagtcactcactactcctccgtgactactcgaccaaacccatccacggttacgtaccttagtatttagttttaagttacgtttccgttccttccgttaggttaacctaaccaaaacccaaccgaacccgtaacggaaccccgaaaaccccgaaccccctaaactctaaagttagttaattagtagtacgttacgttactaacggttaaccggcccggtacccgtacgggtacgggttcgtttcgtacgttaccgtcgttccgttaccgttcggtcccggtaccggttaccggtccgggtacgtaccggaacccgtaacccggtcccggtccccttacccgtaccgtacctccgtttccgtccgggttccggcccgtaccggacgggtaccggtagggtaaccggaccggtacgtacgttaacgttaacgtttcgtttaagtcgtaacgtttacgtaacgacggtaacgaacaacggtccgaacgttacggtacccggttcccgtaccggtaccggttaacgggtacgggtacggtaacccgggtaacctaccccggggtttacctacccggtacccgggtacccggtacccgaaacccccggtaaccgtaccccccggaaaccctaccgttccgtccgttacccg

SEQ ID NO: 36325 - DNA, 733 bp, Homo sapiens
  misc_feature: GYAE6OF01B8M8R.24.12.B01.1.454.CMB.1.raw
  modified_base (154)..(154): a, c, t, g, unknown or other
  misc_feature (154)..(154): n is a, c, g, or t
  modified_base (210)..(210): a, c, t, g, unknown or other
  misc_feature (210)..(210): n is a, c, g, or t
tcagactactatgtcacgaccggtgctcgatttagtagtgtagattcggcgggggggggtctcaggaggcagcgctctcgggacgtctccaccatggcctgggctctgctattcctccaccctcctcactcagggcacgagggtcctgggcccngtctgccctgactcacctcgcctccgtgtctgggcctccgtggacagtcgatcacntcctcctgctactcgaccaaccatcacggtcgtaaccttgtattagtttattaagtttcgtacttccgtggttaactacgaaaccaaccacccgaagaccgaaaccgacccccaactacatagtattagtatagtgtactaagtacgtccgtccgtacggacgggtcttcgtcgtacgtccgtctttcgtcgttccgtactccggtacggtccgtacggtaccaacccgtcccgtaccccttcccgtacgtaccgtaccttccgtaccggttcggtccctacggtacggcgtacggaacgggtcggaacgtcgtacggttacttaacgttgttccgtacgtaacgttacgtaggaacgtaacagaccgtacgtacgtcggttaccgttccggtaccttacggggttcggaaacggggttaccgtaacccggtaccgggtacccgttaccccggtaccggacccgggtacccgaacccgtacccgtaaacccggaccccctaaacccgttacggcccgttaccg

SEQ ID NO: 36326 - DNA, 907 bp, Homo sapiens
  misc_feature: GYAE6OF01B6UHB.24.12.B01.1.454.CMB.1.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
tcagactactatgtcacgaccggtgctcgatttagtagtgtagattcggcggggggggtctcaggaggcagcgctctcgggacgtctccaccatggcctgggctctgctattcctcacccttcctcactcgagggcacgagggtcctgggcccagtctgccctgactcaacctcgcctccgtgtcgtcgggtcctccgtggactagtcgatccactntcctctgcactcgaccaactntcgagtcgtacttagtcgtttagtttaattagtttcgttaccttccgttaggttaactaccaaaccaacctaacccgaacggaaccaaaccgaaccccctaaactacctaacgttacggtttaattttacgtacgttacgttacgtacgttaacggtaaccgttcccggtaccgtacgggtacggggttccttaggttacgtaccgttccgttacctttcgttaccggtcggtacccgtaccgttcgggttcgtaccggtaacccgtaaaccgtcccggttaccccttccgttaacccgtaccgttaccgttcggtttcccggttaccggggtcccttaccgggtacgggtaccgggtaacgggacggggaacggttacggtacgttaacgttacgtttacgtttacgttacgttacggttacgttacctaacggtacgtaaccgtaacggacgtaccggttacgttcccggtttcccggttacccggttaccgggtttaacccggggttaacggggttaaacccgggtaacccggggttaaccggtaccccgggtttacccggttaaaccccgggtttcccggtaacccgggtaacccggtaaccccgggaaccccggttaaccccggaaacccccgtaccccgttaccggtaccccgtttaacccgg

SEQ ID NO: 36327 - DNA, 769 bp, Homo sapiens
  misc_feature: GYAE6OF01CTZYB.24.12.B01.1.454.CMB.1.raw
  modified_base (141)..(141): a, c, t, g, unknown or other
  misc_feature (141)..(141): n is a, c, g, or t
  modified_base (154)..(154): a, c, t, g, unknown or other
  misc_feature (154)..(154): n is a, c, g, or t
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (591)..(591): a, c, t, g, unknown or other
  misc_feature (591)..(591): n is a, c, g, or t
  modified_base (617)..(617): a, c, t, g, unknown or other
  misc_feature (617)..(617): n is a, c, g, or t
tcagactactatgtcacgaccggtgctcgatttagtagtgtagattcggcggggggggtctcagggaggcagcgctctcgggacgtctccaccatggcctgggctctgctacttcctccaccctcctcactcgaggcacgngggtccgcggccngtctcgccctgactcgacctgcctcgtgtcgtgggtcctaccgnggactaggtcgactacacccagttccgtcctcnccgactccgtaccaaacctatcaaggtcgtaaccttgtattagtttactttacgtttcgtcgttactagggtaacaacctaaaccaaaccgaacccgaacggaaccaaacccgtaaccctaactacgaattaacggtatttacgtaagtacgttacgtaaccgtaacggttaccgtccggtacctacgggtaacgggtccttcggtgtaaccttcccgttcttccgtcgtccgtaccctacggtacgggttaccgaccggaaccctaccggacccgttccccgtaccgaccgacctaacgttcccgcggttaccggtccgtacgtcgggtgtcgggaacgtcgaggtccgttatacgttntactcggtactgtcaagtcgacgtanaacgcgtacgcgtaccgttcgtacggttccgtaggtaccgggtaacgttaacccgtacgggtaccccgtaacgggttcccggtaacccggtcccggtaacccgaacccgggaccccttaaccccgaaacccgttcgttccgttaacccccgg

SEQ ID NO: 36328 - DNA, 685 bp, Homo sapiens
  misc_feature: GYAE6OF02F8V57.24.12.B01.1.454.CMB.1.raw
  modified_base (593)..(593): a, c, t, g, unknown or other
  misc_feature (593)..(593): n is a, c, g, or t
tcagactactatgtcacgaccggtgctcgatttagtagtgtagattacgcgggggggggtctcggaggaggcagcgctacttcgggacggtctccaaccagtggcctgggctctgctacttcctcaaccctcctcactcacgggtcactagggtcctgggcccctaggtctggcccctcgactacgtaacctcgcctccgtagtacgtgggtctcctggacagtcgatcacctatcgtcctggcactcgccaaccatccagtcgaccttgacttggttataacgtttgtcctccggtagtatacaacaacaccgaggaccaaacgccccctaaatcctagtacgtatttagtcgatcgtacacgtaatccggccgtacgtacgggtcttcgtggacgtcggtacttctactggtcctaccgtacggtctacggactaacgaccggtaccctaccgtacgacctactcctcgtcgggtacctccggaggtctacggaagggtacgacggtactacggtaactttagttacgttacgacgtaacgttaccgaacgttcggaacgtaaccgcgagaccgtacgtcctttacccggnttacggtacggtaacgtcgggaaccgtaacggtccgtaccggtccttacggtacgacggacccggaacggcccccaacccgtagtcgtaccc

SEQ ID NO: 36329 - DNA, 641 bp, Homo sapiens
  misc_feature: GYAE6OF02I8TCF.24.12.B01.1.454.CMB.1.raw
  modified_base (406)..(406): a, c, t, g, unknown or other
  misc_feature (406)..(406): n is a, c, g, or t
  modified_base (424)..(424): a, c, t, g, unknown or other
  misc_feature (424)..(424): n is a, c, g, or t
tcagactactatgtcacgaccggtgctcgatttagtagtgtagattcggcgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatccaccatcctcctgcactgcaaccatcagtcgaccttgattgttataggtttgtctcctgtatcaacaacaccagaccaaacgcccccaaactcatgatttatgtatgtacagttaatccggcctcgacgggtcttctgtatccgtctttccgtcttggtcctccgtaggtcgtcggacacgaccgccctacccgtcgaaccnctcctcgtcggtctccgnggctggacggaacgtcgcgtcgtaattattagttacgcgttacgtcgagtacggaactaacggacgagtacctaccggtcgtttaccccggtattaccggttaacggggtacggttccggggaacccgtaacgggttccctaaccccggggttcgtacccgggttacgacccggtaacccgaacccggacccctaacccccgtagtacccgttaccc

SEQ ID NO: 36330 - DNA, 1103 bp, Homo sapiens
  misc_feature: GYAE6OF02G8HKG.24.12.B01.1.454.CMB.1.raw
tcagactactatgtcacgaccggtgctcgatttagtagtgtagatttcggtcggggggggggtctcgagggacggcagcgcgtcttccggggacggttcttccacctagtggcctgggctctgctattcctcacccgtcctcacctcaggggcttacgaggggtcctggggcccctagggtttccttggtcccctggtaacctttaaccggaaccctggcccttccggtggtccgtggggttccttccggtgggacctaggttcggattccgaccctatccttccctggcccgtacgggttccgacaaacccattccgaacggttggtacctttgaactttcggttttaattaacgggttttccgtaccgttcccgttagggttactacccaaaaccgtaaaccaaccccgtagggaccgtaaaaccgggtcccccccgaaaaaccttccgaacgttacgggtaacggtttttaacggtcggttacggttacgggttaccggtaaacggttttaaaccggtttacccggttaccccgttaccgggaacgggggggttacctttttaccggtacggttaaacgttcccgtttaccgttttcccgttacccgttaccggggtaccccgtttacccggttaacgggggttacccgggttaccggggtaaccctaaaccccgggtaaccccgggggtccccctttacccccgttaccgggtaaacccgtaaccgtttccccgtttaacccgggttcgggtaaccccgtttaacccgaaccggggggttcccgtttaagggggttaaccgggtaaccgggtaacgtacccggttacgggtaaacctttacgttttaacggttaccggacgttaccggtttacgtaacggttaccgggaaccgtaacgggtcgtaacggtaccgtacggttcccgtttacccgggtacgttccgggttaacggggtacggggttcccggggaaacccgttaaagggggttaccccttaaccccggggttcccggtttaccggggtccttaacccggggtcccggttaaacccggggacccccgtaaaacccccgggttcgttacccggggttaaccccc

SEQ ID NO: 36331 - DNA, 663 bp, Homo sapiens
  misc_feature: GYAE6OF02I95M6.24.12.B01.1.454.CMB.1.raw
tcagactactatgtcacgaccggtgctcgatttagtagtgtagattcggcgggggggggtctcaggaggcagcgctctcgggacgtctccaccatggcctgggctctgctattcctcaccctcctcactcaggcacagggtcctgggcccagtctcgccctgactcaacctgcctccgtgtctgggtctctggacagtcgatcaccatctcctgcctactcgacaaccatcgaagtcgacctttgacttagtttataagtttcgtctcttgtactacaactaaccaccgagacctaaccgaccctaaactctatacgtattagtagtatcgtacacgtacgtccgtccgtacggacgggtcttcgtagtacgtccgtacttcgtcgtcgtctacgtgtacgtcgacaaccgtccgtcctccgtacgcctacgtaccgtcgtcggtcgtaccgtacgtcgtacggtacgggacggtacggtacgtacgtacgttacgttacgtcgtacgtacgtacgtacgtacgtacgtacgtacgacgtagtaccccccccccgtgtaccgtccgttacgtacggtacggtacggtaccggtaacggtaccggtaccgtaccggtccgtcgaccggaccgtacccgacccgaacccgtaccgtaccgtaccg

SEQ ID NO: 36332 - DNA, 867 bp, Homo sapiens
  misc_feature: GYAE6OF02H2NRF.24.12.B01.1.454.CMB.1.raw
tcagactactatgtcacgaccggtgctcgatttagtagtgtagattcggcggggggggggtctcaggaggcagcgctctcgggacgtctccaccatggcctgggctctgctattcctcaccctcctcactcgagggcacgagggtcctgggcccagtctcgccctgacctcaacctcgcctccggtgtcgtgggtcctccgtggacagtcgatccacatctcctgcactcgaccaaccatcagtcgtaccttgtattagtttaattaagtttcgttccttaccgttggttaactaccaaacctaaaccgacccgtaacgggaacccaaacccgtaccccccaaactacaagttacggttattttagtcgtaagttcgtactaaggtaaccgtcccggtacccgtacggtacggggttcttcgtacggtactccggttacctttccgtcggttacggtcccgtccggtaacggtcgtacggaacccgtaacgcccggttacccctaccgtccgtaacccttacgtccggttccggtacggccgtaccggtacggtacggtacgggacggggtaaccggcggtacgtaacgttaacttaacgtttacgttacgaccgttaggtaccgtaagggtaaccggaaacctaaacggtcgtaaaccggccgttaaccgggtttccccggtcccgtttaccgggtttaccgggttaacgggttaccgggggtacccgggtaaccgggtaaccccgggttaccccggtaccccggtttaacccgggtccccgggttaacccgaacccggggtaacccccgggtaaaccccgtaaccccccgggtaaaccccgttaccgttcccggttaaccccccg

SEQ ID NO: 36333 - DNA, 777 bp, Homo sapiens
  misc_feature: GYAE6OF02HTRSN.24.12.B01.1.454.CMB.1.raw
tcagactactatgtcacgaccggtgctcgatttagtagtgtagattcggcggggggggggtctcaggaggcagcgctctcgggacgtctccaccatggcctgggctctgctattcctcaccctcctcactcagggcacagggtcctgggcccagtctgccctgactcaacctgcctccgtgtctgggtctccgtggacagtcgatcaccatctcctgcatgacaaccatcagtcgaccttgattagtttaagtaagttttgtccttaccgtggttaactacaaacaaccacccgaaggaccaaaccgacccccaaaactcatacgtaatttaatgattaggtactagtaaacgtccggtaccctacgagggggtccttacgtgtactacgtcttcgttcgtcggtactaccggtaggttcgtaggtaccaaaccgtaccggtacccgttcccgtaacggaccctaacgtttaccgttccggtcgggtaccgttacccgggaacggtcggttaacgggaacgggaacgggacgggtacttaaccggtaacgtttaacgtttagttacgtaccgttaagttacgtagtaacgggtaactaaacggtaccgacggaacgttaacggtcccggttccggttaccgtttaaccgggtttaccgggaacggttacggggaaacccgtaacggggtaacccctaccggttaaccggttcccggtaccgacccggttaacccggaaacccggtaacccctaaacccccggtagtaccgtaccccg

SEQ ID NO: 36334 - DNA, 752 bp, Homo sapiens
  misc_feature: GYAE6OF02JO279.24.12.B01.1.454.CMB.1.raw
tcagactactatgtcacgaccggtgctcgatttagtagtgtagatttcgcgggggggggtctcaggaggcagcgctctcgggacgtctccaccatggcctgggctctgctattcctcaccctcctcactcagggcacagggtcctgggcccagtctgccctagactcaacctcgcctcgtgtctgggtctccgtgacagtcgatcaccatcctcgtgcacgtgcaaccatcagtcgtaccgttgattagtttaattacggtttcgtccttccgtaggtactacaactaaccaccgagacctaaaccgacccccaaactcgtacttagtactttacgtagtactgtacgtaagtaacgttccggcccgtacgggtacgggtccttcgtacgcttccggtcctttcgtccgtcgtaccgtaccgtggttcgtaacggtaccgtaaccgacccggtaccctacccgtaccgtaaccgtccgttccgtacggttccgggccctacggtacggtccgtacgggaacgggtaccgtaggtacgttacgttaacgtttaacgtttagttaccgtaccgttacgtaccggttaagtaacccggtaacgaacggtaccgaacggtacgttaaccgtcgttcccggtcgttaacggttaacgggtacggtacgggtaaccgtaccggtacccgtaccggttacccgtcggtaccgtacccgaacccggtaccgaaccccttacccggacgttccgttaaccc

SEQ ID NO: 36335 - DNA, 907 bp, Homo sapiens
  misc_feature: GYAE6OF02FGF7C.24.12.B01.1.454.CMB.1.raw
  modified_base (139)..(139): a, c, t, g, unknown or other
  misc_feature (139)..(139): n is a, c, g, or t
  modified_base (247)..(247): a, c, t, g, unknown or other
  misc_feature (247)..(247): n is a, c, g, or t
tcagactactatgtcacgaccggtgctcgatttagtagtgtagattcggcgggggggggtctcaggaggcagcgctctcgggacgtctccaccagtggcctgggctctgctattcctcacctcctcactcagggcacgngggtcctgggccagtctgccctgactcaaccgtgcctccgtgtactgggttacctcgtcggacagtccgatccacctattccttccagcctccgtcgaccaaaccgtntccaaggtccgtaccgtttagtacgttttacgggttttaataggttttcgtccttccgtaggtactaccaaaccgaaccacccgacggacctaaacccgacccccaacttcacttagtactttactagtacttcgttacgtaacgttacgtcccggttacaacgggtaccggttcgtttacgtacgggtaacttccggtccttttccggtccgtttaccggtaacccgtcggtttaccggacccggacggaaaccgtaaacccgggccccggtttaccctaccccggttaaagtccccgttaactttcccgggtttcggacccggggttaccctaacccggggttacggtaccgttaacggggaacgggaacccgggttacgggtaaccgtttacggtttaaaccgttacgtttttaaaccgttaccgggttaaccgtttaaaccgttacggtaacggttaaacggaacgtaaccggtaccgtaacggttaacggttacccgttaccggttacccggtacgtttttacccgggaaagggttccccggaaaggggttaccctaaccggtaccccggttaaccccggtacccgttacggaccccgtaacccgggaccggaaacccccgtttaccccgaacccgggttacttcccgtacccgg

SEQ ID NO: 36336 - DNA, 804 bp, Homo sapiens
  misc_feature: GYAE6OF02F5KPE.24.12.B01.1.454.CMB.1.raw
  modified_base (107)..(107): a, c, t, g, unknown or other
  misc_feature (107)..(107): n is a, c, g, or t
  modified_base (571)..(571): a, c, t, g, unknown or other
  misc_feature (571)..(571): n is a, c, g, or t
tcagactactatgtcacgaccggtgctcgatttagtagtgtagattcggcgggggggggtctcaggaggcagcgctctcgggacgtctccaccatggcctgggctcngctattcctcaccctctcactcaggtcacagggtcctgggcccagtctgccctgactcaacctgcctccgtgtctagggtctccgtggactaggtcgagtccaaccgtatccgtacctgccaacgttcgaccaaaccattccgagttacgaaccgtttgactttacgtttaaattaacggttttcgtacctttccgttaggtaacttaccgaaaaccgaacctaaccccgtaaggaccaaaaccggtaccccccaaacttcaacgtacgtaaacttttacgtacggtaattcgtaccgtaagttaaccggtcccggacccgttggaccggggttcttaccgtagtaaccgtttccggtactttccgttcgtacgggtccttaccggaggtttcgcgtaaccgtaacccgtaccggccccttccgtacctaaccgtacgttcctacggtcggtaccctaaccggnggtacctacgggaacggtacgggaacgtccgttaacgttaactacgtttagccgtattaacgtccgaagttacggaacaggtaccgtacggacttaccggtcccttacggtacttaccgggttaacggtacgggtacggaacccggttaacggtaccggttacccggtaccgttaccggacccgttacggaacccggtaaacccgtccctaaccccggttcgtaaccttcccg

SEQ ID NO: 36337 - DNA, 501 bp, Homo sapiens
  misc_feature: GYAE6OF01CUW89.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaaacaataaagaacctcttaaattggtaccagcaagaaaccaggacagcctcctaagctgctcgtttactgggcatcaaccgggaatctgggtccctgaccgattcagtggcagcgggtctgagacacatttcactctcaccatcagcagcctgcagctgaagatgtggctagtttatactgtacaacagcattatactactccgtactactttgccgagggaccaagctaggagatcaagcgaactggtgctgcacctatctcgtcttcactccttcccgtacc

SEQ ID NO: 36338 - DNA, 498 bp, Homo sapiens
  misc_feature: GYAE6OF01C7V6Q.14.42.D09.1.454.CMB.1.raw
  modified_base (475)..(475): a, c, t, g, unknown or other
  misc_feature (475)..(475): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgtttactgggcatcaacccgggaatctggggtccctgaccgattcagtggcagcgggtctgagacacatttcactctcaccatcagcagcctgcaggctgaagatgtggctagtttattactgttcaacagcattatactactccgtactactttggccaggggaccagctggagatcaagcgaactgtggctgcaccntctgtcttcactccttcccgtcc

SEQ ID NO: 36339 - DNA, 489 bp, Homo sapiens
  misc_feature: GYAE6OF01BINNH.14.42.D09.1.454.CMB.1.raw
  modified_base (466)..(466): a, c, t, g, unknown or other
  misc_feature (466)..(466): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgttactgggcatcaacccgggaatctggggtccctgaccgattcagtggcagcgggtctgagacacatttcactctcaccatcagcagcctgcaggctgaagatgtggctagtttatactgtcaacagcattatactactccgtacacttttggccagggaccaagctaggagatcaagcgaaactgtgntgcacatctgtctcatctcccgc

SEQ ID NO: 36340 - DNA, 498 bp, Homo sapiens
  misc_feature: GYAE6OF01CR9FA.14.42.D09.1.454.CMB.1.raw
  modified_base (451)..(451): a, c, t, g, unknown or other
  misc_feature (451)..(451): n is a, c, g, or t
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgtttactgggcatcaacccgggaatctgggtccctgaccgattcagtggcagcgggtctgagacacatttcactctcaccatcagcagcctgcaggctgaagatgtggctagtttattactgtcaacagcattatactactccgtactactttggccaggggaccaagctagganatcaagcgaactgtggctgccaccatctntcttnactcttcccgtcc

SEQ ID NO: 36341 - DNA, 514 bp, Homo sapiens
  misc_feature: GYAE6OF01COBXN.14.42.D09.1.454.CMB.1.raw
  modified_base (382)..(382): a, c, t, g, unknown or other
  misc_feature (382)..(382): n is a, c, g, or t
  modified_base (501)..(501): a, c, t, g, unknown or other
  misc_feature (501)..(501): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgtttatacacctccaaacaataagaacctcttaaattggtaccagcaagaaaccaggacagcctcctaagctgctcgttactgggcatcaacccgggaatcgtggggtccctgaccgattcagtggcagcgggtctgagacacatttcactctcaccatcagcagcctgcaggctagaagntgtggtctagtttatactgtacaacagctattatactactccgtactactttcggcctacggggaccaaggctaggagtatacaagcgaactggtcggctgccaccatctcgtcttacnctcctcccgtacc

SEQ ID NO: 36342 - DNA, 512 bp, Homo sapiens
  misc_feature: GYAE6OF01BHX98.14.42.D09.1.454.CMB.1.raw
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaaattggtaccagcaagaaaccaggacagcctcctaagctgcttcgtttactgggcatcaacccgggaatcgtggggtccctgaccgattcagtggcagcgggtctgagacacatttcactctcaccatcagcagcctgcagctagaagtatgtggctagtttattactgtacaacagctattactactactaccgtactacgtttcggaccgaggggtaccaagtcgtaggagatcaagcgaactgtgntgcacntcgtctctactatcctccgtcc

SEQ ID NO: 36343 - DNA, 507 bp, Homo sapiens
  misc_feature: GYAE6OF01A2SDZ.14.42.D09.1.454.CMB.1.raw
  modified_base (208)..(208): a, c, t, g, unknown or other
  misc_feature (208)..(208): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaattggtaccagcagaaaccaggacagcctcctaagctgctcgtttactgggcatcaacccggaatctggggtccctgaccgattcagtggcagcggtctgagacacatttcactctcaccatcagcagcctgcaggctgaagatgtggctagtttatactgtacaacagcattatactactccgtactacgtttggacctaggggaccaagctggagatcaagcgaactggtcggctggccaccgatctgttcttcacttccttcccgtacc

SEQ ID NO: 36344 - DNA, 554 bp, Homo sapiens
  misc_feature: GYAE6OF01C10PJ.14.42.D09.1.454.CMB.1.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (285)..(285): a, c, t, g, unknown or other
  misc_feature (285)..(285): n is a, c, g, or t
  modified_base (334)..(334): a, c, t, g, unknown or other
  misc_feature (334)..(334): n is a, c, g, or t
  modified_base (381)..(381): a, c, t, g, unknown or other
  misc_feature (381)..(381): n is a, c, g, or t
  modified_base (515)..(515): a, c, t, g, unknown or other
  misc_feature (515)..(515): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggacgaggacggccaccaagtcaactgacaagtccagccagagtgtttanacacctcaanaataagaacctnttaaatggaccagacaagaaaccaggacagcctacaagctgctcgttacnggcatcaaccggaatcgtgggtccctgaccgtatcagtgcagcgggtcngagacacatttcactctacaccatcagctagcctgcaggcagaaagngtgtggactagtttaataccgtgtacaacgagactaatttaactaacttactaccgttaactacgttttacgggacccgaaggggtaaccaaaggcgtaaggagaactaccgaaggaccgtaaacgtggtcggntcgacaccctatccttgtacttacacgttcccttccgac

SEQ ID NO: 36345 - DNA, 514 bp, Homo sapiens
  misc_feature: GYAE6OF01DDETA.14.42.D09.1.454.CMB.1.raw
  modified_base (498)..(498): a, c, t, g, unknown or other
  misc_feature (498)..(498): n is a, c, g, or t
tcagcgtctagtaccacgaccggtgctcgatttagacacatacgcaggggcagcaagatggtgttgcagacccaggtcttcatttctctgttgctctggatctctggtgcctacgggggacatcgtgatgacccagtcgccagactccctggctgtgtctctgggcgagagggccaccatcaactgcaagtccagccagagtgtttataccacctccaacaataagaacctcttaaaattggtaccagcagaaaccaggacagcctcctaagctgctcgtttactgggcatcaacccgggaatcgtggggtccctgaccgattcagtggcagcgggtctgagacacatttcactctcaccatcagcagcctgcaggctgaagatgtggctagtttattactgtcaacagcattatactactccgtactacttttggccgtagggaccagccgtaggagatcgtaagcgtaacgtgtggctgcacctatctcgtacttntactccttcccgtacc

SEQ ID NO: 36346 - DNA, 518 bp, Homo sapiens
  misc_feature: GYAE6OF01AJJPR.14.42.D09.1.454.CMB.1.raw
  modified_base (331)..(331): a, c, t, g, unknown or other
  misc_feature (331)..(331): n is a, c, g, or t
  modified_base (481)..(481): a, c, t, g, unknown or other
  misc_feature (481)..(481): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaaataagaacctcttaaattggtaccagcagaaaccaggacagcctctaagctgctgttactggcatcaaccggatcgtgggtccctgaccgattcagtggctaggcgggtntgagacactatttcactctcaccatcagcagcctgcagctgaagatgtggctagtttatacgtgtacaacagctattatacgtactccgtactacgttttcggacccgtagggaccaaggtcctaggactatcaagcgtaacgtgtcggntcggacacgtatcgtacgtcttagcttcgtcccgacc

SEQ ID NO: 36347 - DNA, 523 bp, Homo sapiens
  misc_feature: GYAE6OF01AVCL1.14.42.D09.1.454.CMB.1.raw
  modified_base (511)..(511): a, c, t, g, unknown or other
  misc_feature (511)..(511): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgttactgggcatcaacccgggaatctggggtccctgaccgattcagtggcaggcgggtctgagacacatttcactctcaccatcagccagcctgcaggctgaagatgtggactagttttattacttgtacaacgagactattatactactccgtactacgttttacggccgtacggggaccaaagtcgtaggagatacaagccgaactggtggctgccacctatctcgtcttacncttcctcccgtc

SEQ ID NO: 36348 - DNA, 573 bp, Homo sapiens
  misc_feature: GYAE6OF01C3SUN.14.42.D09.1.454.CMB.1.raw
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgtttanacacctccaacaataagacctacttaaattggtaaccagcaagaaaaccaggacagcctacctaagctgctcgtttacnggcatcaaccggatctgggtccctgaccgnttcagtggcgtagcgggtctgagacactatttcacttctacaccatcagcagcctgcaggctgaagatgtggctagtttattactgtacaactgactattaactaacttacctccttaactaccttttcgggaccgtaaggggacccaaggccttagggagtaattacgaaggtaccgtaacgtcggttacgggacttcggaccctaaccgtacttaccgttcgttaccttactaaccctttcccgtccccgttacg

SEQ ID NO: 36349 - DNA, 498 bp, Homo sapiens
  misc_feature: GYAE6OF01E0KZ8.14.42.D09.1.454.CMB.1.raw
  modified_base (470)..(470): a, c, t, g, unknown or other
  misc_feature (470)..(470): n is a, c, g, or t
  modified_base (486)..(486): a, c, t, g, unknown or other
  misc_feature (486)..(486): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgtttactgggcatcaacccgggaatctggggtccctgaccgattcagtggcagcgggtctgagacacatttcactctcaccatcagcagcctgcaggctgaagatgtgctagtttattactgtcaacagcattatactactccgtactacttttggccgaggggaccaagctaggagatcaagcgaactgtggntgcaccatctgtcttnctcctcccgtcc

SEQ ID NO: 36350 - DNA, 559 bp, Homo sapiens
  misc_feature: GYAE6OF01A36OL.14.42.D09.1.454.CMB.1.raw
  modified_base (381)..(381): a, c, t, g, unknown or other
  misc_feature (381)..(381): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctacctaagctgctcgttactggcatccaacccgggatcgtgggtccctgaccgattcagtggcagcgggtctgagacactatttcactctcaccatcagcagcctgcaggctagaagntgtgctagtttatactagtacaacagactattactactactccgttactacgtttcggaccgtacggggtaaccaacgtcgtaggacgtacgtacgaacgtccgtaacgtggtcggtactacggacctaccgtacttccgttacgttaccgttacctacttcccgttccccggtaccc

SEQ ID NO: 36351 - DNA, 503 bp, Homo sapiens
  misc_feature: GYAE6OF01BL0BU.14.42.D09.1.454.CMB.1.raw
  modified_base (208)..(208): a, c, t, g, unknown or other
  misc_feature (208)..(208): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaattggtaccagcagaaaccaggacagcctcctaagctgctcgttactgggcatcaacccgggatcgtggggtccctgaccgattcagtggcaggcgggtctgagacactatttcactctcaccatcagcagcctgcaggctgaagatgtggctagtttattactgtacaacagctattatactactccgtactactttggccgagggacagcgtaggagatcgaagcgaactgtggctgcaccatctgtcttcacttcctcccgtacc

SEQ ID NO: 36352 - DNA, 546 bp, Homo sapiens
  misc_feature: GYAE6OF01CLQUD.14.42.D09.1.454.CMB.1.raw
  modified_base (383)..(383): a, c, t, g, unknown or other
  misc_feature (383)..(383): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaaacaataagaacctcttaaattggtaccagcagaaaccaggacagcctcctaagctgctcgtttactgggcatcaacccgggaatcgtggggtccctgaccgattcagtggcaggcgggtctgagacacatttcactctcaccatcagcagcctgcaggctgaagntgtggctagtttattactgtacaacagctattactacttactccgtaactacgttttcggaccgtaacggggtaccaagtcgtagggagtacgtacaaggcgaaacgttggtcggtctggcctaccattcgtcgttaccttactacttcccgttccccgtacc

SEQ ID NO: 36353 - DNA, 594 bp, Homo sapiens
  misc_feature: GYAE6OF01CPHZY.14.42.D09.1.454.CMB.1.raw
  modified_base (208)..(208): a, c, t, g, unknown or other
  misc_feature (208)..(208): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctaccaacaataagaacctcttaaaattggtaccagcaagaaaccaggacagcctacctaagctgctcgtttactgggcatcgaacccgggaatcgtcggggtcccctgacccgtattccgagtcggcaggcgggtctgacgacacatttcactctcacatcagcacgcctgacgaggctagaacgagttggtaggtacttaggttttaacttacgtcgtacaacgtagactatttactaacctaccttaccgttacttacgtttcggaccggtaacgggactaagcgttaggagacgtaagacgacgtaacgtggtcggtcgtacggcctacctattccgttacgttacctttacctaccgttccccgttcccccgtaccg

SEQ ID NO: 36354 - DNA, 494 bp, Homo sapiens
  misc_feature: GYAE6OF01E1AGF.14.42.D09.1.454.CMB.1.raw
  modified_base (484)..(484): a, c, t, g, unknown or other
  misc_feature (484)..(484): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgtttactgggcatcaacccgggaatctggggtccctgaccgattcagtggcagcgggtctgagacacatttcactctcaccatcagcagcctgcaggctgaagatgtggctagtttattactgtcaacagcattatactactccgtactacttttggccgaggggaccaagctggagatcaagcgaactgtgctgcaccatctgtctnctctcccgcc

SEQ ID NO: 36355 - DNA, 582 bp, Homo sapiens
  misc_feature: GYAE6OF01BF6GG.14.42.D09.1.454.CMB.1.raw
  modified_base (207)..(207): a, c, t, g, unknown or other
  misc_feature (207)..(207): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgtttanacacctcaacaataagaacctcttaaattggtaccagcaagaaaccaggacagcctcctaagctgctcgttacnggcatcaaccgggatcgtcgggtccctgacctnttcagtggcaggcgggtctgacgacactatttcactctccaaccatcagcagcctgcaggctagaagagtggtgactagtttactactgtacaacgtagctaattaactaccttacgtccttaacttcgtttacggacccggaaggggtaacccaaggtcgtagggaacgtactaccgaaacggtcgaaacgttcgggtacggtccttacgaccctaaccctagttccgttacgttccttacctaccttccccgtttacccccggacc

SEQ ID NO: 36356 - DNA, 589 bp, Homo sapiens
  misc_feature: GYAE6OF01AWMH3.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaaacaataagaacctcttaaattggtaccagcagaaaccaggacagcctcctaagctgctcgtttactgggcatcaacccggaatcgtcggggtccctgaccgattcagtggcagcgggtctgagacactattcactctcaccatcagcagcctgcaggctagaagatggtgactagtttatactgtacaacagctaatttactaccttactaccgtacttacgtttacgggaccgtaacggggtacctaaggtacgtacgggaactacgtacgaacggtaccgtaaacggtcggtcgggtcctacggtaccctaaccgtaacgttccgttcgtttaccttacccgttacctttccccgttacccccgtaccg

SEQ ID NO: 36357 - DNA, 561 bp, Homo sapiens
  misc_feature: GYAE6OF01D6TBC.14.42.D09.1.454.CMB.1.raw
  modified_base (288)..(288): a, c, t, g, unknown or other
  misc_feature (288)..(288): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataacgaacctacttaaattggtaccagcaagaaaccaggacagcctacctaagctgcttcgtttacnggcatcgaacccggatcgtgggtccctgaccgattcgagtggacaggcgggtctaggagactactactttcacttctcaaccatcagcagcctgacaggctagaagatggtgtactagtttaacttactgtacaacgtagactaattactacttacctaccgttactacgttttacggaccgaacgggtaccaacgtcgtaggagactacgaagacgtaacgtcggtcgctcgaccaccgtatactcgttccttactacttccgtcccgtacc

SEQ ID NO: 36358 - DNA, 559 bp, Homo sapiens
  misc_feature: GYAE6OF01DBVZO.14.42.D09.1.454.CMB.1.raw
  modified_base (206)..(206): a, c, t, g, unknown or other
  misc_feature (206)..(206): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagaggccaccatcaactgcaagtccagccagagtgtttanacacctccaaacaataagaacctcttaaaattggtaccagcaagaaaaccaggaacagcctacctaagctgctcgtttactggcatccgaaacccggaatccgtcggggtccctggaccgtattcgagtggcaggcgggtctgagacactatttcactctacacatcagcagcctgcagctagaagagtgtggacttagtttaacttactagtacaacgtagtactattactactacctaccgttacgtacgttttacggaccgtaacgggaccgaagtcgtaggagaactacgaagaccgaacgtcggtcggtctacgccacctatctcgttactctactccttcccgtacc

SEQ ID NO: 36359 - DNA, 689 bp, Homo sapiens
  misc_feature: GYAE6OF01AIPGT.14.42.D09.1.454.CMB.1.raw
  modified_base (208)..(208): a, c, t, g, unknown or other
  misc_feature (208)..(208): n is a, c, g, or t
  modified_base (414)..(414): a, c, t, g, unknown or other
  misc_feature (414)..(414): n is a, c, g, or t
tcagcgtctagtaccacgaccggtgctcgatttagacacatacgcaggggcagcaagatggtgtcgcagacccaggtcttcatttctctgttgctctggatctctggtgcctacggggacatcgtgatgacccagtcgccagactccctggctgtgtctctgggcgagagggccaccatcaactgcaagtccagccagtatgttttanaccaccctccaacaataacgaaccttactttaaattcggtaccagacaacgaaaccgaggacacgcctacctaagctgtcttcgttactgggcactaccgaacccgggatcgtcggggtccctcggaccgtattccgaggtggacgacggtccgggtctaggagacctactatttccaccttcctaccacctatcagcacggtccnggaccgacggtcgtaggaacgtagtgggtcggtacttaagttttacttacgtacgtaccaacgtagtacctaatttaaccgtaacccttaccgttacccgttaacgtttaccgttttaccgggaccggtaacggggtaaccctaaggtaccgttaagggaacgtaacgtaccggtaaacggtacccgtaaggttcggtacggtccgtaccggacccgtaacccttacttaccggttacctttcccgttacgtcccttcccggttccccgtacccg

SEQ ID NO: 36360 - DNA, 751 bp, Homo sapiens
  misc_feature: GYAE6OF01ADFNC.14.42.D09.1.454.CMB.1.raw
  modified_base (208)..(208): a, c, t, g, unknown or other
  misc_feature (208)..(208): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatcgacccagtcgccagacctcccgtggctgtgtctcgtgggcgagcggccacatacactgacaacgtccagcagtagttntttaacaccacctacaaacaataacgtaaccttacttaaattcggaaccagacaaacgaaaccgacgacacgtcctacgtaagtctcgtcttacgttacgcggactacgtaccggaaccgggtactccggtcggtacctacggtaccgtagttcggacggtcggaccgtacgggtccggttacgtacggtaacctaaccctaaccgttaactttacccgaaccgtttaccctaaccgaaccctaacgttacccgaccgaccgtaaccggtcccgtacggaccgtaacgggtacgtaacgggtaaagtcgttagggtacgttaacgtttaagtttaaccgttacgtacgtaacctaaacgttaccgtaacgtttaacttaaccgttaacccttaccgttaccgttaaccgttcggttaaccgggaacggtaccggtaacagtcgtaaggactaacgtacgacggtaccgtagtccggtacgtccttacgaccttacttaccgttcggttacctttaccctaccttcccgttccccgtcgtaacg

SEQ ID NO: 36361 - DNA, 481 bp, Homo sapiens
  misc_feature: GYAE6OF01A1PA5.14.42.D09.1.454.CMB.1.raw
  modified_base (395)..(395): a, c, t, g, unknown or other
  misc_feature (395)..(395): n is a, c, g, or t
  modified_base (442)..(442): a, c, t, g, unknown or other
  misc_feature (442)..(442): n is a, c, g, or t
  modified_base (457)..(457): a, c, t, g, unknown or other
  misc_feature (457)..(457): n is a, c, g, or t
  modified_base (467)..(467): a, c, t, g, unknown or other
  misc_feature (467)..(467): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctctaagctgctcgttactggcatcaaccgggatctggggtccctgaccgattcagtggcagcgggtctgagacacatttcactctcacatcagcagcctgcagctgaagatgtgctagttatactagtcaanagctattatactactaccgtactactttgccgtagggacagctaganatcaagcgaatgtgntgcacatctntctcatctccgtac

SEQ ID NO: 36362 - DNA, 494 bp, Homo sapiens
  misc_feature: GYAE6OF01EJ8EC.14.42.D09.1.454.CMB.1.raw
  modified_base (208)..(208): a, c, t, g, unknown or other
  misc_feature (208)..(208): n is a, c, g, or t
  modified_base (482)..(482): a, c, t, g, unknown or other
  misc_feature (482)..(482): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaattggtaccagcagaaaccaggacagcctcctaagctgctcgttactggcatcaaccggatcgtgggtcctgaccgattcagtgcagcgggtctgagacacatttcactctcaccatcagcagcctgcagctgaagatgtggctagtttattactgtcaacagctattatactactccgtactactttggccgtagggaccaagtcgtaggagatacaagcgaatggtcgctgcacatctgtcttcnctcctcccgtac

SEQ ID NO: 36363 - DNA, 776 bp, Homo sapiens
  misc_feature: GYAE6OF01DN8EY.14.42.D09.1.454.CMB.1.raw
  modified_base (218)..(218): a, c, t, g, unknown or other
  misc_feature (218)..(218): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatgacccagtcgccagacctccctggctgtgtctcgtgggcgaggacgggcccaccatcaactgacaagtccagccagtagttgttttaanaccacctaccaaactaataaacgtaaccttactttaaaagttcggtaaccaagacaaacgaaaaccaggaaccacgaccctacctaagcctagtccttacgtttacggcggactaacgtaccggaaaccggtacgttccggtaccggggtaccctacggaaccgtacttacggacggttacgggacgtacgggtccgggttacgtagaacgtaacctaccttaacttttacccgaccttacctaccctaacctataccgacgaccgtaacgccgtacgacggacggtacgtaaggaacgtagttacggtacggtagtttaacggtttaacttaacgtacgtaacctaacgtaacgtaccttaaatttaaccgttaaccttaaccgttaccgttaacgttaccggtttaaccggaccgggtaaccgggtaacctaacggtacgtacggtaacgaacgttacgaaacggtaccgtaagttcgggtaccgtaccgtacgtaccctaacgtacgttacgttaccgtttaccttaacccgttccgtttccccgtccccgtacg

SEQ ID NO: 36364 - DNA, 531 bp, Homo sapiens
  misc_feature: GYAE6OF01AL93G.14.42.D09.1.454.CMB.1.raw
  modified_base (516)..(516): a, c, t, g, unknown or other
  misc_feature (516)..(516): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgttactgggcatcaaccgggatcgtggggtccctgaccgatttcgagtcggcgagcgggtctgagacactatttcactctcacatcagcagcctgcaggctagaagatgtcggtactagtttattactcgtacaacagtctattactacttactaccgtactacgttttcgaccgacgggtaccagctaggacagtcagacgacgtcggtcggtctcgccacctactcgttcgtcttacncttccgttcccgtac

SEQ ID NO: 36365 - DNA, 725 bp, Homo sapiens
  misc_feature: GYAE6OF01B1QKK.14.42.D09.1.454.CMB.1.raw
  modified_base (213)..(213): a, c, t, g, unknown or other
  misc_feature (213)..(213): n is a, c, g, or t
  modified_base (314)..(314): a, c, t, g, unknown or other
  misc_feature (314)..(314): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggcgaggacggccaccatcaactgacaagtccagccagtagttgttttanaccaccctaccaaacaaataaacgaacccttactttaaagttcggtaacccagacaacgaaaaccagggaaccagccctacctaagctgcttcgtttacgngggcatccgaaccgggaatcgtcggggtccctgaccgtattcgaggtggcaggccgggtactggaagaccgtactacttttccgaccttctacccaacctataccgtacgaccaacggtcccttaggaccgacgggtaccgtaggaaacgtagttcgggtacgggtacttaacggtttttaacttaacggttacgttacccaaacgtacgtaaccttaactttacttaacccttaccgtacccggtttaacttaccggtttttacgggacccggtaacggggtaacccgaacgtccggtaggacgtaacgtaccgaacggaccggtaacgttggtacgggtacgtacgcccgacccgttagttccgttcgttacctttacccgtacctttccccgttcccccggtaacccg

SEQ ID NO: 36366 - DNA, 652 bp, Homo sapiens
  misc_feature: GYAE6OF01DX2SN.14.42.D09.1.454.CMB.1.raw
  modified_base (225)..(225): a, c, t, g, unknown or other
  misc_feature (225)..(225): n is a, c, g, or t
  modified_base (377)..(377): a, c, t, g, unknown or other
  misc_feature (377)..(377): n is a, c, g, or t
tcagcgtctagtaccacgaccggtgctcgatttagacacatacgcaggggcagcaagatggtgttgcagacccaggtcttcatttctctgttgctctggatctcgtggtgccgtacggggacatcgtgatgacccagtcgccagacctccctggctgtgtctcgtgggcgagcggccaccatcaactgcaagtccagccagagttgtttacaccacctaccaaanaaataacgaaccttattaaagttcggtaaccagtacaagaaaccgaggaacacgtacctaccgtaagctgtccttacgtttacgcgggactacgtaccgaaccgggtatccggtcggggtccctagaccgtatcgaggtgcgtacggcggtntaggaacgactacgtattcacttcacaactatcgacgacctagtccctggacgaggtacgtacggaagtcgtggtacgtacttaagttttactacgtagtacgaagtacgtacttaacttactaaccttaccgttaccgtacgttaccgtttacgggaccggtaacgggaaccgtacgtacgtaggaactacgtaaccgaacggtacgtaacggtcggtaccgtcgtacgccctacgactttcgtaccttcctacctccttcccgtccccgtacg

SEQ ID NO: 36367 - DNA, 499 bp, Homo sapiens
  misc_feature: GYAE6OF01AOK52.14.42.D09.1.454.CMB.1.raw
  modified_base (283)..(283): a, c, t, g, unknown or other
  misc_feature (283)..(283): n is a, c, g, or t
  modified_base (345)..(345): a, c, t, g, unknown or other
  misc_feature (345)..(345): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgtttacngggcatcgaacccgggatctgggtccctgaccgattcagtggcaggcgggtctgacgacacntttcactctcaccatcagcacgcctgcaggctagaagatgtggctagtttattactgtacaacagctattatactactaccgtactactttcggccgagggaccagcgtgagatcagcgagtgngtcngcacatctcgtctcactcctcccgcc

SEQ ID NO: 36368 - DNA, 712 bp, Homo sapiens
  misc_feature: GYAE6OF01AL8IW.14.42.D09.1.454.CMB.1.raw
  modified_base (166)..(166): a, c, t, g, unknown or other
  misc_feature (166)..(166): n is a, c, g, or t
  modified_base (176)..(176): a, c, t, g, unknown or other
  misc_feature (176)..(176): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (422)..(422): a, c, t, g, unknown or other
  misc_feature (422)..(422): n is a, c, g, or t
  modified_base (657)..(657): a, c, t, g, unknown or other
  misc_feature (657)..(657): n is a, c, g, or t
tcagcgtctagtaccacgaccggtgctcgatttagacacatacgcaggggcgagcaagatggtgttgcagacccaggtcttcatttctctgttgcttctggattctctggttgccgtacggggacatcgtggatgacccagtcgccagactccctggctgtgtctntcgggcgagngggcccaccatccaactgcaagtccagccagagttgtttanaccncctcaacgaataacgacttcttaaatggtaccngtcaagaacagacagcctactaagcctgccttacgtttacnggctactaccggaacccgggtaatccggtcggggtttaccccaggtaacccctaaggtttcccaggttcggactaggtccgggtctaggtacggaacctacgtattttcaaccgtcaccaaccttcnccgagtaccgaagcccgtggacaacgggtcgtaacgtaggaagttcggcggttagtacggttttaacttcgtaacgttaccgtaacgtagtacctaatttaacgttaccctaccgtttaccgtaacgtttacgttttaccgggacccgtaaagggggtaaaccctaggttacccggtaggtaacgtaccgtaaccgtaaagggtcccgtaaagttacgggtaccggtgttaaccncggtaccgtttacacgtttcggtaccctttcgaacgtttcccctacggtaacccc

SEQ ID NO: 36369 - DNA, 667 bp, Homo sapiens
  misc_feature: GYAE6OF01BHIPT.14.42.D09.1.454.CMB.1.raw
  modified_base (375)..(375): a, c, t, g, unknown or other
  misc_feature (375)..(375): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagttgttttataccacctaccaaacaaataacgaaccttactttaaattggtaccagacaagaaaccaggacacgccctacctaagactgtcttacgtttacgtacgggcataccgaaacccggggaatccggtcgggggtcccctaggacccgtatttcgagtggcgaggcgggtntagagacactactttcactctccacctatcacgcacgccgtgacgaggtctaggaagtagtggtcggtacttaaggttttaacttacgtcgtacaacgtacgactaattactaaccttaccgttacccgttacttacgttttacgggaccggaacggggtaacctaaggtcgtaggtaagtaactacgaaacgtacgtaaaccgttggttaccgggcttacggacctaacccgttattacccgttacggtttacccctttaacgtacccgtttccccgttcccccgtaaccg

SEQ ID NO: 36370 - DNA, 654 bp, Homo sapiens
  misc_feature: GYAE6OF01CVHKG.14.42.D09.1.454.CMB.1.raw
  modified_base (381)..(381): a, c, t, g, unknown or other
  misc_feature (381)..(381): n is a, c, g, or t
  modified_base (469)..(469): a, c, t, g, unknown or other
  misc_feature (469)..(469): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgaccccagtcgcccagacctccctggctgtgtctctgggcgagagggcccaccatcaactgcaagtccagccagagttgttttataccacctaccaaactaataaacgaacccttactttaaaattcgggtaaccagacaagaaaacccgaggacacgccctacctaagctgccttcgtttaacgtgggacacgtaccgaaacccgggatccgtcggggtccctagaccgatttcgagtggacaggccgggtntaggacgaccactatttcactctcaccatcagcacgcctgcgaggctagaagagtggtcggcttaagtttacttacgttgtaccaaanacgtactatttacgtaaccttaccgttacccgttaacttaccgttttacgggacccggtaacggggtaccgtaacggtaccttagggacgtataaccgaacggtacgtaacgtcggtacggtcgtcgaccctaccgtaattcccgttacgtttacccttactaccttccccgttcccccgtaccg

SEQ ID NO: 36371 - DNA, 713 bp, Homo sapiens
  misc_feature: GYAE6OF01BJ14A.14.42.D09.1.454.CMB.1.raw
  modified_base (214)..(214): a, c, t, g, unknown or other
  misc_feature (214)..(214): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagacctccctggctgtgtctcgtgggcgaggagggcccaccatcaactgacaagtccagccagagttgttttanaccacctacaacaaataacgaaccttacttaaagttacggtaccagacaagaaaccaggacacgcctacctaagctgtccttcgttacgtcggcactaccgaaaccgggtatccggtcgggtccctcgtaccgattcaggtgcgaggccgggtactaggacgactactacgttaccacctactacccacctagtccaacgccgtacgcctggacgacggacgtaggaagtagtcggttacggtaacttaagttttacttaacgtaccgtaataaccgtagtacctaagtttaccttaccttaccgttaccgttaacgtttaccgtttggaaccccggtaagggtaccgtaaacggtcgttaacgggaataccgtaaccggtaacgtaccgggtaaacgttggaaccgggtaccgtacccggtaacccgtaacccgttacgtttacccgttcggtttaccccttaaccgttaccccgtttccccgttcccccgtaacccg

SEQ ID NO: 36372 - DNA, 584 bp, Homo sapiens
  misc_feature: GYAE6OF01EHB6Q.14.42.D09.1.454.CMB.1.raw
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
tcagcgtctagtaccacgaccggtgctcgatttagacacatacgcagggggcagcaagatggtgttgcagacccaggtcttcatttctctgttgctctggatctctggtgcctacggggacatcgtgatgacccagtcgccagactccctggctgtgtctcgtgggcgagagggccaccatcaactgcagtccagccagagtgttttanacacctccaacaataagaacctacttaaattgtaccagacaagaaaccaggacagcctacctaagctgcttcgttacnggcatcgaaccggatcggtcggggtccctgaccgtattcgagtgcaggcggtctgagacactattcactcncaccancagcacgcctgcaggctagaagtagtggtagtactagtttacttacgtagtacaacagtactattaacttacttaccttaccgttactacgttttacggaccggtaagggtaccgaagtcgtaggagtacgtacgaacggtaccgtaacgtcggtacggtactcggacccaccgtactaccgttcgttacccttacctaccttccccgtccccgtacccg

SEQ ID NO: 36373 - DNA, 670 bp, Homo sapiens
  misc_feature: GYAE6OF01BJ18U.14.42.D09.1.454.CMB.1.raw
  modified_base (210)..(210): a, c, t, g, unknown or other
  misc_feature (210)..(210): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggcgagagggccaccatcaactgcaagtccagccagagttgttttanacacctcaacaataagaacctcttaaattgtaccagacaagaaaccaggacagcctacctaagctgccttcgtttactgggacacgtaccgaaacccgggtaatccgtacggggtcccctagacccgtatttacgagtggcgaggtcgggtctgagaccatattcacctctacaccatcagcagccctgacgaggctagaagatggtaggtactaagtttattactagtacctaactaagactagttaactaccgttaacctaccgttaacttaccgtttacgggacccgtaacgggggtaaccctaacgggtacgtacgggtaacgtaagtacccgaaaacggtccggtaaaaccgttcgggttacggtccgtaaccggtacccctaaaccttacgttacccgtttaggtttacccctttaccttaacccgttttcccccgttacccccgtaaccccgg

SEQ ID NO: 36374 - DNA, 682 bp, Homo sapiens
  misc_feature: GYAE6OF01AWVBJ.14.42.D09.1.454.CMB.1.raw
  modified_base (216)..(216): a, c, t, g, unknown or other
  misc_feature (216)..(216): n is a, c, g, or t
  modified_base (325)..(325): a, c, t, g, unknown or other
  misc_feature (325)..(325): n is a, c, g, or t
  modified_base (391)..(391): a, c, t, g, unknown or other
  misc_feature (391)..(391): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatgacccagtccgccagacctcctggctgtgtctcgtgggcgagacgggccacctatcaactgacaagtcagccagtagttgttttaanaccacctaccaaataaataaacgaacccttaacttaaacgttacggtaccaagaccgaaacgaaaccaggaaccacgccctacctaagctacgtccttacgtttaacgnggccactccgaaaccggtactcggtccgggtacctcgtaaccgtatcgaggtgcgacggtcggttnacggagtacacttattcacctcgtaccaactacgtacgacacgcgtaccgtcgcggtaacggtcctaaggaaacgtgttacgggtcgttacgtttaacgttttaacgttactacggtaacacgtacgtaccgtttaaattacctttaccgtaccttaccgttaacgttcgtttacggacccgaagggtaccaggtcgtaggactactacgaacggtacctaagtggtaccgtacgtccgactaccgtattccggttacttacctttacctccgttccccgtaccccgtacg

SEQ ID NO: 36375 - DNA, 750 bp, Homo sapiens
  misc_feature: GYAE6OF01DS0JJ.14.42.D09.1.454.CMB.1.raw
  modified_base (382)..(382): a, c, t, g, unknown or other
  misc_feature (382)..(382): n is a, c, g, or t
tcagcgtctagtaccacgaccggtgctcgatttagacacatacgcaggggcagcaagatggtgttgcagacccaggtcttcatttctctgttgctctggatctctggtgcctacgggacatcgtgatgacccagtacgccagactccctggtctgtgtctctgggcgagacgggccaccatcaactgcaagtcagccagtagttgttttacacacctcaaacaataaacgaaccttactttaaattggtaaccagcaagaaaccaggaacacgccttacctaagtcttcgacgttcgtttactgggtacacttaccgaaccgggtaatccggtaggggtccctagtacccgtatttccgagttagcgacggtcggtctaganaccgtactatttccaaccttctacaacctagtccacgtaccaacgtccgttaggaccgtaggtaccttaagggaacggtacgtttagggtacgttaacggtttaagtttttaacgttaaccgtacggttaacccgtaaacgtaaccgttaccttaaagtttacctttaacccgttaaccttacccgtttaaacctttccggttttaccgggacccggaaacggggtaacccgtaagtccgtaggggtaaccgactttaaccgaaacggtacggaaaccgttcggtaaccggaccttaacgaccccgttaacctacgtttacccgtacgtttaccccgtttactaccccgtttactcccccggtaaccg

SEQ ID NO: 36376 - DNA, 524 bp, Homo sapiens
  misc_feature: GYAE6OF01DPU7Z.14.42.D09.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (292)..(292): a, c, t, g, unknown or other
  misc_feature (292)..(292): n is a, c, g, or t
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (489)..(489): a, c, t, g, unknown or other
  misc_feature (489)..(489): n is a, c, g, or t
tcagcgtctagtaccacgaccggtgctcgatttagacacatacgcaggggcagcaagatggtgttgcacgacccaggtcttcatttctctgttgctctggatctctggtgcctacggggacatcgtgatgacccagtcgccagactccctggctgtgtctctgggcgagagggccaccatcaactgcaagtccagccagagtgttttanacacctaccaanaataagaaccttacttaaattggtaaccagcaagaaaacccaggacagcctacctaagctgctcgtttacngggcataccgaacccggatccgtggggtccctagaccgtattcgagtggacaggcggtctgagacactactttcacttcncaccatcagccagctgcaggctagagatgtgtctagtttatactgacaanagtanattatactactctactactttgcgacgggacacgcgtagacgatacaacgcgaacgtgtagntgacactatcttcgttcttacgtctcctccgtacc

SEQ ID NO: 36377 - DNA, 709 bp, Homo sapiens
  misc_feature: GYAE6OF01DKXUU.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagtagttgttttaacaccacctaccaaacaataaacgaacccttactttaaaagttcggtaacccagaccaaagaaaacccagggaaccacggtacccctacctaaagcctaggtccttaccggttttaacgtggggacctaacgttacccgaaaccccggggtaattcccggttacgggggtcccctaggtacccgtatttccgaagggttcggacgtacggccggggttctagaacgacctacttactttacccaccttcctaccaacccgtatccgaagtccacggtccctaggacgtacgggtacgtagaacggtagtggtacggtacgttaagtttaacttacgttcgtaactaactacgtacctaatttaacttaccttaccttaccgttactacgtttacggaccggtacgggtacacgtcgtaggacgacgtacgaacggtacgtagtcggtcgtcgtacgtccaccgtataccgttcgttaccttctacttccgttccgtaccg

SEQ ID NO: 36378 - DNA, 588 bp, Homo sapiens
  misc_feature: GYAE6OF01AEG0F.14.42.D09.1.454.CMB.1.raw
  modified_base (211)..(211): a, c, t, g, unknown or other
  misc_feature (211)..(211): n is a, c, g, or t
  modified_base (304)..(304): a, c, t, g, unknown or other
  misc_feature (304)..(304): n is a, c, g, or t
  modified_base (428)..(428): a, c, t, g, unknown or other
  misc_feature (428)..(428): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggcgaggagggccaccatcaactgcaagtccagccagagttgttttanacaccctaccaaacaataaacgaacccttactttaaaattcggtaacccagaccaaggaaaaccaggacacgcctactaagctgctcgttacnggcataccgaaccgggtatcgtcgggtccctagaccgtattcgagtcggactaggccgggtctaggacgaacctactactttcaccttctacaccatcgacgcacgcctgcgaggctagaagtntggtacgtacttaagtttatactagtaccaagtacgactattactactactccgtaactacgttacggaccgagggaccagcgtagagactacgacgtacgagtcgtacggctacgacctacgtatcgttcgtacttaccgtacttccgttccccgtacg

SEQ ID NO: 36379 - DNA, 700 bp, Homo sapiens
  misc_feature: GYAE6OF01C1XJ8.14.42.D09.1.454.CMB.1.raw
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (305)..(305): a, c, t, g, unknown or other
  misc_feature (305)..(305): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatgacccagtcgccagactcctggctgtgtctcgtgggcgagacggccaccatacaactgactaacgtccaagccagtaggttnttttanaaccacctaccaaacaataaacaaccttacttaaattggaccagacaagaaaccaggtacagcctactaagctcgcgttacgtttacngggactaacgtaccgaacccggtattcgtcgggtccctagaccgtatcagtcggctaggtcgggtcagagactactacttacactctacacatacagcacggccaggacgagtcgtaagaagtacgtcggtacgggtacttaaggttttaacttaacgttacgttaacaaaccgtagtaacttaactttaacttaaccttaacttacccgttaactttaacccgttttacgggacccggtaaacggggtaacccgtaaaggtcccgttaagggaacgtaacgttacgaaacggtaaaccgtaacgttcggggtacgtaccgttagacccgttaacctacgtttaccgtaccggtttacctttacctaacccgttttccccgtccccgttaacccg

SEQ ID NO: 36380 - DNA, 677 bp, Homo sapiens
  misc_feature: GYAE6OF01CYH2H.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgccgtacggggacatcgtgatgacccagtcgccagactccctggctgtgtctcgtgggcgagacggccaccatcaactgcaagtccagccagtagttgttttactaccaccctaccaaacaaataacgaaccttacttaaattcggtaccagacaagaaaccaggaacacgcctacctaagctagcttacgtttacgtgggctacgtaccgaaacccgggattcggtcggggtccctaggaccgtattcgagtggacgtaggtccgggttctaggacgacctactacttttaccaaccttctaccgaacctataccgagaccgacgtcccgtggaccgagggtacctaaggaagtagtgtcgggtactttagtttaacgttacgttcggtaaccaacgtaggtactaagtttaacttaacctaccttaccgttacttaccggttttacggaccggtacgggtaccacggtcgtaggtacgacgtacgacgtaccgtagttggtcggtactcggaccctaccgtagttccgttacgtttaccttacgtacccttcccgttccccgtaccg

SEQ ID NO: 36381 - DNA, 687 bp, Homo sapiens
  misc_feature: GYAE6OF01E3KBV.14.42.D09.1.454.CMB.1.raw
  modified_base (307)..(307): a, c, t, g, unknown or other
  misc_feature (307)..(307): n is a, c, g, or t
  modified_base (645)..(645): a, c, t, g, unknown or other
  misc_feature (645)..(645): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggcgagagggccaccatcaactgcaagtccagccagagttgttttataccacctaccaacaataacgaacccttacttaaaattggtaacccagacaacgaaaacccaggaaccacgccctacctaagcctgcttcgtttacgngggacacgtaccgaaacccgggtaatcgtcggggtccctggaccgtattcaggtggcaggtcgggtctaggacgacgactactttccaaccttcctaccacctatccaacgccaggcccttaggccgtaaggtccgtaaggtaaagtagtgggtacggtacttaacgttttaattaccttacggtaccaaacgtaacgtactaatttaaccttaaccttacccgttacccgttaaccgtttaccggttttacggacccggtaaccgggggtaacctaacggtcgttagggagtaactacgaacggaccgtaacgttggtcgcctacggacccaacctnttaccgttcttaccttacctaccgtttcccctacccgtaccg

SEQ ID NO: 36382 - DNA, 836 bp, Homo sapiens
  misc_feature: GYAE6OF01DYA4E.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgccgtacggggacatcgtgatgacccagtcgccagactccctggctgtgtctcgtgggcgagcggccaccatacaactgcaacgtccacgccaagtagttagtttttaactaaccctaccctaccaaaactaaataaacgtaaaccctttaactttaaagttcggtaaaccacgacctaaacgaaaaccgacggaacacgcccttacctaaagcgttcggtaccttccggtttacgcgggtactactaccggaaaaccccggggtagttccgggtccggggtccctacgggtaacccgttagtacggtaacggtgggaccgtacggggtccgggttactcggaaacgacctaaccgtacttttacccaccttacctacctaacctacggtaccacggtaccaccgtacgtccggaacgtcgggtaactaggtaagtacgttacgggttaacggttacctttaagttttaactttacggtaaccgtaaccgtaacgtcgttaaacctttaacgtttaaccgtttaaccgttaccccgtttaacccgttaccgtttaaccggtttcgggaacccgggaacgggtaaccgtaacggtacgttaaggtacgtaacctacggtaaaaccgtcccgggtaaagttccgggtagtaccgttacccgtaacctaccgttacgttaccgttcccgttttacttacccctttaacccgtttccccgtccccgttaacg

SEQ ID NO: 36383 - DNA, 807 bp, Homo sapiens
  misc_feature: GYAE6OF01ETMVY.14.42.D09.1.454.CMB.1.raw
  modified_base (770)..(770): a, c, t, g, unknown or other
  misc_feature (770)..(770): n is a, c, g, or t
tcagcgtctagtaccacgaccggtgctcgatttagacacatacgcagggcagcaagatggtgttgcagacccaggtcttctatttctctgttgctctggatctctggtgcctacggggacatcgtgatgacccagtcgccagactccctggctgtgtctcgtgggcgaggacgggccaacccatcaaactgacaacgtcccagcctaagtaggttacgtttttaacaccacccttaccgaaaactaaataaacgtaacccttaacgtttaaagttcgggtaaccaggtaccgaacgaaaccgagggaaccacggcccttaccgtaaaggtcctagtaccgttaccggttttacgcggggtacctaacggtacccgaaaccccggggtaattcccggggttaccggggtaccccgtaggtaacccggtaactttccggtaacggttcgggacgtaacgggtccggttcccgttaaggaccgtaaaccgtcgttaacgtttttcccgaaccgttaccctacctaaccctaagttcccgaaacgggccctaacggtccccgtagggaccggtaacgggtaccgttaaggtaacggtacggttacggtacggttacgtttaacgtttacgtttacgtacggtactaacggtacgttaactacgtttaactaccttacccgttaccgttaacgttaccggtttacggaccggtacgggtaaccgtacgtcgacggtactacgtaacgacgtaccgtacggttggtacgtcgtacnccactcttacgtcttactacctctaccgtccgtaccg

SEQ ID NO: 36384 - DNA, 783 bp, Homo sapiens
  misc_feature: GYAE6OF01ENI9R.14.42.D09.1.454.CMB.1.raw
tcagcgtctagtaccacgaccggtgctcgatttagacacatacgcagggggcagcaagatggtgttgcagacccaggtcttcatttctctgttgctctggatctctggtgcctacggggacatcgtgatgacccagtcgccagactccctggctgtgtctcgtgggcgagacgggccaaccatcaactgacaagtccagccagtagttgttttatacacctaccaaacaaataaagaaccttacttaaattggtaaccagacaacgaaaccaggacagcctacctaagctgtacttcgttacgtggacacgtaccgaacccgggaattccggtcggggtccctacggaccgtagttcaggtcggacgtaggccgggtactacggacgactacgtacttccacttccacacctatacacgaccgacgtccgtacggcgtaaggggtcttaacgggaaagtacgttggtaacgggtacgtttaagttttaaacgtttacgttacggttaacctaaaccggtacgtaacttaacttttaaccgtaaaccgtttaacccgttacccgttttaaccgttaaccggtttttaccgggaaccccggggttaaccggggtaaacccgttaagggtaccgttacgggaaacgttaaccggtaacgtaaaaccgggttaccgtaaaacgggtttcgggtacgggttaccctaccggtaaaccccgtacccttaacgtttacccgttccgtttaacctttaccttaaccgtttcccccgttaccccggtaaccc

SEQ ID NO: 36385 - DNA, 733 bp, Homo sapiens
  misc_feature: GYAE6OF01EIM7O.14.42.D09.1.454.CMB.1.raw
  modified_base (396)..(396): a, c, t, g, unknown or other
  misc_feature (396)..(396): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatgacccagtcgccagactccctggctgtgtctcgtgggcgagacgggcccaccatcaactgacaagtccagccagagttgttttacaccacctaccaaacaaataacgtaacccttactttaaagttcggtaaccagacaaacgaaaccaggacacgtccctactaagctagtcgttacgtttacgcgggactacgtaccgaaccgggtattccggtcggggtccctaggaccgtattcgaggtcggcgacggtcgggtactcggaanaccgtacttactttacgaccttcctacgaaccctagtccagaccgacgccgttagaccgaggtactaggtaaacgtggtacggtacggtacttaaggtttacttacgtacgtaacctaacgtagtaaccttagtttaaccttaacccgtttaccttaacccggtttaacgtttaaccggttttaccggaacccgggaaacggggttaacctaacggttcgtaacgggtaactaacggttaccgaaacgggtaccgtaacgtttcggtacggtacgttaccgaacctaccgtacttcgttacgtttaccttaccgttaccgttccccgttccgtaccg

SEQ ID NO: 36386 - DNA, 839 bp, Homo sapiens
  misc_feature: GYAE6OF01BKVG3.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgccgtacggggacatcgtgatcgacccagtcgccagacctccctggctgtgtctcgtgggcgaggacgggcccaaccatacaactgacaacgtccagccagtagttagttttaacaccacctaccaaacaaataaaccgtaaccttactttaaagttcggtaaccagacaacgaaaccaggaccacgtaccctaccgtaacgtctcgtaccgtttcggtttacgtcgggacctaaccgtacccggaaaaccccggggttatccgggttccgggggttacccctacggaacccggtagttacgaacggttcggaccgtaacgggtccggggttacgtaggaaccgtaacctaacgttacttttacccgaccttacccttaccgaaccctaactccgaaacggctaaccggtcccgtacggaccgaagggtacctaaggaaaccggttaggttacgggtacggttactttaaacggttttttaactaacgttacgtaacgtaacgtacgtacgtttaaactttaacttacccgttaccgttaacccgttacgtttaaccggttttacgggaacccggtaaccggggtaaccaacgggtacggtaacgggtaactaacggtaaacccgtaggtaaaccgtaaccggttacggtccgggtacttaccggaacctaccgttaccgttaccgttacgtttacccttacccgtaccctttccccgttcccgtaaaccg

SEQ ID NO: 36387 - DNA, 872 bp, Homo sapiens
  misc_feature: GYAE6OF01BLUTI.14.42.D09.1.454.CMB.1.raw
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatcgacccgacgtcgccacgacctcccgtggtcctggtgtcctcgtcggggcgaggacgggcccaccactaccaactcgactaaccgtccgacgccgagtacgtttnttttaacgtaccaccctaccaaactaaataacgtaacccttactttaacgttacggtaccganaccgaaacgaaaacccgtacggaaccacgtaccctaccgtaacgtccttacgttccgttaccgtttacggtcggacctacccgttaaccggtaaaccgggtacgttccgggttccggggtaccccgtcggtaaccgtacgttacggtggttccgggacgtacggggtcggttacgtacggacgtaacctacgtttactttaccgaccttcctacccgtaaccttacaccgtacgccgtaaccggtcctcgggacgtacggtacgtaacgggtaaagtggttacgggtttacgggtaacttttacggtttaactttaccggtacgttaacctaagaccgtttaacttaactttaaccgtttaacccgtttacccggtttaacccgttaccggttttaacccggggttttaccggaacccggggtaaaccgggaacccggttaacggtaaccggttagggtaaccgtaacggtaaccggaacgttaccggttaacggttacgtcgggtaaccgtaccgtcctaccggttaattcccgtttaaccttcgtaaccccgtttccttcccgtacccgtacg

SEQ ID NO: 36388 - DNA, 806 bp, Homo sapiens
  misc_feature: GYAE6OF01BEV4D.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagacctccctggctgtgtctcgtgggcgaggacggcccaccatcaacgtcgacaacgtccacgccaaggtagttgtttttacaaccctacctaaccaaactaaataacgtaaaccttacttaaagttcggtaccaggacaaacgaaaccgaggaaccacgccctacctaagctacgtcctttaccgtttacgcgggtacctactaccggaaaccccgggtatccgggtaccgggtccctagtaccgtattcgaggtcggcgaacggtcgggttacacggacgaacctaacttacgtttccaccgttcacccactacgtcaaccgtcaccggtcccacggcgtacggtctaagggtaacgtgtacgggtcgttaacgttacgtttacgttaccgtaacgtacccgtaaacgtagtacgtttaaacttccggttaacctttaacccggttaccgtttaacggtttaccggtttaccgggtaaccccgggtaacggggttaaaccgtaccgggttagaaccgggtaacgttaaccgtaaccgggtaaaccgttaccgggtaaccggtttacggggtccggttacccgtacggttacccgtaaccgttaccgtttaccgttcccggtttaaccctttaacggtttccccttcccggttcccccgtaaccg

SEQ ID NO: 36389 - DNA, 786 bp, Homo sapiens
  misc_feature: GYAE6OF01A5T0I.14.42.D09.1.454.CMB.1.raw
  modified_base (736)..(736): a, c, t, g, unknown or other
  misc_feature (736)..(736): n is a, c, g, or t
tcagcgtctagtaccacgaccggtgctcgatttagacacatacgcaggggcagcaagatggtgttgcagacccaggtcttcatttctctgttgctctggatctctggtgccgtacgggacatcgtgatcgacccagtcgccagactccctggctgtgtctcgtgggcgaggacggccaccatcctaacgtcggacaaccgtccacgccaaggtacgtttaggttttaacaacctaaccctaccgaaaactaaacgttaaacgtaaacccttaactttaaacgttacggtaacccaagacgtaaaccggaaaaacccgacgggtaaccaacggtaccccttaaccgttaaacggtccgttaggtcccgttttacggtttaaccgtcggggaactaaccgtaccgggtaaaacccggggtaacttccggggtaccggggtaccctaggtaacccgtagttacggacggtcggacgtaacggccgggttctaggacgtaacgtccgtaacgtttcaccgtacgtcccaacggatacgacgacgtaacgtccgacgtcggacgtacgtagtaaacgtgttacggtacgtacgtttaacgttaacgttaaccgttagtaacctaaagaaccgttacttaacgtaaccttaacgtaccttaccggtacttacggttacggaacggaacgggtacagtcgtaagggaccaacgtacgaacgacgtaaaggttcggcggttacnccggtactacccgtagttcctacggttacttcgaccctttccgtcctacg

SEQ ID NO: 36390 - DNA, 768 bp, Homo sapiens
  misc_feature: GYAE6OF01D53LY.14.42.D09.1.454.CMB.1.raw
tcagcgtctagtaccacgaccggtgctcgattttagacacatacgcaggggcagcaagatggtgttgcagacccaggtcttcatttctctgttgctctggatctctggtcgccgtacggggacatcgtgatcgaccagtcgccagactccctggctgtgtctcgtgggcgagaggccacatcaacgtcgacaacgtccagccagtagttgttttacaccgacctaccaactaacgtaaacgaaccttacttaaacttcggtaaccagacaacgaaaccaggaacacgtaccttacgtaacgcttagtccgttacgttacgtcgggacctaacgtaccggtaaacccggtattccgggttccggggttaccctacggtaaccgtacgtttacgaggtacgcggtacggtcgggttcaggaacggtactaacttactttaccgaccttctaaccgaacctaacgtcgtaacgacgtacgaccgtaggacgtacgggtacctaacggtaactcgggtaccggtaggttaaccgtttaaggttttaacttccggttaacgtaacgaaacgtacgtacgtttaaactttaacctacccgtttaaaccgtaccgttacgtttaacccgggttacggaacccggaacgggtaaccgacggttacgtagggtaacgtaagtaaccgtaacggaccgttaaggtcgggtcgttacgccgtaaacctcgttacgtcgtttaccgtactttacccgtaccgtcccgtttaccgaacccg

SEQ ID NO: 36391 - DNA, 789 bp, Homo sapiens
  misc_feature: GYAE6OF01CWV14.14.42.D09.1.454.CMB.1.raw
  modified_base (138)..(138): a, c, t, g, unknown or other
  misc_feature (138)..(138): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
tcagcgtctagtaccacgaccggtgctcgatttagacacatacgcaggggcagcaagatggtgttgcagacccaggtcttcatttctctgttgctctggactctctggtcgccgtacggggacatcgtgatcgacccngtcgcccagacctcccgtggctgtcgtctcgtgggcgaggacggccaccatacaatgacaacgtccagtccagtagttntttanaccacctacaaacgaataacgaccttacttaaattcggaacagacaaagaaaccgtcggaacacgaccctactaacgctatccttacggtttacgcggtacacgtaccggaacccggtatccggtcgggtacccacggtaccgtatcggagtcgggactcgggtacgggttctagacgactaacttaccgttttacaccttaccgaaccaactacttaaccgggactacccgaaccggtcccttacggacccgagggttaaccgttagggaaacgtccgtttagggtaaccgggttacttttaaacggttttaagttaaaccctcgggttaaaccctaaaggtacttaaccctttaaagtttaacccgtttaacttaccccgtttaaccgggtttaacctttaccggggttacccggaaacccgggtaacgggtacgttaccgggtaacgttaggggaaactaccggttaaccgaaacgggtaccggttaacgtcggtaaacggtctaccggaaccctaacgtttctaaccgtttcgttaccctatttacccctccgggtaccccta

SEQ ID NO: 36392 - DNA, 783 bp, Homo sapiens
  misc_feature: GYAE6OF01A8832.14.42.D09.1.454.CMB.1.raw
tcagcgtctagtaccacgaccggtgctcgatttagacacatacgcaggggcagcaagatggtgttgcagacccaggtcttctatttctctgttgctctggatctctggtgccgtacggggacagtcgtgatcgacccagtcgccagacctccgtgtctgtcgtctcgtgggcgaggacggccacactacaactgacaacgtcccacgaccaggtagtttcgtttttaacacctaaccctaaccaaactaaagtaaaacgtaaccctttattttaaacggttacggaaccagaccgaaacgaaccgaggaaccacgtcctacctagtctacgtacgtttaccgtttacggacggtactaacgtaccggaaccggtattccggtcggtacccgtagaccgttatcggacgtcgacggtacgcgggtactacgaacgactacctagtttacccacgttaccaccctaacacctacggaccgtccgtaaccgtccggtaagaccgggtacgggtaggttacgtaaacggttacggtggtttacgggttaaacgtttaagtttacttaacggtaacgtaacctaaacggtactaacgttaaccttacgtttaacccttaacccgttacggttaccgttaaccggttccggaaccggtaacgggttacccagttcgggaaggacttaacgaagttacggtaccggacgtttacggcgttacccttaagaccccctttagtacccttgttacccgttacttaaccttcccccgttaccgccccttaaagg

SEQ ID NO: 36393 - DNA, 847 bp, Homo sapiens
  misc_feature: GYAE6OF01BMCRP.14.42.D09.1.454.CMB.1.raw
  modified_base (346)..(346): a, c, t, g, unknown or other
  misc_feature (346)..(346): n is a, c, g, or t
tcagcgtctagtaccacgaccggtgctcgatttagacacatacgcaggggcagcaagatggtgttgcagacccaggtcttcatttctctgttgctctggactctctgtcgccgtacgggacatcgtgatcgaccagtcgccacgactccgtgtctgtgtctcgtgggtcgagcggccaccgtagtccactgcgaacgtccgacgccgtaggtacgtttcgttttaacacgtacctaaccaaactaaagtaacgtaaaccctttacgttaaacgttcggttaaccacggtacaaacgaaaccgtaggaccacgtacctaccgtaagtctacgtccgttacgttacgnggtacctaacgtaccccggaaacccggtagtttcccgggccggttaccccgtagtacccgttattacggaggtcgggtacgtaccgggcggttaccgaggacgtaactacgttaacgtttcccactccgtacgtaaccgactaccgtacggccgtaacggtcctaacggcgttaccggtacgttaacgtaggtaaccggttcgtaccggttaacgttaacgttttaacgttacgttacgtaaccgtaacgtacggtaacgttaaccgtttaaccgttaaccgttaaccgttaaccgtttaccggttaccgtttaccgggtaacccgggtaccggtaaccgtaacgggttaaccgtacgggtaaagttaacccgtaaccggtaaccgttacgggttaaccgttccgggtaacgggtacccggtaacgtaaccccgttaacccgtacgtttaccggttacgtttcccgttaaaccgtcccgtttaaccccgttccgtaaaccg

SEQ ID NO: 36394 - DNA, 723 bp, Homo sapiens
  misc_feature: GYAE6OF01AO9ZH.14.42.D09.1.454.CMB.1.raw
  modified_base (355)..(355): a, c, t, g, unknown or other
  misc_feature (355)..(355): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatcgacccagtcgccagacctccctggctgtcgtctcgtgggcgaggacgggcccaccatcaactgacaacgtccagccagtagttgtttttaactaccacctaccaaacaaagtaaacgtaaccttactttaaagttggtaaccagacaacgaaaccgaggacacgaccctactaagctcgtcttacgttacgtggactacgtaccgaaccggatcgtcgggtcccngacctatcgagtcggctacggcgggtctaggactacacttactttcgaccttcctaccaaccgtactaccgacgtccaaccggtccgtggaccggtacggaccgttaaggaaacgttgttacggtacggtactttaagttttaacgttaacgtacgtaaccaaagtacgtaccttaactttaacgtacccttaaccgttaccgtttacccgtttaacggtttccgggaacccgggtacggggtaaaccaacgggtacgtaacgggaataacgtaacgaacggtaccgtaacgttgggaccgttcgaccgtaacctacgtacgtttaccgttcgtaccctttactaccgtttccccgttcccgtaaccg

SEQ ID NO: 36395 - DNA, 650 bp, Homo sapiens
  misc_feature: GYAE6OF01ACJA4.14.42.D09.1.454.CMB.1.raw
  modified_base (109)..(109): a, c, t, g, unknown or other
  misc_feature (109)..(109): n is a, c, g, or t
  modified_base (208)..(208): a, c, t, g, unknown or other
  misc_feature (208)..(208): n is a, c, g, or t
  modified_base (370)..(370): a, c, t, g, unknown or other
  misc_feature (370)..(370): n is a, c, g, or t
tcagcgtctagtaccacgaccggtgctcgatttagacacatacgcaggggcagcaagatggtgttgcagacccaggtcttcatttctctgttgctctggatctctggtnccgtacggggcatcgtgatgacccagtccgcagactccctggctgtgtctcgtgggcgaggacggccaccatcaactgacaagtccagccagtagtttnttttaacacaccctccaaacaataacgtaaccttactttaaagttcggtaccagacaaacgaaacctaggacctacgcccttaccgtaagtccttgtaccgttacggttacgtcgggactaacgtacccgaaccggtatccggtacgggtccctagaccgtntccgtagtcgcgtacggcggtacagacgactacgttactctcgtcctacgactctacgactcactcgtagacgtagagtacgagtgtacggtcgtatttacgttataccgttagacctaactgtaacccttaattacccttaacgttacccgtaccgttacgtttccggttacgggacgttaaccgggataacggcggttagactacgtagacgttacgacgttggtaccgcgtacgtccctacgcttacgtttctcttacctcgttcccctccgtaccg

SEQ ID NO: 36396 - DNA, 655 bp, Homo sapiens
  misc_feature: GYAE6OF01DD2K0.14.42.D09.1.454.CMB.1.raw
  modified_base (129)..(129): a, c, t, g, unknown or other
  misc_feature (129)..(129): n is a, c, g, or t
  modified_base (320)..(320): a, c, t, g, unknown or other
  misc_feature (320)..(320): n is a, c, g, or t
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
  modified_base (578)..(578): a, c, t, g, unknown or other
  misc_feature (578)..(578): n is a, c, g, or t
tcagcgtctagtaccacgaccggtgctcgatttagacacatacgcaggggcagcaagatggtgttgcagacccaggtcttcatttctctgttgctctggatctcgtggtcgccgtacggggacatcgtnatcgacccgagccgccaagtacctccgtggctgtcgtctcgtgggcgagacgggccaccatcaactgacaagtccagccagtagttactttacacctaccctacaaacaagtaaacgtactactttaaagtcggaaccagacaaagaaaccaggaactaccgccttaacaggtcctgtccttacgttacgnggactacgtaccgaaacccgggtattccgggccggtacccgtaagaccgttatccggaagtcgggataccggngggttaccagagacctagttctttaccnctccgtaaccagaagtccaaagccgtaacgtccgagacggaagtagtacgaagtagtacggttacggtactttagttaacttacggtactaacaacgtataactattaactaactacgtaccgtacttacgtacgacggtaacgggtacaacggttntaggactagtacgaacgtacggtaagcggtcgtacacgtcacctatcgttactacctacgacttccgtaccccgtag

SEQ ID NO: 36397 - DNA, 712 bp, Homo sapiens
  misc_feature: GYAE6OF01EY58J.14.42.D09.1.454.CMB.1.raw
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (318)..(318): a, c, t, g, unknown or other
  misc_feature (318)..(318): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatcgacccagtcgccagacctccctggctgtgtctcgtgggcgagagggccaccatcaactgacaacgtccagccaattagttnttttanaccaccctaccaaaacaaataaacgtaacctacttaaaagttcggaaccagacaagaaaaccagaccacgcctacctaagctagtccttacggttttacgngggactaactaccgaaacccgggtattcgggtacggggttacccacgaccgtattcgaggtacggactacggccgggttataggaacgtaactaacgttacgtttaccaccgttaccctaaccgaaccctaataccgaagtccgaacggtccctggaaccgagtacggtaacgaacgtagtggtacgtacgttaagtttaacgttactacgaacctaagtacgtactaaatttaccaacttaccgttaccgttaacgttaccgtttaccggaccggtaacgggaacctaagacgtaggagtaacgaacacggtacgtaaccgttagggtctacgtcggaacctaccgtaacttccggtaacttccgttaacctccttacccgttccccgtaacg

SEQ ID NO: 36398 - DNA, 789 bp, Homo sapiens
  misc_feature: GYAE6OF01DN62P.14.42.D09.1.454.CMB.1.raw
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
  modified_base (393)..(393): a, c, t, g, unknown or other
  misc_feature (393)..(393): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatcgacccagtcgccagacctccctggctgtgtctcgtgggcgaggacggccacatcaagtgacacgtcagcagtagttntttacaccacctacaanaataacgaccttacttaaagttcggaacagacaagaaaccnggacncgacctacagcgtcgtctttacggttacgnggactaacgtacccgtaaaccggtagtccggtttaccggggtccctacgggacccttagttaccgagggttaccgggacgacgggtccgggtntacggacgaacttacttcttaccaccttcctacacccggtataccgacgtcacggtccgtacgcgtacggtacggtaacgaacggtaggttacggtacggggttaacctttaaggttttaacctttaaccggtacgttaaccgaaccgtaacgttaaccgtttaacgtttaacctttaacccgttacccgttttaacccgtttaaccggtttaccgggttttaccgggacccgggttaaaccgggtacccgttaacgggtaccgttaacggtacggtaaccgttacggtaaccggtaaccggttaacggtcggttaacgtacggtacccgtaccgtaccgttaccttaccgtttccgttaaccttaccgttacccgttccccgttacccgtacccg

SEQ ID NO: 36399 - DNA, 816 bp, Homo sapiens
  misc_feature: GYAE6OF02F8BXD.14.42.D09.1.454.CMB.1.raw
tcagcgtctagtaccacgaccggtgctcgatttagacacatacgcaggggcagcaagatggtgttgcagacccaggtcttcatttctctgttgctctggatcttcgtggtcgccggtacgggacagtcgtgatcgacccagtccgccagacctccgtggctgtcgtctcgtgggcgaggacggccacatacagtcgacgacgacgacgacgacgtagttagtttacttaacctacctaacctaacctaaaacgtaaacgtaaccgttaaacctttaacgttaacgttaccgacgacgaacgaaaccgaaaccgaacggaccaccgtaaccgtaccgtacgtcgtcgttaccgtttacggttacggacggtactaaccggtaacccggtaaccggtacggttccgggttaccgggtacccgtaacgttaaccgttacgttacggacggtacggacggtacgggttcggtacgtaacgaaccgaaacttacctttaacctttacctacccttacctaacctaacctaacgtacgaacgcccgtacgtccgtacgacggtacgtaaggtaagtaacggttggtcggtacggtttatttaacgtttagtaccgtacgtaaccaacgtacgttacttaaacttaaccgttacccgttaccgtaaccgttttacggttaaccggtttaccggggaacccggtaaacggtaaccgttacggtacggtaagtaacgtacgtaaccgacgtacggtacggttcgggcgtaccgacccgtaactacgttacgttcgttaccttaccgttacttccgttccctaccg

SEQ ID NO: 36400 - DNA, 489 bp, Homo sapiens
  misc_feature: GYAE6OF02FTH3W.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgtttatacacctccaacaataagaacctcttaaattggtaccagcagaaaccaggacagcctcctaagctgctcgttactgggcatcaacccgggaatctggggtccctgaccgattcagtggcagcgggtctgagacacatttcactctcaccatcagcagcctgcaggctgaagatgtggcagtttattactgtcaacagcattatactactccgtactactttggcctaggggaccaagctggagatcaagcgaactggtggctgcacatctgtctcatctccgc

SEQ ID NO: 36401 - DNA, 495 bp, Homo sapiens
  misc_feature: GYAE6OF02GZATH.14.42.D09.1.454.CMB.1.raw
  modified_base (339)..(339): a, c, t, g, unknown or other
  misc_feature (339)..(339): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgttactggcatcaacccggatcgtgggtccctgaccgattcagtggcagcgggtctgagacanatttcactctcacatcagcagcctgcagctgaagagtgtggtctagtttattacgtgtacaacagcattatactactcctactacgtttcgccgacgggaccagctggagatacgaagcgactggtgctcgcaccatctctcttctactcctccgc

SEQ ID NO: 36402 - DNA, 528 bp, Homo sapiens
  misc_feature: GYAE6OF02JXOR1.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactcccctggctgtgtctctgggcgagagggccaccatcaactgcaagtccagccagagtgttttatacacctccaacaataagaacctcttaaaatggtaccagcagaaaccaggacagcctcctaagctgctcgtttactgggcatcaacccgggaatctgggtccctgaccgattcagtggcagcggtctgagacacatttcactctcaccatcagcagcctgcaggctgaagatgtgctagtttatactgtacaacagcattatactactccgtactacttttggcctaggggaccaagcctaggacgatcaagcgtaactaggtggacttggacctaccgtaattccttcggttccttccaacttccttaccccggtaccc

SEQ ID NO: 36403 - DNA, 517 bp, Homo sapiens
  misc_feature: GYAE6OF02IQFNB.14.42.D09.1.454.CMB.1.raw
  modified_base (208)..(208): a, c, t, g, unknown or other
  misc_feature (208)..(208): n is a, c, g, or t
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaattggtaccagcagaaaccaggacagcctcctaagctgctcgttactggcatcaacccgggaatctggggtccctgaccgattcagtggcagcggtctgagacacatttcactctcaccatcagcagcctgcaggctagaagatgtgntagtttatactgtacaacngcattatactactccgttactctttggaccgtagggaccaagcgtaggagtatacgaagcgaacgtggtcgtctcggactacccgattctcgttcttcacttccgttcccgtacc

SEQ ID NO: 36404 - DNA, 493 bp, Homo sapiens
  misc_feature: GYAE6OF02GRC7A.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgtttactgggcatcaacccgggaatctggggtccctgaccgattcagtggcagcgggtctgagacacatttcactctcaccatcagcagcctgcaggctgaagatgtggcagtttattactgtcaacagcattatactactccgtactactttggccaggggaccaagctggagatcaagcgaactgtggctgcaccatctgtcttcatcctcccgc

SEQ ID NO: 36405 - DNA, 526 bp, Homo sapiens
  misc_feature: GYAE6OF02I630Q.14.42.D09.1.454.CMB.1.raw
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (469)..(469): a, c, t, g, unknown or other
  misc_feature (469)..(469): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatgacccagtcgccagactccctggctgtgtctctgggcgagagggccaccatcaactgcaagtccagccagagtgttttanacacctccaaacaataagaacctcttaaaattggtaccagcaagaaaccaggacagcctcctaagctgctcgtttacngggcatcaacccgggatctggggtccctgaccgattcagtggcagcgggtctgagacacatttcactctcaccatcagcagcctgacaggtctagaagatgtggctagtttattactgttcaaactagacattactacttactccgtaactcttttacgccgtaggggacctaagctggaanagacgagacgtagtggtcgtctacgactacagtctcgttctactacttcctcctacc

SEQ ID NO: 36406 - DNA, 553 bp, Homo sapiens
  misc_feature: GYAE6OF02JMCZ2.14.42.D09.1.454.CMB.1.raw
  modified_base (207)..(207): a, c, t, g, unknown or other
  misc_feature (207)..(207): n is a, c, g, or t
  modified_base (280)..(280): a, c, t, g, unknown or other
  misc_feature (280)..(280): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgtttanacacctccaacaataagaacctcttaaattggtaccagcagaaaccaggacagcctctaagctgctcgttacnggcatccaaccgggatcgtcggggtccctgaccgattcaggtggcaggcgggtctggacgacacatttcactctcaccatacagcagcctgcgaggctagaagatggtggtctagtttatactgtacaacagactattatacttactccgtaacttacgtttacggaccgaacggggaccaagtcgtaggatacgtacgaacgacgtaacgtggtcggtactcggaaccacctacgtcgttcgttacgttcctacgttcccttacccgtaccg

SEQ ID NO: 36407 - DNA, 575 bp, Homo sapiens
  misc_feature: GYAE6OF02H9C98.14.42.D09.1.454.CMB.1.raw
  modified_base (382)..(382): a, c, t, g, unknown or other
  misc_feature (382)..(382): n is a, c, g, or t
tcagcgtctagtaccacgaccggtgctcgatttagacacatacgcagggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttaacacctcaacaataagaacctctttaaaattggtaaccagcaagaaaccaggacagcctctaagctgctcgttactggcatacaaccggaatcgtggggtccctgaccgattcgagtgcagcgggtctgagacactatttcactctcgaccatcagcagcctgcagctgaagatgnggctagtttatactgtacaacgagacaatttataactactaccgttactacgttttacggccgtaacggggacctaacgccttagggaactactacgaaacgcgtaaacgtcggttggaccgttacgaccgtaaccctaagttcccttaggtttacctttaccgtaactttaccccgtttcccccggtaaccc

SEQ ID NO: 36408 - DNA, 531 bp, Homo sapiens
  misc_feature: GYAE6OF02JG0Z5.14.42.D09.1.454.CMB.1.raw
  modified_base (207)..(207): a, c, t, g, unknown or other
  misc_feature (207)..(207): n is a, c, g, or t
  modified_base (458)..(458): a, c, t, g, unknown or other
  misc_feature (458)..(458): n is a, c, g, or t
tcagcgtctagtaccacgaccggtgctcgatttagacacatacgcagggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaatggtaccagcagaaaccaggacagcctcctaagctgctcgtttactgggcatcaacccgggaatctggggtccctgaccgattcagtggcagcgggtctgagacacatttcactctcacatcagcagcctgcagctgaagatgtggctagtttattactgtacaacagacattatactactccgtaactacttttacggccgaaggggtaccaagcctagganaatacgaagcgtaaacgtggtacggcttgaccgacctatccgttcgttcttactacttacccgttccccgacc

SEQ ID NO: 36409 - DNA, 502 bp, Homo sapiens
  misc_feature: GYAE6OF02GA7CI.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgtttactgggcatcaacccgggaatctggggtccctgaccgattcagtggcagcgggtctgagacacatttcactctcaccatcagcagcctgcaggctagaagatgtggctagtttattactgtcaacagcattatactactccgtactacttttggccgaggggtaccaagctaggagatcaagcgaactggtggctgcaccatctgtcttcactcctccgacc

SEQ ID NO: 36410 - DNA, 519 bp, Homo sapiens
  misc_feature: GYAE6OF02HV774.14.42.D09.1.454.CMB.1.raw
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaattggtaccagcagaaaccaggacagcctcctaagctgctcgtttacngggcatcaacccgggatcgtggggtccctgaccgattcagtggcagcggtctgagacacatttcactctcaccatcagcagcctgcaggctagaagatgtggctagtttatactgtacaacagactattatactactccgttactacgttttaggcctaaggggaccaagcgttaggaagactacgaagcgtaacgtggtggctcggcaccgatcgtgttcttcattccgttctcg

SEQ ID NO: 36411 - DNA, 519 bp, Homo sapiens
  misc_feature: GYAE6OF02JKNID.14.42.D09.1.454.CMB.1.raw
  modified_base (208)..(208): a, c, t, g, unknown or other
  misc_feature (208)..(208): n is a, c, g, or t
  modified_base (338)..(338): a, c, t, g, unknown or other
  misc_feature (338)..(338): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaattggtaccagcagaaaccaggacagcctcctaagctgctcgtttactgggcatcaacccgggatcgtggggtccctgaccgattcagtggcagcgggtctgngacacatttcactctcaccatcagcagcctgcaggctagaagatgtggctagtttattactgtacaacagctattatactacctccgtactacttttggaccgtaggggaccaagctaggagatcaacgcgaactggtacggctaggccactacgtctcgtcttctacttccttcccgtcc

SEQ ID NO: 36412 - DNA, 589 bp, Homo sapiens
  misc_feature: GYAE6OF02JBLUT.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaaattggtaccagcagaaaccaggacagcctcctaagctgctcgtttactgggcatcaacccgggaatcgtggggtccctgaccgattcagtggcagcgggtctgagacacatttcactctcacatcagcagcctgcaggctagaagatgtggctagtttacttacgtgtaccaacgtagtctagttataccttactccgtaactacgttttccggccgtaacggggacctaaggccgttaggaaggtaacttacgaaacggaccgaacgttggtacgggccttaggacccgtaacccgtatttacccgttacggtttacctttccgtacctttccccgttaccccggtaccccc

SEQ ID NO: 36413 - DNA, 508 bp, Homo sapiens
  misc_feature: GYAE6OF02H694R.14.42.D09.1.454.CMB.1.raw
  modified_base (363)..(363): a, c, t, g, unknown or other
  misc_feature (363)..(363): n is a, c, g, or t
  modified_base (474)..(474): a, c, t, g, unknown or other
  misc_feature (474)..(474): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgtttatacacctccaacaataagaacctcttaaattggtaccagcaagaaaccaggacagcctcctaagctgctcgtttactgggcatcaaacccgggaatctggggtccctgaccgattcagtggcagcggtctgagacactatttcactctcaccatcancagcctgcaggctgaagatgtggctagtttattactgtacaacagcaattactactactccgtactacttttggccaggggaccaagctaggagatacaagcgaacgtggnggctgcctacatctgtcttcacttcctccgtacc

SEQ ID NO: 36414 - DNA, 512 bp, Homo sapiens
  misc_feature: GYAE6OF02J2PA0.14.42.D09.1.454.CMB.1.raw
  modified_base (208)..(208): a, c, t, g, unknown or other
  misc_feature (208)..(208): n is a, c, g, or t
  modified_base (480)..(480): a, c, t, g, unknown or other
  misc_feature (480)..(480): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaatggtaccagcagaaaccaggacagcctcctaagctgctcgtttactgggcatcaacccgggaatctgggtcctgaccgattcagtggcagcggtctgagacacatttcactctcaccatcagcagcctgcacggctaggaagactagtggctagttttactactagtcaactagactattactactactccgtactactttcggcctaggggaccagctggagatcaagcgaatggtcggtacncgccactatctcgtcttccattcctcccgtac

SEQ ID NO: 36415 - DNA, 515 bp, Homo sapiens
  misc_feature: GYAE6OF02HC9RR.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaaattggtaccagcagaaaccaggacagcctcctaagctgctcgttactgggcatcaacccgggaatctgggtccctgaccgattcagtgcagcgggtctgagacacatttcactctcaccatcagcagcctgcaggctgaagatgtgctagtttatacgtgtacaacagactatttatactactccgtactacgtttacggccaggggaccaagtctggacgatacgaagcgaactggtggctgaccacagtctcggttcttctacttccttccccgacc

SEQ ID NO: 36416 - DNA, 544 bp, Homo sapiens
  misc_feature: GYAE6OF02IT24S.14.42.D09.1.454.CMB.1.raw
  modified_base (283)..(283): a, c, t, g, unknown or other
  misc_feature (283)..(283): n is a, c, g, or t
  modified_base (384)..(384): a, c, t, g, unknown or other
  misc_feature (384)..(384): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcaagaaaccaggacagcctctaagctgctcgtttacnggcatcaacccgggaatcgtgggtaccctgaccgattcgagtggcaggcggtctgagacacatttcactctcaccatcagcagcctgccagctgaagatgnggctagtttattactgtacaacagcaattatactactccgtactacttttcggaccgacggggaccaacgtacgtggaagaatacgaagacgtaacgtcggtggtcctgacctacctagttaccttcggttccttactaacgttcccttccccggtaccc

SEQ ID NO: 36417 - DNA, 837 bp, Homo sapiens
  misc_feature: GYAE6OF02J14A1.14.42.D09.1.454.CMB.1.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
tcagcgtctagtaccacgaccggtgctcgatttagacacatacgcagggcgagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacncctcaacaataacgaacctcttaaaattggtaccagacagaaaccaggacaggcctccttaagctagccttcgttttactcgggcatccgaacccggggaatccgttcgggggtccccttcggacccggtattaccgtacggtggtacccgagggtcccgggggttcttacggaacggaaccgtaaccgtaacgtttttcccaaaccgtttccttaccctaacccctaaacttacccgaaacgtccgaaaccggtcccgttacggccgtacgggtaccgttaacgggaaagtaacgttcgggtacggtacgttaacggtttttaagtttaaccgttcgttaacgaaacccgtagttaccgttaaacttttaacgttaaccgtttaacccttacccgggtttaaaccttaccggtttttttaaccgggacccggtaaaccggggggtaaccctaaacggggtccgttaacggggtaacgtaacgttaaccgtaaaccggtaccggttaaacgttcgggttaccgggttaaccgttcggtaccccgtaacccggttaactttcccggtttaacgggttccctttttaaccggttaacccgtttaccccgttttccccccggtaacccg

SEQ ID NO: 36418 - DNA, 497 bp, Homo sapiens
  misc_feature: GYAE6OF02FJN7T.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgtttactgggcatcaacccgggaatctggggtccctgaccgattcagtggcagcgggtctgagacacatttcactctcaccatcagcagcctgcaggctgaagatgtggcagtttattactgtcaacagcattatactactccgtactactttggccaggggaccaagctggagatcaagcgaactgtggctgcaccatctgtcttcacttcctcccgacc

SEQ ID NO: 36419 - DNA, 563 bp, Homo sapiens
  misc_feature: GYAE6OF02GP5JI.14.42.D09.1.454.CMB.1.raw
  modified_base (208)..(208): a, c, t, g, unknown or other
  misc_feature (208)..(208): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctaccaacaataagaacctcttaaattggtaccagcaagaaaccaggacagcctacctaaagctgctcgtttactgggcatcaacccgggatcgtgggtccctgaccgattcagtggcagcgggtctgagacatatttcactctcaccatcagcacgcctgacaggctagaagatgtggctagtttattactgtacaacagactattataactactaccgttacttacgtttcggacccgtaacggggaacccgaaggtcgtaggaacgtaacttacgaaagacgtaaccgttggtcggtactcggacctacctatcgttacgttacctttacacttcccgtacccgtacc

SEQ ID NO: 36420 - DNA, 575 bp, Homo sapiens
  misc_feature: GYAE6OF02H7Y7V.14.42.D09.1.454.CMB.1.raw
  modified_base (212)..(212): a, c, t, g, unknown or other
  misc_feature (212)..(212): n is a, c, g, or t
  modified_base (404)..(404): a, c, t, g, unknown or other
  misc_feature (404)..(404): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagacctccctggctgtgtctcgtgggcgagagggccaccatcaactgcaagtccagcccagagttgttttanacaccctaccaacaataaagaacctacttaaattggtaccagacagaaaccaggacagcctacctaagctgtctacgtttactgggacataccaaacccggatcgtacgggtccctgaccgattcgagtggcagcggtctgagacactatttcactctacaccatcagcacgcctgcaggctagaagagtgnggtacttagtttattacgtgtacaacagtactaattaacttacctactaccgttaacttaccgtttggaccaacggggtaccaaggtcttaggactaagtacaagacgaacgtggcggacttcggacctacgtagtacttcgtaccttaccgtacttcccgtacccgtacc

SEQ ID NO: 36421 - DNA, 527 bp, Homo sapiens
  misc_feature: GYAE6OF02FTVJL.14.42.D09.1.454.CMB.1.raw
  modified_base (295)..(295): a, c, t, g, unknown or other
  misc_feature (295)..(295): n is a, c, g, or t
  modified_base (345)..(345): a, c, t, g, unknown or other
  misc_feature (345)..(345): n is a, c, g, or t
  modified_base (417)..(417): a, c, t, g, unknown or other
  misc_feature (417)..(417): n is a, c, g, or t
  modified_base (492)..(492): a, c, t, g, unknown or other
  misc_feature (492)..(492): n is a, c, g, or t
tcagcgtctagtaccacgaccggtgctcgatttagacacatacgcaggggcaggcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttagtaccacctccaaacaataacgaaccttacttaaaattcggtaacccagcaagaaacccaggacagcctctaagctgctcgtttacngggcatcaacccgggatcgtgggtccctgaccgattcagtgcagtcggtntgagacacatttcactctcacatcagcagcctgcaggctagaagatggtggactagtttattactgtacaanagactaattactactactccgtactacgtttgaccgacgggaccagtctaggagtatcgaagcgaacgtggtcgntcgcaccagtcgtcgtccttcacttccttcccacc

SEQ ID NO: 36422 - DNA, 535 bp, Homo sapiens
  misc_feature: GYAE6OF02FYPRX.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaaattggtaccagcagaaaccaggacagcctcctaagctgctcgtttactgggcatcaaccgggaatcgtgggtccctgaccgattcagtggcagcggtctgagacacatttcactctcaccatcagcagcctgcaggctgaagatgtggctagtttattactgtacaacgagctattactactactccgtactacgttttacggaccgtaacggggaccaagctaggaagtacgtacgaagcgaacgtggtggactcgaccacctacttcgtcgttccttctacttcccgttacccaccg

SEQ ID NO: 36423 - DNA, 527 bp, Homo sapiens
  misc_feature: GYAE6OF02I52V1.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgtttactgggcatcaacccgggatcgtggggtccctgaccgattcagtggcagcgggtctgagacacatttcactctcaccatcagcagcctgcaggctagaagatgtggctagtttattactgtacaacagctattactactacctccgttactacgttttcggaccgacggggtaccaagtctaggagtactacgaagcgaactggtcggctgacctaccatctcgttcttcacttcccttcccgtacc

SEQ ID NO: 36424 - DNA, 594 bp, Homo sapiens
  misc_feature: GYAE6OF02JC9FN.14.42.D09.1.454.CMB.1.raw
  modified_base (208)..(208): a, c, t, g, unknown or other
  misc_feature (208)..(208): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaattggtaccagcagaaaccaggacagcctcctaagctgctcgttactgggcatcaacccggatctgggtccctgaccgattcagtggcagcgggtctgagacacatttcactctcacatcagcagcctgcaggctagaagatgtggactagtttattactgtacaacagactaattactaaccttactccgttaactacttttcgggtaccgagggggtaacccaaggtcgttagggaactagtacgaacggtcgtaaacgttgggtacgggtaccttacgggaccctaacccgtaacgtttcccgttacggtttacccttttaccgtaaccgtttccccgttacccccggtaaccccg

SEQ ID NO: 36425 - DNA, 503 bp, Homo sapiens
  misc_feature: GYAE6OF02GL2IJ.14.42.D09.1.454.CMB.1.raw
  modified_base (452)..(452): a, c, t, g, unknown or other
  misc_feature (452)..(452): n is a, c, g, or t
  modified_base (479)..(479): a, c, t, g, unknown or other
  misc_feature (479)..(479): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgttactgggcatcaacccgggaatctgggtccctgaccgattcagtgcagcgggtctgagacacatttcactctcaccatcagcagcctgcaggctgaagatgtggctagtttattacgtgtcaacgtagctattatactactcctactactttcggccgagggaccagctagganatcaagcgaactggtggctcgccaccntcgtgtcttcgacttcctccctcc

SEQ ID NO: 36426 - DNA, 631 bp, Homo sapiens
  misc_feature: GYAE6OF02HNANN.14.42.D09.1.454.CMB.1.raw
  modified_base (208)..(208): a, c, t, g, unknown or other
  misc_feature (208)..(208): n is a, c, g, or t
  modified_base (280)..(280): a, c, t, g, unknown or other
  misc_feature (280)..(280): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaattggtaccagcagaaccaggacagcctctaagctgctcgttacnggacatcaacccgggaatccgtcggggtccctggaccgtattcgagtggcacggcgggtctggacgaactactactttcgactccgtacaccatcgagcgacgcctggccaggctaggaagagtggtcggacttaaggtttacttacgtagtacaaacgtagtactaatttaagtaccttacgttaccggttaacttaccgttttacgggacccgtaacggggtaacctaaggtccgtagggtaacgtaacgtacgaacggtacggtaacgttcgggtacggtaccgtacggtaacctaacccgtagttaccgttcgttaccttacgtaacgttcccgttaccccgtaccg

SEQ ID NO: 36427 - DNA, 523 bp, Homo sapiens
  misc_feature: GYAE6OF02HKMVI.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaaattggtaccagcaagaaaccaggacagcctcctaagctgctcgttactgggcatcaacccgggatcgtgggtccctgaccgattcagtggcaggcggtctgagacactatttcactctcacatcagcagcctgcagctagaagatgtggctagtttattactgtacaacagactattatactactaccgtactacgtttggaccgaaggggaccaagtcgtaggacatacgaagacgaactggtacggctcgactaccgatctcgtcttcgtactcctcccgtaccg

SEQ ID NO: 36428 - DNA, 536 bp, Homo sapiens
  misc_feature: GYAE6OF02FUORL.14.42.D09.1.454.CMB.1.raw
  modified_base (231)..(231): a, c, t, g, unknown or other
  misc_feature (231)..(231): n is a, c, g, or t
  modified_base (409)..(409): a, c, t, g, unknown or other
  misc_feature (409)..(409): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctnttaaattggtaccagcagaaaccaggacagcctcctaagctgctcgtttactgggcatcaacccgggaatcgtggggtccctgaccgattcagtggcaggcgggtctgagacacatttcactctcaccatcagcagcctgcaggctgaagatggtggctagtttattacgtgtcaacngactattatactactccgtaactacgtttggaccacggggaccagcgtaggagactacaaagcgaaacgtggtacggcgtcgacctaccgagttccttgttacctttcacttcccgttcccgtaacc

SEQ ID NO: 36429 - DNA, 609 bp, Homo sapiens
  misc_feature: GYAE6OF02GF1PY.14.42.D09.1.454.CMB.1.raw
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
  modified_base (323)..(323): a, c, t, g, unknown or other
  misc_feature (323)..(323): n is a, c, g, or t
tcagcgtctagtaccacgaccggtgctcgatttagacacatacgcagggcagcaagatggtgttgcagacccaggtcttcatttctctgttgctctggatctctggtgcctacggggacatcgtgatgacccagtcgccagacttccctggctgtgtctctgggcgagagggccaccatcaactgacaagtccagccagtagtgttttanacacctcaaacgaataagaacctnttaaaattggtaaccagcagaaaccaggacagcctacaagctgctgtttactggacactcgaaacccgggaatccgcggggttaccccnggaccgtattccgagttcggacacggtcgggtctcggaagactacgattttcactactcaacccagtccagcctaaggccctagcgtaagctaggaatacgtgtacgctaagtttacttactcgtactaacgagcttaattactactacgttacccgtaattaacctttcggtaccaacgggggtaaccctaaacgcgttacggaagaacgttagaaccgcgtaaaccgtgtaacgggccttaggccaaccgtatacgtcgttacctttcacgtttcacccgtccg

SEQ ID NO: 36430 - DNA, 665 bp, Homo sapiens
  misc_feature: GYAE6OF02JPWU9.14.42.D09.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
tcagcgtctagtaccacgaccggtgctcgatttagacacatacgcagggcgagcaagatggtgttgcagacccaggtcttcatttctctgttgctctgatctctggtgcctacggggacatcgtgatgacccagtcgccagacctccctggctgtgtctctgggcgagagggccaccatcaactgcagtccagccaggagttgtttanacacctccaanaagtaagaaccttcttaaagttcggaaccagcaaacgaaaccaggaactacgcctaccgtaaacgtctacgcttacgtttactggggtcctaagtcaaccccgggaattccgtacggggtccctaggtacccgtagttcgaacgttgggaccaggtccggggttctacggtacggaccactaacgttttccaacttctaccacctagctacgactaggccctcgcgacggcgtagaagtagtacggtggcttaagtttattacgttacggtactaacgacgttacaagttactacgttactaccgttactacgttttacgccgtacgggaaccgtaacggtacgtacgggacgtacgtacgaaccgtcgtaacgtcggtacggtacgtcgacccgtaccgtacgtaccgtttcgtaccgtttacctcgtttccgttacccggtccc

SEQ ID NO: 36431 - DNA, 795 bp, Homo sapiens
  misc_feature: GYAE6OF02H45NX.14.42.D09.1.454.CMB.1.raw
  modified_base (160)..(160): a, c, t, g, unknown or other
  misc_feature (160)..(160): n is a, c, g, or t
  modified_base (207)..(207): a, c, t, g, unknown or other
  misc_feature (207)..(207): n is a, c, g, or t
  modified_base (408)..(408): a, c, t, g, unknown or other
  misc_feature (408)..(408): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctntgggcgagagggccaccatcaactgcaagtccagccagagtgtttanacacctccaacaataagaacctcttaaattcggtaccagcaagaaccaggacagcctcctaagctagctcgttactgggactataccaaccgggtaattccgtcggggtacccctagtaccgaagttcctaaggtcggacgacggtccggggtcttaggacggaactaccgtagtttccacctcttacacctaagtccaancgaaccgtccgtacggaccgtaagggtccgtaggaaacgtaagttcggtacgggtacgttaacggttttaattaaacccgtttgtaaccgtaaacgtaaccggtaccttaaactttaacgtttaaacccgttaacccttaacccggttttaactttaaacccggttttttaaccggggtacccgtaaaccgggggggttaaacccaaaccgggttaaccggttacggggtaaacgttaaaccggttaaccgtaaaaccggttaccggttaaacccggtttacggttaccggggtaacccgttaccggtacccgtaaacccgtagtttaccccggtaggtttacccctttacccgttaaacgttttccccgttacccccggttaaccc

SEQ ID NO: 36432 - DNA, 632 bp, Homo sapiens
  misc_feature: GYAE6OF02HJKDH.14.42.D09.1.454.CMB.1.raw
  modified_base (297)..(297): a, c, t, g, unknown or other
  misc_feature (297)..(297): n is a, c, g, or t
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgaggagggccaccatcaactgcaagtccagccagagttgttttatacacctaccaaacaaataaacgaacctactttaaaattggtaaccagacaagaaaaccaggacagcctactaagctgcttcgttacnggcagtaccaacccgggaatccgtcggggtccctagaccgtattcgagtggctaggcggtntgagactactatttcacttctacacactcacgcacgcctgcgacgctagaagngtcgtaggcttaagtttattacgtgtacaagtacgacttaattaacttaactacctaccgttaacttaccgttttacgggacccgtaacggggtaaccaacggtccgttaggaagtaacgtacgaacggtaccgttaagtcgggttcggacctccgaaccgtacccgttaagttccgttacggtttacctttccgtaccgtttaccccgttccccgtaccg

SEQ ID NO: 36433 - DNA, 598 bp, Homo sapiens
  misc_feature: GYAE6OF02IFZ11.14.42.D09.1.454.CMB.1.raw
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
tcagcgtctagtaccacgaccggtgctcgatttagacacatacgcaggggcgagcaagatggtgttgcagacccaggtcttcatttctctgttgctctggatctctggtgcctacgggacatcgtgatgacccagtcgccagactccctggctgtgtctctgggcgagagggccaccatcaactgcaagtccagccagagttgttttanacacctccaacaataagaaccttacttaaattggtaccagcaagaaaccaggacagcctcctaagctgctcgtttacngggcatccaacccgggaatcgtcggggtccctgaccgattcgagtgcagcggtctgagacatatttcactctacgaccatcagcacgcctgacgaggctagaagatgtggctagtttatactgtcaacacgcattaatacttactaccgttactaccgttttcggaccgtacggggtaacctaacggtcgttagggaacgtacgtacgaacggaccgtaaacgttgggtcggtccgtacggtaccctaacccgtaaccgttcccttcggttaccctttacctacgttttaccccgtaccccgttaaccccg

SEQ ID NO: 36434 - DNA, 691 bp, Homo sapiens
  misc_feature: GYAE6OF02FGHYO.14.42.D09.1.454.CMB.1.raw
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagttgttttatacacctccaaacaaataacgaaccttcttaaaattggtacccagcaagaaaccaggacagcctactaagctgctcgtttacgtggcatacgaacccgggaatccgtacggggtccctggaccgtattcagtggcaggcgggtntgagacactattcactcncacatcagcagcctgcaggctaggaagtagtggtacggtacttaagttttaacgtttacctaggtacctaaacgacgtaccttaattttaaacgttaaccttaacccgtttaacccgttaacttaaccggtttttacgggaacccggtaacggggggtaaaccctaaaggtccgttaacgggtaaacggtacgttaccgaaacgggtaccggtaaaccggtcgggttaacgggtacccgtacggtaaccctaacccgttaacggttccgtttaccggttttaccttaccgtacccgtttccccgtttacccccggtaaccc

SEQ ID NO: 36435 - DNA, 649 bp, Homo sapiens
  misc_feature: GYAE6OF02JOJ4I.14.42.D09.1.454.CMB.1.raw
  modified_base (207)..(207): a, c, t, g, unknown or other
  misc_feature (207)..(207): n is a, c, g, or t
  modified_base (254)..(254): a, c, t, g, unknown or other
  misc_feature (254)..(254): n is a, c, g, or t
  modified_base (280)..(280): a, c, t, g, unknown or other
  misc_feature (280)..(280): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgtttanacacctccaacaataagaacctcttaaattggtaccagcagaaaccnggacagcctctaagctgctcgtttangggacataccgaacccggatcgtcgggtccctggaccgtattcaggtggacgaggtccggggttactaggagacctaacgtacttttacgaccttctacaccataccacgtaccaacggtccctagaccgtacgggccgtaagaaacggacgttcgggtaggtaccgtaaagtttttacgttaacgttcgtaaccaaacgttacgactaatttaactaaccttaccgtaccttaacgttcgtttcgggaccgtaggggtaacccagtcgtaggtaactacgtaacaacggacgtaacgtggtacggtactacggaaccctacgtacgttccgttacggttccttacgaccgtttaccctcccggtaacc

SEQ ID NO: 36436 - DNA, 533 bp, Homo sapiens
  misc_feature: GYAE6OF02HJ3QN.14.42.D09.1.454.CMB.1.raw
  modified_base (467)..(467): a, c, t, g, unknown or other
  misc_feature (467)..(467): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaacctcttaaattggtaccagcagaaaccaggacagcctcctaagctgctcgttactgggcatcaacccgggaatcgtggggtccctagaccgattcagtggcagcgggtctgagacactatttcactctcaccatcagcagcctgcgaggctagaagagtgtggactagtttattactgtacaactagactaattatactactcccgtacttacgtttcggccgagggaccagcgtagganagtacaagcgtaagtggtcgcgtcgccaccgtattcgttcgtcctttacacttcccttcccgtacc

SEQ ID NO: 36437 - DNA, 593 bp, Homo sapiens
  misc_feature: GYAE6OF02H8DG5.14.42.D09.1.454.CMB.1.raw
  modified_base (208)..(208): a, c, t, g, unknown or other
  misc_feature (208)..(208): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaacctcttaaaattggtaccagcaagaaaccaggacagcctcctaagctagctcgtttactgggacatcaacccgggatcgtcggggtccctgaccgattccgagttggcaggcgggtctgagcacactttcactcncaccatcancagcctgcagcngaantgtgctgtttacttactgtacaacagactattatactactacccgttactacgttttcggaccgaacggggtaccaacgtacgtagggaacgtaacgtacgaacggacgtaaccgttaggttacggtaccgtacggaccctaacccgtagttccgttacggtttacctttaccgtttaccttacccccgttaccccgttaaccccg

SEQ ID NO: 36438 - DNA, 598 bp, Homo sapiens
  misc_feature: GYAE6OF02GBLNE.14.42.D09.1.454.CMB.1.raw
  modified_base (208)..(208): a, c, t, g, unknown or other
  misc_feature (208)..(208): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctcaaacaataaagaacctacttaaattggtaccagcaagaaaccaggacagcctcctaaagctgctcgtttactggcatcgaaacccgggtaatcgtggggtccctgaccgtattcagtgcagcggtntganacatatttcactcacaccatcacgcagtcctgcgagtctagaagtagtgtaggactaagtttattaactcgtacaacgtagtactaattaactaactacctaccgttaacttacgttttacggaccgtacggggaacctaacgtcgtaggaacgtaacgtacgaaacgtacgtaaccgtgggtacggtaccgtacggaacctaccgtacttcgttacggttacctttactaccgttacccttaccccgtaccg

SEQ ID NO: 36439 - DNA, 582 bp, Homo sapiens
  misc_feature: GYAE6OF02GF3IZ.14.42.D09.1.454.CMB.1.raw
  modified_base (209)..(209): a, c, t, g, unknown or other
  misc_feature (209)..(209): n is a, c, g, or t
  modified_base (385)..(385): a, c, t, g, unknown or other
  misc_feature (385)..(385): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcaggagggccaccatcaactgcaagtccagccagagttgttttanacacctccaacaataacgaacctcttaaattggtaccagcagaaaccaggacagcctcctaagctgctcgtttactgggctatacaacccgggaatctaggggtccctcggaccgtattcaggttggcaggcgggtcctgacgacactatttcactctcaccatcagcagcctgcnggctagaacgtatggtcgtcgtagtttacttacgtcgtacaacagtactaagttactacttacctccgttacttacgtttcggacccgacgggtaccaacgtcgtaggacgtatacgaagtaccgaagtcggtaggccttcggaccctaaccgtacgttaccttcgttccttactcctttccccgttcccgtacccg

SEQ ID NO: 36440 - DNA, 765 bp, Homo sapiens
  misc_feature: GYAE6OF02JEFFG.14.42.D09.1.454.CMB.1.raw
  modified_base (215)..(215): a, c, t, g, unknown or other
  misc_feature (215)..(215): n is a, c, g, or t
  modified_base (327)..(327): a, c, t, g, unknown or other
  misc_feature (327)..(327): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggcgagagggcccaccatcaacgtgacaacgtccagccagtagttgttttanaccacctaccaaacaaataacgtaacccttacttaaaagttcggtaacccagaccaacgaaaaccagggaccaggtcccctactaacggcttcgacctttcggttttaacgngggacctacgttacccgaacccgggtaattccgggtcggggtaccccagtaccgtattcgacggtcggacgacgggtccgggtatagacgtacctactactttaccacctccgtaccaccgtactaccgacgtaccacggccgttacggaccgtagggtacctaaggtaaacgtggttacggtaggtacgtttaaggtttacttacgtacgtaacctaaggtacttaacttacttaccgttaaccttacccgttaccgtaaccgtttcgggttaccgggtaccggaacgggttaacccgtaggtaccggtaacgtaaacgtcgtaacgaacggtaccgttaacggtcggtacgggtaacccttacggaacccttaaccttcggttaacccgttacgtttccccttaacggtccctttacccccgttacccgttaaccg

SEQ ID NO: 36441 - DNA, 569 bp, Homo sapiens
  misc_feature: GYAE6OF02IWPF7.14.42.D09.1.454.CMB.1.raw
  modified_base (208)..(208): a, c, t, g, unknown or other
  misc_feature (208)..(208): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaaacaataacgaacctcttaaaattggtaccagcagaaaccaggacagcctcctaagctgctcgttactgggcatacgaacccgggatcgtgggtccctgaccgattcgagtggcagcggtctgacgacaactatttcacctctcaaccatcagcagcctgcagctgaacgatgtgactagtttatactgtacaacagctatatactactccgtactactttacggaccgagggaccagaccgttaggaacgaactaccaaggccgtaaacgtggtacggtacgttacggaccctaaccgtacgttacgttccggttaccttacgtaacctttacccgttaccccgtaacccg

SEQ ID NO: 36442 - DNA, 580 bp, Homo sapiens
  misc_feature: GYAE6OF02GB4VX.14.42.D09.1.454.CMB.1.raw
  modified_base (423)..(423): a, c, t, g, unknown or other
  misc_feature (423)..(423): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttatacacctccaacaataagaaccttacttaaattggtaaccagcaagaaaaccaggacagcctcctaagctgctcgttactgggcatccgaacccgggaatccgtggggtccctgaccgattcagtggcagcgggtctggagacactatttcactctcacatcagcacgcctgcgacggctacgaagatgtggtactaggtttattacgtgacaacncgacttattactaccttacctaccgttacgttacgtttcggaccggtaacggggaccgtaaggtcctagggaacgtaacgtacaacggtaccgaagttggtcggtccgtacgccaccgtattccttgttaccttcgacctttcccgttcccgtaccc

SEQ ID NO: 36443 - DNA, 721 bp, Homo sapiens
  misc_feature: GYAE6OF02IBBD1.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagacctccctggctgtgtctcgtgggcgaggacgggccaccatcaactgacaacgtccagccagagttgttttaacacaaccctaccaaactaaataaacgtaaacccttacgttaaaatttcggtaacagacaacgaaaccaggacacgcctaccgtaagctcgtacttacggttaccgtgggtactaacgtacccggaaacccgggtaattccgggtccggggtccctacgaccgtattcgaggtcggcgaggtcgggtactacggaacgaccacttacgtttccaaccgttcctaccaacccagtaccgaacgtcgaaccgtcccgtcgacgtaacggtacgtaaggaacggtagttggtacggtaacgttagtttaacttacgtacgtaacaacgtacgtacttaacgttaaccttactaaccgtaccgttacgttaccggtttaccggaccggtaacggggtaccaacggtacgtagggataacgtaacgaacgggtactaacgtcggtacggtaccgtacgtaccctaacgtcgttacttcgttaccttacgttacccttccccgtaccgtaccg

SEQ ID NO: 36444 - DNA, 650 bp, Homo sapiens
  misc_feature: GYAE6OF02HKGD0.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacgggacatcgtgatgacccagtccgccagactccgtggctgtgtctcgtgggcgagagggccacatcaacgtgcaagtccacgcagtagttgttttacacacctacaaacaagtaacaaccttcttaaaattcggtaaccagacaagaaaccaggtacacgcctacctaagctacgtcttacgtttacgtgggactacgtaaccgaaccggggtaattccggtacgggggttccctacgtaccggtatttaccggaagttcgggacacgggtccggggtcttacgggaactaaccctagtacgttttccaacctttcctaccgaacctatacgaacggactaacggtcccgtacggccgagggtactaggaagtacgtggtacggtactaggttttactacgtacgtataccgagtacgtaattactaacgtcctacttacttacgttacggacgaacggactaagtgtcgatacgtagagacgtacgtcggtgccacgtccacgtattcgttcgtccttacgtctacccgcctacg

SEQ ID NO: 36445 - DNA, 895 bp, Homo sapiens
  misc_feature: GYAE6OF02JKU47.14.42.D09.1.454.CMB.1.raw
  modified_base (235)..(235): a, c, t, g, unknown or other
  misc_feature (235)..(235): n is a, c, g, or t
tcagcgtctagtaccacgaccggtgctcgatttagacacatacgcaggggcagcaagatggtgttgcagacccaggtccttcatttctctgttgctctggatctctggtgccgtacggggacatcgtgatcgacccagtcgccagacctccctggctgtgtctcgtgggcgagacgggccacactcaactgcaacgtccagccagtagttagttttaacacctacctacccaaanaaactaaacgtaaccttaactttaaatacggtaaccagaccaagaaacccgagaacgacgccctaacgtaacgcgttcgtaccgtttacgtttacggtcgggtaacctaaccttacccgaaaacccccggaggttaaaccgttaccggttccggggggttaccccctttacggaaaccccgttaaagttttcccggaaacgggtaccggtccggtaacggggtaccccgggtttacgttaacggggaaaacccggtaaccctaacccgggttttaaaccgttttcccgtaccctttaaaccccggttacccctaaacccgtaacgtttacccgtaaacggggacccgtaaacccggtttccccggtaaagggacccgtaacgggtaacccgggttaaaggtaaaccgtagttacccggggtttagttaacccgttttaacgggttttaacttaccgtttaaccgggaaactaacccggttaagttacttaaacgtttaacttacccggtaccgtttaaccggtacctttacggtttaccgggaacggaccggtaaccgtacgtacgtaccggtaagtacgtacgaacgttcgtaacgtcggtactcgtaaccgaccttagtacgtttccggatttccctacgtaccttccccgtaccccg

SEQ ID NO: 36446 - DNA, 714 bp, Homo sapiens
  misc_feature: GYAE6OF02JWUWJ.14.42.D09.1.454.CMB.1.raw
  modified_base (210)..(210): a, c, t, g, unknown or other
  misc_feature (210)..(210): n is a, c, g, or t
  modified_base (459)..(459): a, c, t, g, unknown or other
  misc_feature (459)..(459): n is a, c, g, or t
  modified_base (676)..(676): a, c, t, g, unknown or other
  misc_feature (676)..(676): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatgacccagtcgccagactccctggctgtgtctctgggcgagagggccaccatcaactgcaagtccagccagagtgtttttanaccacctaccaaacgaaactaaacgaacccttacgtttaaaacttcgggtaacccagtaccaaacggaaaacccgaacgggaactaccggacccctacctaaacggcctggttcccttacgttttaaccggtggggacctaacgtacccggaaaccccggggaattcggttcggggtccctagaccccggtattccggtaaggtcggaccgtagggtccggtcgtagacggacctacgttactttaccnccttactaccacctaactcgtaacgccgaacgtcctgggacctagggctaggaagcttggtacggtcttagttttaactcgttacgaaccgatagtctaaagtttactacgtaccgtccttattaccgttcggacggacgggtaacgtacgtaggtcggaaagtacgtaacgtacgaccgttagtcgggtacggctaccgaccgttacaaccgtttnttaccgttacccgttctaaccgttccctacccggtacc

SEQ ID NO: 36447 - DNA, 577 bp, Homo sapiens
  misc_feature: GYAE6OF02H2QSX.14.42.D09.1.454.CMB.1.raw
  modified_base (209)..(209): a, c, t, g, unknown or other
  misc_feature (209)..(209): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagttgttttanacacctccaacaataagaacctacttaaaattcggtaccagacaagaaaccaggacagcctcctaagctgctcgtttactgggcatcgaacccggatcgtggggtccctgaccgattcagtcggcaggcggtctgagacactatttcactctcacatcagcacgtcctgcaggctagaagtagtgtcggtactagttttatactgtacaacgtcgtactattaacttactactaccgttaactacgttttcggaccgtacgggaacctagtcgtagggactagtaccgaagtaccgtaacgtggtaggtccgtcgacctaccgtagttccttacgtttccttaccgtactttacccgtccccgtaacc

SEQ ID NO: 36448 - DNA, 597 bp, Homo sapiens
  misc_feature: GYAE6OF02IBE9S.14.42.D09.1.454.CMB.1.raw
  modified_base (208)..(208): a, c, t, g, unknown or other
  misc_feature (208)..(208): n is a, c, g, or t
  modified_base (289)..(289): a, c, t, g, unknown or other
  misc_feature (289)..(289): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataagaaccttacttaaattcggtaccagacaagaaaccaggacagcctcctaagctgcttcgtttacngggcatccgaaaccggattcgtggggtccctgaccgattcgagtcggcaggcggtcngagacactntttcactctcacatcancagcctgacgaggctagaagagtgtcggtactagtttacttacgtgtacaactagcttaattacttaactacctaccgtacttacgttttacgggaccgtaacggggtaccaacggtcgtacggatacgtacgaagtaccgtaacgttggtcgggtactcgtacccgtaacccgtagttccttacggttacctttaccgtaactttccccgttacccgtaacccg

SEQ ID NO: 36449 - DNA, 718 bp, Homo sapiens
  misc_feature: GYAE6OF02H5FPQ.14.42.D09.1.454.CMB.1.raw
  modified_base (210)..(210): a, c, t, g, unknown or other
  misc_feature (210)..(210): n is a, c, g, or t
  modified_base (298)..(298): a, c, t, g, unknown or other
  misc_feature (298)..(298): n is a, c, g, or t
  modified_base (382)..(382): a, c, t, g, unknown or other
  misc_feature (382)..(382): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggcgagagggccaccatcaactgcaagtccagccagagtgttttaanacacctacaacaataaagaacctacttaaaattcggtaacagacaacgaaaccaggaacacgcctacctaagctgtcttacgtttacngggactagtacccgaaaccgggtattccggtacgggtaccttacgaaccgtattacgacggtggacaacggtcgggtctagganaaccacgtattttccgaacttccacgaaccctagtaccaagtaccacgtaccttggacctaagggactaggtaaacgtagttggtacggtacgttaagtttaacttaacgtgtaactaaaccgagttactaacttaacgttaaccttaaccgtaaccgttaaccgttacgtttacgggacccgtaacggggaaccgtaacgtaccgttaggaacgtaacgtaccggaaacgtaccgtaacggttacgggtacggtaccgtttacggaaccgttaaccctacgttcccgttacggttaccctttaccgttaaccgtttccccgttacccgtaacccg

SEQ ID NO: 36450 - DNA, 582 bp, Homo sapiens
  misc_feature: GYAE6OF02IELW6.14.42.D09.1.454.CMB.1.raw
tcagcgtctagtaccacgaccggtgctcgatttagacacatacgcaggggcaggcaagatggtgttgcagacccaggtcttcatttctctgttgctctggatctctggtgcctacggggacatcgtgatgacccagtcgccagactccctggctgtgtctctgggcgagagggccaccatcaactgcaaggtccagccagagtgttttagtaccacctccaacaataagaaccttacttaaattcggtaccagcaagaaaccaggacagcctacctaagctgcttacgtttacgtgggcatccaacccgggaatcgtggggtccctggaccgtattcgagtcggcaggcgggtctggacgacactatttcactctcaccatcagcagcctagcagcagaagatgtggactaagtttattactcgtacaacgagtactaattaactactactaccgtactacgtttacggaccgacgggaaccaagtcgtaggagtatacgaacgacgtaacgttggtacggtacgtcgtaccgtacctagttccgttacgttaccgttacgtaccttcccttacccgtaccc

SEQ ID NO: 36451 - DNA, 761 bp, Homo sapiens
  misc_feature: GYAE6OF02H1R5A.14.42.D09.1.454.CMB.1.raw
  modified_base (319)..(319): a, c, t, g, unknown or other
  misc_feature (319)..(319): n is a, c, g, or t
  modified_base (429)..(429): a, c, t, g, unknown or other
  misc_feature (429)..(429): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatgacccagtccgccagacctccctggctgtgtctcgtgggcgaggagggccaccatcgaactcgcaacgtccagccagtagttgttttaacacacctacaaactaagggggtaactaacccttattaaattcggtaaccagcaagaaaccaggtaccatccctacctaaggctcggacttacgttttacgngggtaccagtaccgtaaccccgggaagttccgtacgggggtacccctggtaaccggaatttcgaagttacggactaagggtccggggttacgttacggaacggtaacccncgttaacggtttttacccaacgttccgttacaaacccttaagtaccgtaacgacctaacggtcccttacggtacggaacgggtcggttacgaacgtaggttacggtacggacgttagtttaacgttagtacgtacgaacctacggtactacttaaccttacttaacccgtaaccgtaccttaacgttttaccggaccggtaacgggaaccgtaacgacggttaggtaaacgacgttaaccggaagtaccggtaacgttaccgggacggttacaccgtacctaccgacttttaccgcgtttaccgttacttccccggttcccgtacttacccg

SEQ ID NO: 36452 - DNA, 653 bp, Homo sapiens
  misc_feature: GYAE6OF02INTAJ.14.42.D09.1.454.CMB.1.raw
  modified_base (209)..(209): a, c, t, g, unknown or other
  misc_feature (209)..(209): n is a, c, g, or t
  modified_base (437)..(437): a, c, t, g, unknown or other
  misc_feature (437)..(437): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagttgttttanaccacctaccaaacaataacgaaccttacttaaattcggtaaccagacaagaaaccagggacacgccctacctaaagctagccttcggtttacgtgggactactaccgaacccgggtaattccggtcggggtccctaggaccgtattcgagtcggctaggtcgggtctagagactactactttcaccttctacactactcgacgacacgcctgacaggtctagaagtntcggtgtacttagtttattacgtagtacaacgtgtacttaacgttaacttacctaccttaccgttacgttaccgttttacggaccgtaacgggaactacgacgttaggaacgtaactagaacggtacgtaacggttcggtaacggtctccggtaacctaccgtaacgtttccgttacgtttccgttaccgtactttacccccgtaccccgttaccg

SEQ ID NO: 36453 - DNA, 590 bp, Homo sapiens
  misc_feature: GYAE6OF02FZQ1B.14.42.D09.1.454.CMB.1.raw
  modified_base (232)..(232): a, c, t, g, unknown or other
  misc_feature (232)..(232): n is a, c, g, or t
  modified_base (283)..(283): a, c, t, g, unknown or other
  misc_feature (283)..(283): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggcgagagggccaccatcaactgcaagtccagccagagtgttttatacacctccaacaataagaacctnttaaattggtaccagcagaaaccaggacagcctctaagctgctcgtttacnggcatcaaccgggatcgtcgggtccctgaccgattcagtggcaggcggtctgagacactatttcactctcacatcagcacgcctgcaggctagaagatgtggctagtttatactgtacaacagactattactactactccgtacttacgtttcggaccgtaaggggacctaacggtcgtaggaaacgtacgtaccgaacggtaccgtaaacgttcgggtacgggtaccttaccggacccgtaacccgtaacgttccgttacggtttaccgtttaacccgtaacgtttcccccgttaccccgtacccg

SEQ ID NO: 36454 - DNA, 677 bp, Homo sapiens
  misc_feature: GYAE6OF02F47KB.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggcgagagggccaccatcaactgcaagtccagccagagttgttttaataccacctaccaaacaataaacgaacctactttaaaattcggtaccagacaagaaaaccaggacagcctacctaagctgccttcgtttacgtcgggactacgtaccgaaccccgggtaatccggttccggggttcccctggacccgtagttccgagggtcggcgacgggtcggggttactaggtacgacctactacttttccgaaccttcctaccaccgtatccagccgacgtcctcgcgacggtcgtaggaagtagtggtacgagttagttttacttacgtcgtacgtaacgtacattaacttacttacctactacccgttacttacggtttacggaccgtaacggggtaaccaacggttagtacggacgtacgtaacgtaagacggttaacgtcggtcggtccgtacgtacccgtacgtacgttacgttcgttaccgttacctaccgtttcccgtacccgtaccc

SEQ ID NO: 36455 - DNA, 596 bp, Homo sapiens
  misc_feature: GYAE6OF02GS3ME.14.42.D09.1.454.CMB.1.raw
  modified_base (208)..(208): a, c, t, g, unknown or other
  misc_feature (208)..(208): n is a, c, g, or t
  modified_base (323)..(323): a, c, t, g, unknown or other
  misc_feature (323)..(323): n is a, c, g, or t
  modified_base (381)..(381): a, c, t, g, unknown or other
  misc_feature (381)..(381): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgttttanacacctccaacaataacgaacctcttaaattgtaccagcaagaaaccaggacagcctacctaagctgcttcgtttactgggacataccgaacccgggtaatcgtacggggtcccngaccgtattcgagtggcaggcggtctgagacactacgtttcactctcactatcgaacncacgtcctgacgagtacctagaaacgtgtaggtcggacttaggttttaacttacgtagtacaacgagtactagttaacttaacctaccgttaccgttaacttacgtttcggaccggagggtaccaaggtcgtaggaagtacacgaacgtcgaactgggtacgcgtacgaccgtaccacgttcgttctccgttacgtaccttacccgtccctaccg

SEQ ID NO: 36456 - DNA, 588 bp, Homo sapiens
  misc_feature: GYAE6OF02F4VAB.14.42.D09.1.454.CMB.1.raw
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
  modified_base (424)..(424): a, c, t, g, unknown or other
  misc_feature (424)..(424): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcagagggccaccatcaactgcaagtccagccagagtgttttanacacctccaacaataacgaacctcttaaattggtaccagcaagaaaccaggacagcctctaaagctgctcgtttacngggacagtcaaacccgggaatcgtcggggtccctgaaccgtattcagtggacaggcggtctgagacatactttcacctctcaccatcacgcagcctgcgagctagaagtatggtggtactagtttacttactgtacaacngtcttaacttactaactaccgttaccgtaacgttacgtttaccgggccggtaaccgggtaacctaacgtccgtaaggacgtaatacgaacgtacgaaacgttcggtcggactaccggacctaccgtatcgttacgttccttacctccgttaccctccccgtacg

SEQ ID NO: 36457 - DNA, 750 bp, Homo sapiens
  misc_feature: GYAE6OF02GMUDG.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgccgtacggggacatcgtgatgacccagtcgccagactccctggctgtgtctctgggcgagcggccaccatcaactgacaagtccagccagtagttgttttaactaccgaccctaccaaactaaataaacgtaacccttatttaaaacgttcggtaaccagacaaagtaaaccgaggaacacgtccctacctaaggcctacgtcgttacgtttacgcgggctaacgtaccgaacccgggtatccggtacggggtccctaggtacccgtagttccgaggttacggacgtacgggtaccgggtgttacggaccgaactaacgttactttacgaccgtacctaaccaaccgttactaccgaacgtacctacggtccgtacgaccgacgggtactaacggtaagtacggtggtacggtaacttaggttttaactacgtacggtaaccaacgtacttaagtttaaccttaacgtacccttaaccgttacccggttaacgttaccgtttaccgggtacccggaacgggtaaccctaaggtcggtaacgtaacgtaacgtacgaaaggtaccgtacggtacggtcggtaccttaccgaccgtacctagttcgttaacgtcccttatccccgtttacccgtccctaaccg

SEQ ID NO: 36458 - DNA, 634 bp, Homo sapiens
  misc_feature: GYAE6OF02GM1U4.14.42.D09.1.454.CMB.1.raw
tcagcgtctagtaccacgaccggtgctcgatttagacacatacgcaggggcaggcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagttgtttttacaccacctaccaaactaataaacgaacctacttaaattcggtaccagacacgaaaccaggacagcctcctaagctgccttcgtttactgggcatacgaacccggtaatcgtacggggtcccaggaccgtattcgagttcggcgacgggtccggggttacgtaggaacggaactaacgtacttttcctaacctcctaccacctatacgacgccgagtcccgtacgaccgtagggactaggaagtacgtgggttacggacgtttaagtttcttaacgttcgtaccaacgtagacttagttacttactaccgtacctacgttactttcggacgacgggacacgtacgaggacagacgacgacgtacggtcggtcgtacgacctacgtactacgtcgttcttacctcctaccgttcccgtacttaccg

SEQ ID NO: 36459 - DNA, 904 bp, Homo sapiens
  misc_feature: GYAE6OF02G9AXQ.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgccgtacgggacatcgtgatcgaccagtcgccagacctcctggctgtgtctcgtagggcgagacggccaacatacaacgtcgacaacgtccacgcgtagtaggttactttttacaacctacccttaccaaaacgtaaactaaaccgtaaaccttaactttaaaacggtttccggtaaccgtaacgaccgaaaacggtaaaccgaacgggacctaacgtaccccttaaccgttaaacggtccgtacggtacccttttacggttttaacggcgggtacctaaaccggtacccgggtaaaccgggttccgttaccgggtttaccggggtttacccaaccggtaccgtacgttttacggtaacggtcgggtacggtacgggttccggtacgaggtaaccgaactttacgacttttaccgaacctccgtaactaaccgtactccgaacgttcgaaccggtccgttacggaccggtaacgtaccgtaaggtaaacgttcgggtaacggtttccgtaattttacgggtttaactaacggtttaaccggacctaaacggttccggtttaacctttaacgtttaacccgttaacccgttttacccgttaaccgttttacccgtttacgggttaccggggaacccgggtaagggttaaccccgtaaggggttaccgttaaaggaaaccgttaacgtaacccggttaggaccgtttacggtaccggttacggaccgtacggtaaccgtctttaccggggttcccttacgtttacccgttacggtaccctttccgttacccgggtacc

SEQ ID NO: 36460 - DNA, 731 bp, Homo sapiens
  misc_feature: GYAE6OF02I5IUF.14.42.D09.1.454.CMB.1.raw
  modified_base (212)..(212): a, c, t, g, unknown or other
  misc_feature (212)..(212): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggcgagacgggccaccatacaactgcaagtccagccagagttgttttanacacctaccaacaataacgacctacttaaattggtacagacagaaaccaggacacgcctacgtaacgctacgtcgttacgtttacgcgggacacgtacccgaaacccgggtatccggtcggggtccctacggtaccgtacttcgaggtcggtacgacgggtccggggtactacggacgaacctacttacgttttaccaccgttcctaccgaacctacgtaccgacgtaccgacgaccgtcgacgtaggtacgtaacgaaagtagttcggtacgggttattacggttttaacttacgttacgtaacgaacttacgtacttaactttaactaaccttacctacccgttacgttaccgtttacggacccggtaacgggaacctaacggtacgtaaggtaacggtacgtaaccgtaacgtaccggtaacgttacgggtacggtaccgtaccgaccgttaacccgtacgtttacgtttaccgttacctttaccgttaccgttacccccgttacccgttaacccg

SEQ ID NO: 36461 - DNA, 694 bp, Homo sapiens
  misc_feature: GYAE6OF02FYYCL.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagttgttttatactacctaccaaacaataaacgaaccttacttaaattggtaccagtacaagaaaccaggacacgcctacctaagctcgtcttcgtttacgtcgggcactcgaacccgggaattcggtacggggtccctacgaccgtattaccgaggtcggcaggtcgggttactaggacgtactactagtttccacttccgtacctacatcgacgccacgtcctacgacgtacggtaccttaggaaacggtagttgggtcgggtaacgttacgtttttaacgttacgttacgttaacgaaacgttaagtaacgttaactttaacgttaacctttaccgttacccgttaaccgtttaccgttttacgggaccgttaacgggggaacctacggtacgtacggtacggtatacggaacgtacgtacggtaggtccgtcgtacgtccgtaaccgttagttccgttcgttacccttctaccgtttccccgttacctaccg

SEQ ID NO: 36462 - DNA, 705 bp, Homo sapiens
  misc_feature: GYAE6OF02I6TPO.14.42.D09.1.454.CMB.1.raw
  modified_base (153)..(153): a, c, t, g, unknown or other
  misc_feature (153)..(153): n is a, c, g, or t
  modified_base (313)..(313): a, c, t, g, unknown or other
  misc_feature (313)..(313): n is a, c, g, or t
tcagcgtctagtaccacgaccggtgctcgatttagacacatacgcaggggcgagcaagactggtgttgcagacccaggtcttcatttctctgttgctctggatctctggtcgcctacggggacatcgtgatcgacccagtcgccagacctccnggctgtgtctcgtgggcgagacggccaccgatcacgtgcaacgtccacgccagtagttgtttacacacctaccaactaataacgaccttacttaaacgttcggtaccagtacaacgaaaaccgtggaccagccctacgtaagcgtcgcttcgtttaacgnggaccaacgtaccgaaccggatcggtacgggtccctagaccgtatcgagtcggacgtacggcggttacagaacgactacctacgttttaccaacttacctacaccgtactacgaacgcctacgacgttcgaacgtacgtacgttaacggaagtacgttacgtaggtaaccgtttaagtttacgttaaccgtaggtacctaaacgtacgacttaacgttaactaaccgttaacgttaccgttacgtttaacggtttaccggaccggtaacgggtacctaacggttcgaacggtagtaacgtaaccgtaacggtaccgtaacggtcggtaacgtcggtacgtacccacgttacgtacgttacgttccttaccgtaccttaccgtacccgtaccg

SEQ ID NO: 36463 - DNA, 780 bp, Homo sapiens
  misc_feature: GYAE6OF02H1ZKH.14.42.D09.1.454.CMB.1.raw
  modified_base (155)..(155): a, c, t, g, unknown or other
  misc_feature (155)..(155): n is a, c, g, or t
  modified_base (471)..(471): a, c, t, g, unknown or other
  misc_feature (471)..(471): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgcagactccctggctgtntctcgtggcgagagggccaccatcaactgcaatccagaccagtacgttgtttaacaccaccttaccaaacaataaacgaccgttacttaaattcggtacccagaccaacggaaaccacggaaccacgtaccccttcccgtaaaggcctcggtaccgtttaccgtttaacgtcggggctaccgtaaccggaacccgggtacttccggtcgggggtccccctaggtacccgtaacgtttcgacggttcggcgtacggtcggggtctaggacgtacactatttccacgtctcgacctaatcgagtcagtccacgggacncgggtactacggtaagtcgtacgggttggtacgttaagttttaacgtttaacgttaccgtaacctaagtaaccgttaaccgttaacgtttaccgtaaaccgtttaccctttaaccggttaacccttaccggtttttaccggaccggtaaccggggttaaaccgtaaccgtccggtaaacggggtgtaaccggttacgtaaaccggtacgttaacggttaccgggtcggtacggttaccgtacgtacccgttacttaaccggtccgtttaccttacccttaaccccggttcccgtttacccgtaacccgg

SEQ ID NO: 36464 - DNA, 838 bp, Homo sapiens
  misc_feature: GYAE6OF02G45TR.14.42.D09.1.454.CMB.1.raw
  modified_base (224)..(224): a, c, t, g, unknown or other
  misc_feature (224)..(224): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatgacccagtcgccagacctcccgtggctgtgtctcgtgggcgaggacgggcccaccactacaactgacaacgtccagccgaagagtttagttttanaacctaacctaccaaaacaaactaaacgtaaacccttaactttaaagttacggtaaccaacgacgaaacgaaaaccgaacgggaacaaccgtaccccttaaccggtaaagtccgtacggtctttacccggtttttaacggcggggtacctaaccgttaacccggaaaaccccggggttaattacccgggttccgggggttaccccccgttaggtaaccccggttaacgttaccggtacgggttaccggaacggtacggggttcgggggtacccgttaaggaaaccgtaacgttaaccttacgttttaccgtaaccctttacctacccctaacctacttaccgaccgacgtaaccgccggttagaaccggacgggtacgtacggtaaagtacgtcggttaggtacttaagtttacttacgtacgacctaacgtacgaacgttattaccgtaaccgttccgttacccgttacgttaccgggtttacggaccgggtaaccgggaacgtacgtacggtaaggactacgtaacgaacgtaccggtacgtacgggtcggactacggtaccttacgtaccgttcgtttactcgttaaccgtcccgttacccgtcccgtacg

SEQ ID NO: 36465 - DNA, 845 bp, Homo sapiens
  misc_feature: GYAE6OF02FF0B3.14.42.D09.1.454.CMB.1.raw
  modified_base (559)..(559): a, c, t, g, unknown or other
  misc_feature (559)..(559): n is a, c, g, or t
tcagcgtctagtaccacgaccggtgctcgatttagacacatacgcaggggcagcaagatggtgttgcagacccaggtcttcatttctctgttgctctggatctctggtgcctacggggaccatcgtgatcgacccagtcgccagacctccctggctgtgtcgtcgtgggcgaggacggcccaccatacaacgtgcaacgtccagccaagtagttgtttacaccgacctaccaaactaacgtaaacgaaccttactttaaaagttcgggtaacccaggaccaaacgaaaacccgacggaaccacgtaccccttaccgaaacgtccgttacggtaccgtttaccggttttaacgcgggtacctacgtaacccgaaaccccggggtaacttccggtaccggggttaccctacggtaacccggtagtttacccgaaggttccggaccgtaccggggtccgggttactacggaacgtaccctagttacctttccgtaaccttcctacccaaccgtataccgaacggtccctacgccgttgaccgacgtacgttagaacgttagnggtacggtattaacgttttactacgtacgtaaccgtaactagtaccttaagttaacctacccttttaccggtaccccttaacgttttacccgggttacggaaacccgggtaaccgggtaaaccgtcgtaacgggtaacgtaaacgtccgttaacccgaaggttaccgtaaccgggttcgggttaaccggaccttacccggtaaccctaaccgttacggttttacccggtaccttttaaccccggtttaccctacccggtttacccccgttaccccgttaaccccgg

SEQ ID NO: 36466 - DNA, 590 bp, Homo sapiens
  misc_feature: GYAE6OF02JH8E9.14.42.D09.1.454.CMB.1.raw
  modified_base (207)..(207): a, c, t, g, unknown or other
  misc_feature (207)..(207): n is a, c, g, or t
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagtgtttanacacctccaacaataagaacctcttaaattggtacagcagaaaccaggacagcctcctaagctgctacgttactggctatacgaacccgggatcgtgggtccctgaccgattcagtggcagtcggtactgacgacactactttcacttctacaccatacacgtcacgtcctgaccaggctacgaagtacgtgtaggtacttaagtttattacgtcgtacaactagactagttaactacgttactaccgtacttacggtttacgccgaaggggtaccaagtcgttacggagtaacgtacgaacggtccgtaaagtcggtcggacttacggaccgttacctaagttcttcggttacctttaccgtaccttcccgtaccccgtacg

SEQ ID NO: 36467 - DNA, 793 bp, Homo sapiens
  misc_feature: GYAE6OF02HD12R.14.42.D09.1.454.CMB.1.raw
  modified_base (455)..(455): a, c, t, g, unknown or other
  misc_feature (455)..(455): n is a, c, g, or t
tcagcgtctagtaccacgaccggtgctcgatttagacacatacgcaggggcagcaagatggtgttgcagacccaggtcttcatttcgtactgttgctacgtggatctctgggtacgccgtacggggatagtcgtagactgacccagtccgaccagtacctcccgtggcctagtgtactcgagggacgtacggacggtaccaacatcaacgtgacaacgtccgagacctaggtatttacgtttacaccaaccttaccaaacgtactaaacgtaaccttaattaaacgttcggtaccaaggactaaaacgtaaccgaggaaccactaccctaccggtaaagtctacgtaggttaaccccgtttaggagggtacctaagaaacccgtaacccgggtaagtcccggtacgggtaccctaggaccttacgttgacgggtacggctaacgggttccggaanacgtaacggtacttacgttaccttacgttaccctataacccaccggattacgacccgttaaagcgtaacgaccaggtacggttacagtaaaccgtatacggtaagtcgttaacttacggtaactacggtacaacggaacttacgtaaacttaacctacgttacctaaccgttaacgttaccggttacgtaccgggaaggttaacccgagtaacggtcggaaccttaggaacccgtaaggtaccggaacgtttacgggtaacgtaccgggttaacaacttaagtaccgttaacggtttcctaaaccttaccctacccggttaccgttaccgtaacccgg

SEQ ID NO: 36468 - DNA, 755 bp, Homo sapiens
  misc_feature: GYAE6OF02G9SOI.14.42.D09.1.454.CMB.1.raw
tcagcgtctagtaccacgaccggtgctcgatttagacacatacgcaggggcagcaagatggtgttgcagacccaggtcttcatttctctgttgctctggatctctggtgcctacggggacatcgtgatgacccagtcgccagactccctggctgtgtctcgtgggcgaggagggcccaccatcaactgacaacgtccagccagagttgttttataccaccctccaaacaataaacgaaccttacttaaattggtaaccagacaacgaaaccaggacacgccttacctaagctgccttacgtttacgtcgggactaacgtaccgaaacccgggtaatccggttcggggtcccctacggaccgtattacgaggttcggaccgagggtccggggttctaggacgacctaacttacgttttaccaccgttcctaccaaccgtattaccgaaggacccgtacgtcccgttcggaccgtaacggggtaccgtacggaaaggtaagttcgggttcgggtacgtttaacgggtttttaacttacggtttacgaaccgtaaacgacgttaacgttaactttaaacgtaccctttacccgtaccgttacctttaaccggttttcgggaccgtaacgggggaacctaacggtccgttaagggactaacgtaaccgtaacgaccggtaacggtcgggttcggaccgttcgacctacgtacgttccttacggtttccttacgttaccccgttttacccgacctttacg

SEQ ID NO: 36469 - DNA, 725 bp, Homo sapiens
  misc_feature: GYAE6OF02FMREB.14.42.D09.1.454.CMB.1.raw
  modified_base (210)..(210): a, c, t, g, unknown or other
  misc_feature (210)..(210): n is a, c, g, or t
tcagcgtctagtaccacgaccggtgctcgatttagacacatacgcagggggcagcaagatggtgttgcagacccaggtcttcatttctctgttgctctggatctctggtgcctacggggacatcgtgatgacccagtcgccagactccctggctgtgtctctgggcgagagggccaccatcaactgcaagtccagccagagttgttttanaccacctaccaaacaataaacgaacccttactttaaaagttcggtaaccaggaccaagaaaacccaggaccacgcccttacctaaagctagccttcgtttaactgggacacgtaccgaaccccgggaatccgttcggggtccctacggaccgtagtttccgaggtcggacgaaggtccggggttctaggacgaacctaacgtaacttttccaacttccgtaccaacccgtaattaccgaacgaccaacggtcccgtacgtccgaacgggtccgtaaggaacgtaacgttgggtacggtacgttaacgttttaacgtttaaccgtagtaccaaacgtacgtacttaatttaaccgtaaccttaaccgttaccgttaaccgttaccgtttacgggacccggtaaccgggtaacctaacggtacgtacggaacgtactacgaacgtacgaacgttcggtacggtctacgacctactacgttcgtcgttaccttctaccgtttcccgttacccgtaccg

SEQ ID NO: 36470 - DNA, 819 bp, Homo sapiens
  misc_feature: GYAE6OF02IG1DU.14.42.D09.1.454.CMB.1.raw
  modified_base (211)..(211): a, c, t, g, unknown or other
  misc_feature (211)..(211): n is a, c, g, or t
tcagcgtctagtaccacgaccggtgctcgatttagacacatacgcaggggcagcaagatggtgttgcagacccaggtcttcatttctctgttgctctggatctctggtgccgtacggggacatcgtgatgacccagtcgcagacctcctggctgtgtctcgtggcgacggacggccacatacaacgtgctaacgtccagccgagtaggttnttttaacaccacccttaccaaataaactaaacgtaacccttaacgttaaagtttcggaaccacgaacgaacgaaaaccgacggacgtaaccgacccttaccgtaacggtcctacgtacctttacggtttaacgtagggtactaaccgtacccggaaaccccggggtaacgttccgggttaccgggggtaccctacggtaaccgtactttcgagggtcgacggtacgggtcggtacgtagaacgtactaacgttactttcgtaacctcctacacgtacgtacaacgtcaccgtcccgagtaccggaaggtaccggtaggaaacgtcgttacgggtaacggttcgttttaaccgtttaagttacgttacccggttaaacgaaactaaccggtttaattaacgtttaacctttaccttaccggttaaccgtttacgttaacccgggttttacggacccgggtaaacggacccgttaagggtacgttacgggtaaacgtacgttaaacgaacggttaccgggtacgtaacggcggttacaccggttaacacccgttacttacgttcggtttaccctttaaccggtacccgttttcccgtaacccgttacccg

SEQ ID NO: 36471 - DNA, 761 bp, Homo sapiens
  misc_feature: GYAE6OF02H4MOI.14.42.D09.1.454.CMB.1.raw
  modified_base (248)..(248): a, c, t, g, unknown or other
  misc_feature (248)..(248): n is a, c, g, or t
tcagcgtctagtaccacgaccggtgctcgatttagacacatacgcaggggcgagcaagatggtgtgcagacccaggtctcatttctctgttgctctggatctctggtcgccgtacggggactagtcggtgatcgacccaggtccgcccagacctcccgtggcctggtgtctcgtgggcgagacgggcctaaccagtcaactgacaacgtccagtcccagtagttcgttttaacacgtacctaccaaanaactaaacgtaaccttacttaaaagtttccggaacagacgtaaacgaaaccgaacggtacaacgtacctaccgtaaagccgttacgtcgtacggttacgtcgggactaacgtaccgaaacccgggtatccggtacgggtaccccgttagacccgtaagtttcgaggttaccggacggacgggtccggtacgtagaacggtacctaccgttaactttccgacctttacgaccctacaacgttacgaacgtccgaacctccggtacgacggtacgggtacgtacgggaacgtacggtcgggtagtacgttaacggtttacgttacgtacgttacaaaccgtagtaacttacgttacttaaccgtacttacccgttacgttacggtttacgaccggaaccgggtaacacggtacgtaccgggtaataccgtacggtaacgacggttaacctcgggtcgaccgtcgtaccgacgtacgttcgttacgttccctacgtccgttacccgttccgtaccg

SEQ ID NO: 36472 - DNA, 641 bp, Homo sapiens
  misc_feature: GYAE6OF01BPDUD.36.81.H04.1.454.CMB.1.raw
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
tcagtacgctgtctcacgaccggtgctcgatttagtagtgtagattcgcggggagctctgagagaggagcccagccctgggattttcaggttgttttcatttggtgatcaggactgaacagagagatctcaccatggtaatttgggctgagctggtctttttcttgtggtcttaattttaaaaggtgtccagtgtgaggtgcagctgcgtgggagtcggtggggggaggtcgttgggtacgacgggcccggggggtccctggagtacctctccgtgtgacgcctcgtggtacttctacctttagactaagtcgtgcctatcggaccgtcgggtccgccgacggccgtaccggaagggggaacggggtcgtagggtacggtcggggttcttacgtagtttagttaggtggtaggtggtagtagcacgagtatacgcgacgacgtccggtaggacgggtccggtacaccgtatcctaccgaagacaacgtaactaccaacagaccaccgtnttagttnttcgactacaagtacgaacacgtcgagacgacgaccggaacgacgacggctaattatattagtgtacgtacgttaaacctttcgttagtaccgttagtttacttaccgtccctaggtccgaccgg

SEQ ID NO: 36473 - DNA, 532 bp, Homo sapiens
  misc_feature: GYAE6OF01DX6XQ.36.81.H04.1.454.CMB.1.raw
  modified_base (367)..(367): a, c, t, g, unknown or other
  misc_feature (367)..(367): n is a, c, g, or t
  modified_base (512)..(512): a, c, t, g, unknown or other
  misc_feature (512)..(512): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggctttttcttgtggctattttaaaaggtgtccagtgtgaagtgcagttgttggattcgtgggggaggcttggtacaggccgggggggtcctgagactctcctgtgcagcttcaggattcagtctttagcagctacgccatgagctgggtccgccaggctccgaggggagggactggagtgggtctcgaggtattggtggcaggtggtgagaccanatactacgcagactccggtagaacggggtccgttcaccatctccaagacgaacaacttaccgaagaaccaccctgtctctgacaaatgaacaactgagacgccgagacacgccctatatacagtacgaaagtgactacggatagnactactagtggactggtaac

SEQ ID NO: 36474 - DNA, 535 bp, Homo sapiens
  misc_feature: GYAE6OF01BEQNN.36.81.H04.1.454.CMB.1.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (386)..(386): a, c, t, g, unknown or other
  misc_feature (386)..(386): n is a, c, g, or t
tcagtacgctgtctcacgaccggtgctcgatttagtagtgtagattcgcgggggagctctgagagaggagcccagccctgggattttcaggtgttttcatttggtgatcaggactgaacagagagatctcaccatggaatttgggctgagctggctttttcttgtggctattttaaaggtgtccagtgtgaagtgcagttgttggattcgtgggggaggcttgggtacaggccgggggggtccctgagactctcctgtgcagcttcaggattcagctttagcagctacgccatgagctgggtccnccaggctccgaggggaggactgggagtgggtctcgaggtattggnggcaggtggtgagaccacatactacgcagactccgngacgggccgtcaccatctccagagacaataccaagaacaccctgtctctgacaaatcgaacctacctaggagtacgaccgaggaccacggcctatatactgtaacgaaatggacctacggatatacgactatagtggtacgtggttacc

SEQ ID NO: 36475 - DNA, 620 bp, Homo sapiens
  misc_feature: GYAE6OF01DCPP9.36.81.H04.1.454.CMB.1.raw
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggctttttcttgtggctattttaaaaggtgtccagtgtgaagtgcagttgttggattcgtgggggaggcttgggtacgaggcccgggggggtccctgagactctcctgtgcagcttcaggattcagtctttagcagctacgccatgagctgggtccgccaggcctaccgaggggaaggactgggagtgggtctcgagggtattggtggcaggtggtgagaccanatacncgcagactccggtagacggtccggttacaccatcctacagacgaactaactcccaagaaccaccctgtctctagacaaatcgaaaccaaccgtagacgacggacccggaacggaaccgaccgggtacccctaagttaacttaaccgtacgttaaaccggtaaaaacgtccgggacccttaaaccgggaacttagttacgtaaccttaacgttagtttacggggaccgtttgggttaaccg

SEQ ID NO: 36476 - DNA, 520 bp, Homo sapiens
  misc_feature: GYAE6OF01D19CC.36.81.H04.1.454.CMB.1.raw
  modified_base (417)..(417): a, c, t, g, unknown or other
  misc_feature (417)..(417): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctgggttttcctcgttgctcttttaagaggtgtccagtgtcaggtgcaactggtggagtcgtgggggaggcgtgatccagcctgggaggtccctgagactctcctgtgcagcctctggaatcaccttcaatagctatggcatgcacgtgggtccgccaggctccaggcaaggggctgggagtgggtgcttttagttcatatgatggagtatagttgaagactatgcagactcgtagaggcgatcacatctccagagacacttaccaanaacacgctagtatctgacaaatgagaccaacgtgaacgtaggttagaggacgacggactggtagttattacgtgtacgtccgtcccccggtggggtgtaccgg

SEQ ID NO: 36477 - DNA, 666 bp, Homo sapiens
  misc_feature: GYAE6OF01B4CEL.36.81.H04.1.454.CMB.1.raw
  modified_base (326)..(326): a, c, t, g, unknown or other
  misc_feature (326)..(326): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttcttgtggcttattttaaaaggtgtccagtgtgaagtgctagttgttggattcggtgggggaggtcgtttggtacgacggcccggggggtccctggacgacctcgtccgtgtcgcgagtcttcgaggtattcagtctttagcagctacgccatgagcgtcgggtccnccgaggcctccggaaggggaacggacgtgggaggtcggggtcctacgtaggttagttggggtggcgtagggtggtagaacggaccctacgaactacgacgactaacgtaccgttaccggaggtaacgggtcccgttacaaccgtactccgtaccgagaacgaactaaacttacccaaacggtaaccctacccgttgtacctcgtacgactaaagtcgaaaccaaccgtagacgacggaccgaaggaaccgacggtacccttaagtaacttacgtaacggtaaacgtaaagtcggacctaaggattacgtacgtacttacgtagttcggacgttggtaccg

SEQ ID NO: 36478 - DNA, 638 bp, Homo sapiens
  misc_feature: GYAE6OF01A45Q4.36.81.H04.1.454.CMB.1.raw
  modified_base (153)..(153): a, c, t, g, unknown or other
  misc_feature (153)..(153): n is a, c, g, or t
  modified_base (164)..(164): a, c, t, g, unknown or other
  misc_feature (164)..(164): n is a, c, g, or t
  modified_base (174)..(174): a, c, t, g, unknown or other
  misc_feature (174)..(174): n is a, c, g, or t
  modified_base (176)..(178): a, c, t, g, unknown or other
  misc_feature (176)..(178): n is a, c, g, or t
  modified_base (181)..(182): a, c, t, g, unknown or other
  misc_feature (181)..(182): n is a, c, g, or t
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagcggngtgttctaggngctattaagncnnnatnngtgtgatntgggngctgganagccgggggtcctgagctctcngtgcagtcttnaggattcagcctttaancagctacgcatgacgtcgtcggtccgacgacggtcgtacggaggggtacggtacgtaggacggtcggtacgtacgtaaggttcgttgggcggtacggtagggttcggacggacgaccgaacgtaacgtaacgtacgtacgtaacgtaccgtaccggtacggtaacgggtaccgtaccgtaccgtacctaccgtacgtaacgtaaccgtaactaacgtaaccgtaaccgtaaccgtaacccgtaccgtacgtacgtacgtaacgaactaacgaacgtaaccgtacgacgacgacgtaacgaccgaccgtaccgtacgtacgtacgtacgtaacgtaacgtacgacgtacgtacgtagtaacgtactacgtagtacggtgtacgtacg

SEQ ID NO: 36479 - DNA, 681 bp, Homo sapiens
  misc_feature: GYAE6OF01DVHST.36.81.H04.1.454.CMB.1.raw
  modified_base (225)..(225): a, c, t, g, unknown or other
  misc_feature (225)..(225): n is a, c, g, or t
tcagtacgctgtctcacgaccggtgctcgatttagtagtgtagattcgcggggagctctgagagaggagcccagccctgggattttcaggttgttttcatttggtgatcaggactgaacagagagatctcaccatggaatttggctgagcgtgtctttctgtgctatttaaaggtgtcagtgtgaggtgcagctgctggagtcgtgggggaggtcgttggtacgnggcccgggggggtcctggacgactcgtcctgtgaacgtccttctagggtactttcctacccttttgaacaaggttgtcgcagtcgaccgtggggtcccgccaggcctaccggagggaaggggctgggaggtggtctcgagttattagtggtaggtcggtagtagcaacgagtacttacgcacgtacgtccggtaggtaacggggcccgtttacaaccgtactccgtaccagaacgtaaacctaacttaacccaaacgtacgccaacgtctacgttagtttccgactactatagaaaccgtagacccgtaggagaccggaccggaacggaccgtaaccggaccttaagtacgtttaatttagttcgttaaccggtacggtttaaacccttttacccgttttgtaacgtttacggtttaactttacccgttaccccgttaagtcccggtaaaccccgg

SEQ ID NO: 36480 - DNA, 727 bp, Homo sapiens
  misc_feature: GYAE6OF01DHSLT.36.81.H04.1.454.CMB.1.raw
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttcttgtggctattttaaaaggtgtccagtgtgaagtgcagttgtggattcgtgggggagcttggtacgaggcccgggggggtcctggagacttctccgtgtgcagcttacaggtattcagtctttagcagctaccgccatgagtcgtacgggtccgaccgaggccgtaccgaggggaaacgggcgtagggtagtcgggtctacgaggttagtggtggcgaggttggagacgtaaccgaactaactaactacgacaggtacctccgggtacggaaccggggtcccgttaccaaccgtaactcctacccgaagaacgtaactaaacttaccaaacgaaccctaaccctgtaccttcgtaacgtaaccaaattacggaaaaccaaccgttaacggaacggaacggacccgggaaacgggtaacccgacccggttacccttaaacgttaaacttaccggttaaacggtaaaccgtaaaaagttccgggtaacccgttaaacgggtaaacgttaaagttacgttaaccgttaaacgtttaggtttacggggtaaccgtttggtttaaacccgg

SEQ ID NO: 36481 - DNA, 623 bp, Homo sapiens
  misc_feature: GYAE6OF01BO8SE.36.81.H04.1.454.CMB.1.raw
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttcttgtggcttaattttaaaaggtgtccagtgtgaagtgcagttgttggattcgtgggggaggcttggtacgaggccggggggtcctgagactctcctgtgcagcttcgaggtattcagtctttagcagctacgcatggagtcgtgggtcccgccacggccgtaccgaaggggaacgggactgggaggtcgggtctacgtaggttacgttgggtcggcgtaggtggtgacggaccaactaagtactacgcagtaccgtccggtaggaacgggtccgttcaccatcctcagagacaataccaagacccacgtcgtcnctnacaaatacaaccaacgtgaacgagaccggaagaccgaccggcctaattacttaaccgttaaggtaacgtaaaaggtcggaacccgttaacgggaacttagtaacgtaacgttacgttaacggttacgggtaacttgggttaaccg

SEQ ID NO: 36482 - DNA, 678 bp, Homo sapiens
  misc_feature: GYAE6OF01CXIP2.36.81.H04.1.454.CMB.1.raw
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttcttgtggcttaattttaaaaggtgtccagtgtgaagtgctagttgtggattcgtgggggagtcgttggtacgaggccggggggtccctggagactctcctgtgcgagcttcgaggtattcgagtctttagctagctacgcctagtcgagcgtcggtccgccgtaggcctaccggaggggaaggtcgtgggtaggtggtctacgtaaggtggttaggtggtagtagtggtacgtactaaacgactaataccgtacgcgtacggccctcggtacggtacgggcccgtacttaccacctactccgtacccagtaacgaaacctaacgttcccggaaggtacgacccggtacggtttcgtttacgtacgtaacgttaaagtcggaccggtacccgtaccgtaagggaaccggacccggtaacgggacccgtaaccggtaccctaactttaccgtagtcggtacgtacggtaagaacgttccggaagtacggaacggtaggtagggacgcgtacggaacccgg

SEQ ID NO: 36483 - DNA, 954 bp, Homo sapiens
  misc_feature: GYAE6OF01BA0IK.36.81.H04.1.454.CMB.1.raw
  modified_base (171)..(171): a, c, t, g, unknown or other
  misc_feature (171)..(171): n is a, c, g, or t
  modified_base (265)..(265): a, c, t, g, unknown or other
  misc_feature (265)..(265): n is a, c, g, or t
tcagtacgctgtctcacgaccggtgctcgatttagtagtgtagattcgcgggagctctgagagaggagcccagcccgtgggtatttttcgaggttgttttctagttttggtgactcgaggacctagaacgagagagtatcctaccacctagtaggtaagtttgggctaggngtcgttggtttctttttcgttggtcggttactttaagttttaaaaggtctacgtaggtgtagtaagtgcgtagtttgtggtagttcggtagggngtcggttggacggtaccggggtcccggggttcccgaggtaaccgtccgttccgtccgttggtacgtcgacgttcgttacggagttacgttacgtacgttacgtttaacgcgaacctcgtaaccgtctaacgtggtaccggccggttccgggtacccgtaccggacccggtaccggaaccggggtaaggaacgggtacggttacgggtaccgggttacggttccgtaaacgggttaggtttccgggagggtaacggtccggtaggggtttacgaaaccgggtaccgtaaccgtaacgttaagttaaccccgaggaccgtaccgttaacccgggtttaccgggtaccggtaaacccggggttcccttaaccgtacccgttaccggttaaccccgacgtaaacccgtaaccgttaaccgttaaaccgttaaccccgtaaacgtaaaccccgttccgtttaccgttaccgtaccgtaaacgtaacgtaaacgaacggttaaaccgaacgtaacggaaccggtaacggacccggaaacggtacccggtaacccgttaaaccgttacgttaaaaccgttaccgttaaacggtaaaccgttaaacggtaccggtaaagttaaaccgtagttaaccgttaaccggttaaaccgttcggttaaaccgggtttacgttaccggttaccggtttaaccgg

SEQ ID NO: 36484 - DNA, 777 bp, Homo sapiens
  misc_feature: GYAE6OF01EOVPN.36.81.H04.1.454.CMB.1.raw
tcagtacgctgtctcacgaccggtgctcgatttagtagtgtagattcgcgggtctgagagaggagcccagccctgggattttcaggtgttttcatttggtgatcaggactgaacagagagatctcaccagtggtaagtttgggctgagctggtctttttcttgtggtcttaagttttaaaaggtgttccagtgtgaagtgctagttgttggtattcggtgggggagtcgttaggtacgacggggtcccggggggtccctggagtacctctccgtgacgcacgtcttcgaggattcagtcttagctagctacgaccatgacgtccgtcgggtcccgcggcgtaccgtaccggagggttaacgggcccgtaggggacggttcgggtagacccaaacgtaacgtacgaccggtaccgggtaagtacgggtaaaggtacggaaacgtaacgtacgtaacggtcggtaggtaacggtcgtaagggtaacgggaaccggtacccgtattacccgaaccgttactccccgtaaccgtagaaccgtaaccgtaaccgaaccaaaccggttactacccgtaacgttttcgttaaccgtacggtaacctacggtacgtacccgaacgttaccggagtacccgggaacccggtaggtaaaccggtccggtaccgtccgttcgttaaccgttacgttacgtgggtacgtaagggagggtacggtacggtttacccgttaggttacgggttactaccgggtttaacttccccccggttctttaaccgggg

SEQ ID NO: 36485 - DNA, 797 bp, Homo sapiens
  misc_feature: GYAE6OF01AQBA2.36.81.H04.1.454.CMB.1.raw
  modified_base (270)..(270): a, c, t, g, unknown or other
  misc_feature (270)..(270): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
tcagtacgctgtctcacgaccggtgctcgatttagtagtgtagattcgcggggagctctgagagaggagcccagccctgggattttcgaggtgttttcatttggtgatcgaggactgaacagagagatctcaccatggtaatttgggctgagctggtctttttcgtgtggacttaagttttaaaggtgtcctagtgtgaagtgctagttgtgattcggtgggggagcgttggtacgacgggccggggggttcctgacgtactctcctggngcagtcttcgaggtattcgatcgtttagcgtacgacttacggcagttcgacgtccggtgggtaccccgcgaaggtccctacgggaagggacggtacgtgggtagttacggctacggtaggttnttccgggngaccgtaggttggacacggtaaccccaagtaccaacgtcccgaggtaaacgtccgggttacggttaacggggacccggggtacccttacctaaaccgttcgtacccgttaacgaacggtaaactaccgtaaacttacccgaaacgtaacccgtttcccgtacggtaccttaccccgaaggttaaccctaaaaccgtacgttaaaacccgacccgttggaacgggtaaccccggacggaacggaacccttacccggtaaccccgttaagtaaccccggtttacgtaaacggttaaacccggaaacttaggggtaaccccgtaacaagtttaaacccggcgtttaaacccgttacgttaaagggttttcccggggtaaacctttgggttaaacccggg

SEQ ID NO: 36486 - DNA, 241 bp, Homo sapiens
  misc_feature: GYAE6OF02HUGNP.36.81.H04.1.454.CMB.1.raw
  modified_base (238)..(241): a, c, t, g, unknown or other
  misc_feature (238)..(241): n is a, c, g, or t
tcagtacgctgtctcacgaccggtgctcgatttagtagtgtagattcgcggggctgccctttggttttggagatggttttctcgatgggggctgggaggcctttgttggagaccttgcacttgtactccttgccgttcagccagtccaggagcacctccgagagcacagcggccctgggctgcctggtcaaggactacttccagacagcgtactgagcgggctggcaaggcgcatagnnnn

SEQ ID NO: 36487 - DNA, 521 bp, Homo sapiens
  misc_feature: GYAE6OF02G5DJV.36.81.H04.1.454.CMB.1.raw
  modified_base (419)..(419): a, c, t, g, unknown or other
  misc_feature (419)..(419): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggctttttcttgtggctattttaaaaggtgtccagtgtgaagtgcagttgttggattctgggggaggcttggtacagccgggggggtccctgagactctcctgtgcagcttcaggattcagctttagcagctacgccatgagctgggtccgccaggctccgaggggaagggactgggagtgggtctcgaggtattgggtggcaggtggtgagaccacatactacgcagactccgtgaagggccgtcaccatctcagagacaatccaanacaccctgtctctgcaaatgaacaacctgagagccgagacacggccctatacttactagtacgaaatggacctacggatatgactactatgggactggtacg

SEQ ID NO: 36488 - DNA, 531 bp, Homo sapiens
  misc_feature: GYAE6OF02HG069.36.81.H04.1.454.CMB.1.raw
tcagtacgctgtctcacgaccggtgctcgatttagtagtgtagattcgcgggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttggtacagccgggggggtccctgagactctcctgtgaagcctctggattcacctttgacaagtgtgccatgacctgggtccgccaggctccgagggaaggggctggagtgggtctcagttatagtggtagtggtagtagcacagattacgcagactcgtgaagggccggttcaccatcctccagagacaattccaaacagcacgctgtatttgcacatgaacagcctgagagccgaggacacgccatatattattgtgcgtaaacttcctttagacttggttattactccccttagtcgacctacgtgggacccg

SEQ ID NO: 36489 - DNA, 243 bp, Homo sapiens
  misc_feature: GYAE6OF02G3JQ0.36.81.H04.1.454.CMB.1.raw
  modified_base (238)..(243): a, c, t, g, unknown or other
  misc_feature (238)..(243): n is a, c, g, or t
tcagtacgctgtctcacgaccggtgctcgatttagtagtgtagattcgcggggctgccctttggttttggagatggttttctcgatgggggctgggaggcctttgttggagaccttgcacttgtactccttgccgttcagccagtccaggagcacctccgagagcacagcggccctgggctgcctggtcaaggactacttccagacagcgtactgagcgggctggcaaggcgcatagnnnnnn

SEQ ID NO: 36490 - DNA, 573 bp, Homo sapiens
  misc_feature: GYAE6OF02G4G2Y.36.81.H04.1.454.CMB.1.raw
  modified_base (416)..(416): a, c, t, g, unknown or other
  misc_feature (416)..(416): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggctttttcttgtggctattttaaaaggtgtccagtgtgaagtgcagttgttggattcgtgggggaggcttggtacaggccggggggtccctggagactctcctgtgcagcttcaggattcagtctttagcagctacgccatgagctgggtccgccgaggcctccgagggaagggactggagtgggtctcgaggtatggtggcgaggtgggtgagaccacatacgtacgcagactccgtaggaacgggtcccgttcacctatccnccgagacgacaacgttaccaaagaacctacccgtacgtcctacgtcgaacaaagtacgaaacctaaccgtgaacgacgaccgaaggaccacggaccctatacttactagtaacgaaatcggactacgatagtacgacttatagtcggacgtagtacg

SEQ ID NO: 36491 - DNA, 537 bp, Homo sapiens
  misc_feature: GYAE6OF02IEKXU.36.81.H04.1.454.CMB.1.raw
  modified_base (152)..(152): a, c, t, g, unknown or other
  misc_feature (152)..(152): n is a, c, g, or t
  modified_base (163)..(163): a, c, t, g, unknown or other
  misc_feature (163)..(163): n is a, c, g, or t
  modified_base (175)..(175): a, c, t, g, unknown or other
  misc_feature (175)..(175): n is a, c, g, or t
  modified_base (179)..(180): a, c, t, g, unknown or other
  misc_feature (179)..(180): n is a, c, g, or t
  modified_base (182)..(183): a, c, t, g, unknown or other
  misc_feature (182)..(183): n is a, c, g, or t
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
tcagtacgctgtctcacgaccggtgctcgatttagtagtgtagattcgcggggagctctgagtgaggagcccagccctgggattttcaggtgttttcatttggtgatcaggactgaacagagagatctcaccatggaatttgggctgagcgngtgttctaggngctatttaaagncatnnanncattntgntctgggagnttgcagcgggggtcctgagctctctgtgcagcttnaggattcanctttgcagctacgccatgngctggtccgccgcggctccgacggaggacgtggaggnggtccgtcaggtgttggtgcgngtggtgngacacacactaacgnacacgtccgngacggccggttcacactcaccagagacacttaccaagaacctaacctctctctcacaatacgaacaacgagacgacgacgacgacgacgtccgtactacttacgtacgtaacgtaaacgtacgaccgtaaccggtactagtaccggtaattaacgttacgttacggtacgtacggttaaccgg

SEQ ID NO: 36492 - DNA, 558 bp, Homo sapiens
  misc_feature: GYAE6OF02HJTVG.36.81.H04.1.454.CMB.1.raw
  modified_base (303)..(303): a, c, t, g, unknown or other
  misc_feature (303)..(303): n is a, c, g, or t
  modified_base (440)..(440): a, c, t, g, unknown or other
  misc_feature (440)..(440): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggctttttcttgtggctattttaaaaggtgtccagtgtgaggtgcagctgttggaggtcggggggaggcttggtacagcctggggggtccctgagactctcctgtgcagcctctggattctcctttagcacctatgccatgagctgggtccnccaggcctccgagggaggactggagtgggtctcatccattagtggtcacggtacttcatacatacttcgcagactcgtgaacgggtccgttcaccgatcgtaccagagacaattaccaagaacacacagtactactnactaaatagaaacacgacctagacgacgccggaagaccgacggccgtactactttcgtggtcgacgtaacgtcctttagttcgttaccggttatggtagttacggaagggggtaccgg

SEQ ID NO: 36493 - DNA, 609 bp, Homo sapiens
  misc_feature: GYAE6OF02IH7ZN.36.81.H04.1.454.CMB.1.raw
  modified_base (365)..(365): a, c, t, g, unknown or other
  misc_feature (365)..(365): n is a, c, g, or t
tcagtacgctgtctcacgaccggtgctcgatttagtagtgtagattcgcgggggagctctgagagaggagcccagccctgggattttcaggtgttttcatttggtgatcaggactgaacagagagatctcaccatggaatttgggctgagcgtggtcttttttcttgtggacttatttttaaaaggtgtccagtgtgaagtgcagttgttggattcgtgggggagcttggtacaggccggggggtcctggagactctcctgtgcagcttcgaggattcagtctttagcagctacgcatgagcgtgggtccgcaggctccgaggggaggactggagtgggtctcgaggttatggtggcaggttggngagaccagtactaacgtacgcagacgtccggtaggaacgggtccgttcaccatcctcgaagacgactaacttacccaaacgtaacctacccgtgttacctacgtagactaaagtcgaaacccgtaaccgtgaacgacggtaccgaacggaaccaccggtacctagtacttacgtagtaaacgaaagtccggaactacggtaatacgttacgaacttaacgtagttacgggaccttggttaaccg

SEQ ID NO: 36494 - DNA, 636 bp, Homo sapiens
  misc_feature: GYAE6OF02JFJXF.36.81.H04.1.454.CMB.1.raw
  modified_base (443)..(443): a, c, t, g, unknown or other
  misc_feature (443)..(443): n is a, c, g, or t
  modified_base (486)..(486): a, c, t, g, unknown or other
  misc_feature (486)..(486): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggctttttcttgtggtcttaattttaaaaggtgtccagtgtagaagtgcagttgttggattcgtgggggaggcttggtacagggcccggggggtcctggacgactctcctgtgcagtcttcgaggtacttcagtctttagcagctacgccatgagcgtcgggtcccgccgaggccgtccgaaggggaacggacgtgggaggtgggtctcgtaggttattgggtggcgtaggtggtagacgaccacgtatacgtacgacacgaccgtccggtaggaacgggtcccgtacaccntcctacagtacactaataccaaacgtaccaccgtgtcctctanaactaaagtacgaaacctaaccgtggaacgacggaccgaaggaccgaacccggtaccttaagttacttacgtacggtaaacgtaaacgtcggaacctacggtaactacgtacgtaaccttaagttaggttacggtacgttaggtaacccg

SEQ ID NO: 36495 - DNA, 630 bp, Homo sapiens
  misc_feature: GYAE6OF02FX0XR.36.81.H04.1.454.CMB.1.raw
  modified_base (417)..(417): a, c, t, g, unknown or other
  misc_feature (417)..(417): n is a, c, g, or t
  modified_base (510)..(510): a, c, t, g, unknown or other
  misc_feature (510)..(510): n is a, c, g, or t
  modified_base (606)..(606): a, c, t, g, unknown or other
  misc_feature (606)..(606): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggctttttcttgtggctattttaaaaggtgtccagtgtgaagtgcagttgttggattcgtggggggaggtcttgggtacgacggggtcccgggggggtccctggacgacctcctccgtgtgtagtcttcgaggtattcagtctttagcagtctaccgccatggagcgttcggggtcccgccgaggcctccggaaggggaaggggactggggaggttcgggtctcgtaggttagttgggtgggcgtagggttggtaggacgaccaanactacgtacgcaacgacctcggaggaacgggtccggtacaccactccacgagacgaactaacttaccgaaacgaacacgtatagtactacgtnaactaagacaacgagtacgtagagacgaccgaacgcggaccgtacgtatactacacgtggcgaacgtaaccggtacccggggaggggacgtacggnggtcgtacggtacgtgtaaccggg

SEQ ID NO: 36496 - DNA, 526 bp, Homo sapiens
  misc_feature: GYAE6OF02GLNSV.36.81.H04.1.454.CMB.1.raw
  modified_base (480)..(480): a, c, t, g, unknown or other
  misc_feature (480)..(480): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggctttttcttgtggctattttaaaaggtgtccagtgtgaagtgcagttgttggattctgggggaggcttggtacaggccgggggggtccctgagactctcctgtgcagcttcaggattcagctttagcagctacgccatgagctgggtccgccaggctccgaggggaaggactgggagtgggtctcgaggtattggtggcagtggtgagaccacatactacgcagactccgtgaacgggccggttacaccatcctccagacgactaattcccaaagaaccaccctgtctctgacaatgaacactgagagcgagacacgcctatatacngtaacgaaatcgacctaggatagtcgactactagtggtactgttac

SEQ ID NO: 36497 - DNA, 772 bp, Homo sapiens
  misc_feature: GYAE6OF02IX8CN.36.81.H04.1.454.CMB.1.raw
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttcttgtggctaattttaaaaggtgtccagtgtgaagtgcagttgttggattcgtgggggaggtcttggtacgagggccgggggggtccctggagactctccgtgtgcagtcttcaggtattcagtctttagcacgctacgccagtgagcgtcggggtccgccgacggccgtaccggaagggggaagggccggtagggacggtcgggttacctcggtagggttacggtttgggtggacgtagggttcgggtgacggacccaacgattaaccgtacgacgtacggtaccgttaccgggtagggaacgggggtcccggtttaccaacccgtacttcctaccgaaggtaaccgaacgtaaacgttaacccgaaaacgtaaccctaaccccgttcggttacccttaccgttaacgtaacctaaacgtaacggtaaacctaacccggttaaggaacggaaccgggacccgggtaacggaacccggtaacccggtacccttaaagtttaccgttacgttaacgtaaaccggtaaacggtacggtacccgtaacgggttaattaacggtacgttaaaccgttacgttaacggtttacgggtaaccgtttcgggttaaaccg

SEQ ID NO: 36498 - DNA, 677 bp, Homo sapiens
  misc_feature: GYAE6OF02HX45B.36.81.H04.1.454.CMB.1.raw
  modified_base (202)..(202): a, c, t, g, unknown or other
  misc_feature (202)..(202): n is a, c, g, or t
  modified_base (318)..(318): a, c, t, g, unknown or other
  misc_feature (318)..(318): n is a, c, g, or t
  modified_base (590)..(590): a, c, t, g, unknown or other
  misc_feature (590)..(590): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttctgtggtactaagttttaaaaggtgtacctagtgtgaagtgntagttgttggattcgtgggggaggtcttggtacgacggccgggggggtcctggagtctctcctgtgcagtcttcaggtattcagctttagctagctacgcatgagcgtgggtcccnccgaggcctaccgagggaacgggactagggaggtgggtcctgtaagggtgtttggggaggtcctaggggtggttacggaacgacccgaactaagtttacgacgccaagtaccgtccggtacggaacggggtcccgttacacccgtatccgtaccgagaacggaaactaaccttaccaaagtaaaccctacccgtacgttctcttacgaactaaacgttacgaaacctaacccgagaacgaccggtacccggaaagccgaaccgaaccgttanacgtttacgtagttaacggtaaaatccggaccctaaggtaaccgtatacgtactaacgtttagtacggttaccgttaggtttacccg

SEQ ID NO: 36499 - DNA, 924 bp, Homo sapiens
  misc_feature: GYAE6OF02G2MYC.36.81.H04.1.454.CMB.1.raw
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttcttgtgtcttaatttaaaaggtgtccagtgtgaagtgctagttgttggtattcggtgggggaggtcgtttgggtacgacggggcccgggggggttcccctaggacgtaccttccgttccgttggtcgcgacgtcctttcgaagggtacttacgagtaccgttttagaccgtagtaccgtaccggaccctagtacggacggtccgtcgggggtaccccgaccgacgggtcccgtacccggaagggggtaaacggggtaccggttaggggtacggggttacgggggttaccttaccgggtaaagggggtttacggttttacgggggttacggggtaccgttaaggggggttttcgggttaacgggaaaacggggtaaccccctaaaaccgtaaacgtttaaacccggtaaccgggtaccctaaacgggtaccccgttacccggggtaaacgggtaaacccgggggttccccgggtttaaccctaaacccggtacttacccgttacccggaaaggtaaaccggtaaacctaaaccggttaaaccctaaaccggtaaaccccgttaaccccgtttcgttacccttacgtaccgtaaaccgtaaacgtaacgtaaaacccgtaacccgttaggaaaccgtaccggaaccggaacgaacccggaacccgtacccgtaattacgtacgttcggaaaacgtaacgtacggtaaccgtaacgttaacgtagtacgtaaccgttagttacgttacgggactttacggttaaccg

SEQ ID NO: 36500 - DNA, 622 bp, Homo sapiens
  misc_feature: GYAE6OF02IJ3VY.36.81.H04.1.454.CMB.1.raw
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (486)..(486): a, c, t, g, unknown or other
  misc_feature (486)..(486): n is a, c, g, or t
  modified_base (578)..(578): a, c, t, g, unknown or other
  misc_feature (578)..(578): n is a, c, g, or t
tcagtacgctgtctcacgaccggtgctcgatttagtagtgtagattcgcgggggagctctgagagaggagcccagccctgggattttcaggtgttttcatttggtgatcaggactgaacagagagatctcaccatggaatttgggctgagctggctttttctgtggctattttaaaaggtgtccagtgtgaagtgagttgttgtagttctggggagggcttggttacgaggccggggggtcccggtcgagacgtcctccgtgtgcgacgcttcgtacggagttctagtactttacgtacgacgtcgtacgccactgagtcgtcgggtccgcccgaggcgtccgacgggaagggcgtaggaggtagggtcgtcgaggtagttggtggngngtggtgagacacatacgtacgcgagacgtccgtaggacggtccggttacacactctaccgagaagactaactacctaagaacctacccttcgtactntaccgcaaactacgaactaaccgagagacgacggacgacgtaccgacctacgtattacctagtaacgtaaacgtgtacccgtaggaacttanacgtacttaaccgttaggttacgggtacttacggtacgttaccg

SEQ ID NO: 36501 - DNA, 672 bp, Homo sapiens
  misc_feature: GYAE6OF02HRCRE.36.81.H04.1.454.CMB.1.raw
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggctttttcttgtggctattttaaaaggtgtccagtgtgaagtgcagttgttggattcgtgggggagtcttggtacagggcccgggggggtccctgagactctcctgtgcagcttcaggattcagtctttagcagctacgccatcgagcgtcgggtccgccgaggtcctacgaaggggaagggtaccgtagggacggttcgggtcctacgtagggttagttggggtggcgtgggttgggtagacggtaacccaactaactaaccgtaacggtacaacggtacccgtcgggtaggaaccggggtcccgttaccaacccgtatccctaccgaagaacgaacctaacttaacccgaaagaaccctaccccgttgtaccttacgtacgacctaaaagtcgaaaccctaaccgtgaaggaccgaccggaacggtaccgaccggtacccttaataacgttacgtcggaaacgtaagtccggactacggatacgatacttacgtaggttacggtacgtaggttaaccg

SEQ ID NO: 36502 - DNA, 766 bp, Homo sapiens
  misc_feature: GYAE6OF02GTNDA.36.81.H04.1.454.CMB.1.raw
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttcttgtggcttaattttaaaaggtgtccagtgtgaagtgcagttgttggattcgtgggggaggcttggtacaggccggggggtccctgagactctcctgtgcagcttcgaggtattcagtctttagcagctaccgcatgagcgtcgggtccgccgaggcctaccggaaggggaacgggtacgtgggaggtcgggtctcgtaggttagttgggtcggcgaggttggtagacggacccacgtattaaccgtacgcacgaccgttaccggtacggtaaccggggtccgttacacccgtatcccgtaccgagtaacgaactaaacttacccgaaacgtaaccctaacccgttcgttacctacgtacgaacctaaacgtaccgtaaaaccgtaaccgttaggaacggaaaccggtacccggaaaacgggaacccgtaaccccggttaacccttaaagtttaacctttaaccgtaacggttaaacccggtaaaaaggttcccggggttaaccccgttaaacgggtaaacgtttaacggttaaccgggttaaaccttttaaccggtttaaagggtttaacccgggggtaaccttttacggggtttaaaccccgg

SEQ ID NO: 36503 - DNA, 692 bp, Homo sapiens
  misc_feature: GYAE6OF02GG7RK.36.81.H04.1.454.CMB.1.raw
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttcttgtggctattttaaaggtgtccagtgtgaagtgctagttgttggattcgtgggggaggtcgttggtacgaggtccgggggggtccctggacgacgtctccgtggtgtacgcgttcgaggtattcgagtctttagcgagctacgccatgagtcgtcgggtcccgccgacggcctaccggaggggaacgggtaccgtgggaggtgggtactcggaaggttagttgggtagcgtaggtggtcggacgaccatagtaccgacgacgacgtaccgtccggtggaacggggtcccgttacacccgtacgttccgtaccgaaggaactaaccgtaaacttacccgaaacgaacccgtaaccctgttacctcttaacgacctaaaacgttacgaaacctaacgtacggaacgacgtaccggacggaaccaccggtacctaagttacgttacgtacgtaaacggtaaacgtcgggtaaccctacggaattacgtacgaacttacgttaacgttacggggtactttcgggtaacttacgg

SEQ ID NO: 36504 - DNA, 606 bp, Homo sapiens
  misc_feature: GYAE6OF02HAG0W.36.81.H04.1.454.CMB.1.raw
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
  modified_base (542)..(542): a, c, t, g, unknown or other
  misc_feature (542)..(542): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttctgtggtcttattttaaaggtgtccagtgtgaagtgctagttggttggatttcggtgggggaggtctttggtacgacgggtcccgggggggtcctggacgtactctcctgtgcgagcttcaggattcgagtctttagcagcctacgccatcggngctgggccncgaggcctcgagggaaggctgggagtgggtctcgaggttgttggaggctagggtggttagaggaccaactacgtaacacgngtagtccgtcggtaggaaccggggtccgttacnctactcctacgaggactactaaacttccgaaacaccacccttagtctctagactaaacgtacgaactaaccgtgagacgcgaacgcacggtacctagtacttacngtaaacgtaagaccggtagaaccgtataattcgaacttacgttaggtaacgtggtcgttaaccg

SEQ ID NO: 36505 - DNA, 753 bp, Homo sapiens
  misc_feature: GYAE6OF02GYQA8.36.81.H04.1.454.CMB.1.raw
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagctggtctttttctgtggtctattttaaaaggtgtccagtgtgaagtgcagttgttggattcgtgggggagtgttggtacgacgggtccgggggggtccctgagacctctccgtgtgcagtcttcgaggattcgagtcgtttaagctagcctacgcagtgacgtccgtgggtcccgccgaggccgtccggaaggggaacggtacggtggaggttcgggttccttcgaagggttacgttgggtcggtacgtagggttgggtacggaacgtacccgtaactaacgtaaccgtaaccggacgaacgtaccgttccgggtaacgggaaaccgggggttccccggtttaaccgaacccgttaaagttccccgttaaccgaacggtaaactaacccgtaaacttaaccccgaaaacggaaaccccttacccgttacgttccctagttaccgaaccttaaaagacccgaaaacgtaaccgtggaaacgccgaacggtacgaaaccgtaccggaaccttagtaaccgtttacgtaacgtaaaccgtaaaggtccggtaaaccctaggtaacttacgagtaccttaaacgttgggtaacgtcggtacgttaacg

SEQ ID NO: 36506 - DNA, 857 bp, Homo sapiens
  misc_feature: GYAE6OF02GAR5X.36.81.H04.1.454.CMB.1.raw
tcagtacgctgtctcacgaccggtgctcgatttagtagtgtagattcgcggggagctctgagagaggagcccagccctgggattttcaggtgttttcatttggtgatcagactgaacagagagatctcaccatgaatttgggctgagctggtcttttcttgtggcttaattttaaaggtgtccagtgtagtaagtgctagttgttggtattcgtgggggaggcttggtacgaggtcccgggggggtcctggagtactccgtccgtgtacgtcacgtccgttcgaaggtacttcgacgttctttaggaccgagtaccgtaccggccaagttcggacggtccgttacggggtccccgtaccgtagggtcccgtcccgaacggggaaagggtcctagggacggttcggggtctacgtagggttaagtttcggggtcggtcgtaagggtcgggttaggaacccgtaaccgaaacgtcgttaaacccgtacgaccctaaacgggacccgttcccggggtaaaggtaacccgggggtacccgggtttaaccaacccgggtcctacccggtacccgaagggtaaaccgaacgttaaaccttaacccggaaacgtaaaacctccccgtacggttacctacctcgtaaacgaaccttaacggtaaacccctaacgggtacggaaacgtaccggacccggtaaacgaacccggaaccgtaaccccgttaaggtaaccttacgtttaaccgaaaacgggttaaaccgttcccgggtaacttaaacccgggtaatttaaaccgggttcgaaaacccggttttaaggttaacgggtttaccgggtacgtttaacccgggtttaaacccgg

SEQ ID NO: 36507 - DNA, 875 bp, Homo sapiens
  misc_feature: GYAE6OF02IPAED.36.81.H04.1.454.CMB.1.raw
  modified_base (201)..(201): a, c, t, g, unknown or other
  misc_feature (201)..(201): n is a, c, g, or t
tcagtacgctgtctcacgaccggtgctcgatttagtagtgtagattcgcggggagctctgagaaaagaggagcccagccctgggattttcaggtgttttcatttggtgatcaggactgaacagagagatctcaccatggaattttgggctgagctggtctttttcttgtggcttattttaaaaggtgtccagtgtgagtgntagttgttggattcgtgggggagtcgttggtacagggcccgggggggttccctggagacctctccgtgtcgcagtcttcgaggtacttcacgtcttttagccgagtctacgaccatgacgtcgtcgggtcccgaccgaggccgtaccggaagggaacgggacgttagggacggttgggttaccgtacggtaagggttagttaggggtggtacgtaagggtgggttacgaacggtaacccaacgtaacgttaaccgtaacgaccgtaaacgtacccggttccggtaacgggtaaccggggttccccggtttaccgaaacccgttacggttaccccgtaacccggtaacggaaccgtaaaccgtaaaaccgtttaacccgaaaaaccggtaaacccctacccgttacggtttaacccttaccggtaacgaaaccgttaaaacgtaaccgtaaaacccttaaacccggttaagggaaacggtaaccggaacccgggaaacggtaaaccccggtaaacccggttaccccgttaaatttaaccgttaacgtttaaccgggtaaaaccggttaaaacggtaccggtaaacccggttaaacgggtaaaccgttaagttaccgtaaaccgttttaacggttaaccggtttacggggtacccggtttaagggttttaaccccg

SEQ ID NO: 36508 - DNA, 749 bp, Homo sapiens
  misc_feature: GYAE6OF02ISV46.36.81.H04.1.454.CMB.1.raw
tcagtacgctgtctcacgaccggtgctcgatttagtagtgtagattcgcggggagctctgagagaggagcccagccctgggattttcaggtgttttcatttggtgatcaggactgaacagagagatctcaccatggtaatttgggctgagcttggtcttttttcttgtggtacttaagttttaaaaggtgtccagtgtgaagtgctagttgttggtattcggtgggggagtcgttggtacgagggccggggggtccctggagacctccgtcctggtcgctacgtctttacgaggtattcgagttctttagcagtacctacgccagtgacgtcgtcgggtcccgaccgaggcctaccggaaggggacgggagtgggaggttcgggtcctacggtagggttagttggggtcggtcgtaagggtggtacgacgtacactaacgtactacgactaacggaccttacggtaggaccgggtacccgtacacctacgtcctaccgaagtaaccgactaaacttacccgaaacgaaaccctcccgtttatccttccgtaagaacctaaagtaccgtaaacgtaaccgtaggaacgaccgggtaaccgaacgggaccctaccggtacccttaagttagtttaaccggaaggtttaaaacccggaaagtttacccgggaaaccgtttacggaaactttaggtaaccgttaacggtttaacgttaagggttacccgggtttaagtccggttttaaaccgg

SEQ ID NO: 36509 - DNA, 780 bp, Homo sapiens
  misc_feature: GYAE6OF02GBR1O.36.81.H04.1.454.CMB.1.raw
  modified_base (525)..(525): a, c, t, g, unknown or other
  misc_feature (525)..(525): n is a, c, g, or t
  modified_base (584)..(584): a, c, t, g, unknown or other
  misc_feature (584)..(584): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaatttgggctgagcgtggtctttttcgttgtggtcttaattttaaaaggtcgtcagtgtgaagtgctagttgtggtattcgtgggggaggtcgttggtacgacggccggggggtccctgagactctctgtcgcagtcttacgaggtacttcgagttcgtttagcgagtaccgtacgtaccagtcgacgtcgtccggggtccgcgaccggtccgtaccggaagggggaacggtacgtgggaacgggttcgggttcgtacggtagggttacgttggggtacggtacggtagggttcgggtacggtaacggaaccctaacgtaacgttaaccgaccgtacgaaccggtaccgtaccgggtaagggtaccgggtcccgtttaaacaaccgttntccccgtaacgaacggtaacaaccgtaaacccgtccgaaaagggccaacgaacccgttntaaactcgtacacggaaataacggtcacgaacgtccgtccgaaaggtaaccgacgggtaaccgaaccgggtaccggtaccgggttacgtttaggtttaaacgttcgggtttaaaccgggcccggaaggtaacccgttaaccggttacccgtaacccccgggtaaacgggtttacccaacggttaccgtttaagggg

SEQ ID NO: 36510 - DNA, 809 bp, Homo sapiens
  misc_feature: GYAE6OF02JT7YL.36.81.H04.1.454.CMB.1.raw
  modified_base (378)..(378): a, c, t, g, unknown or other
  misc_feature (378)..(378): n is a, c, g, or t
tcagtacgctgtctcacgaccggtgctcgatttagtagtgtagattcgcggggagctctgagagaggagcccagccctgggattttcaggtgttttcatttggtgatcaggactgaacagagagatctcaccatggaagtttgggctgagtcgtcggttctttttcttggtggtacttaagttttaaaaggtcgtcctagtgttaggaagtgcgtagtttggttcggtgtttcggtagggggtacggtcgtttagggtaccgaggggtaccccgggggggttccctagggacgaccgttcctccgttggtgccgtagtccgtttacgagggtactttccggacgttcgtttaacggcaggttccgtaacgtcgtacgnggtacgcggtcggggtcccgaccggtacggccgtacggaagggacggtacgtagggtaacggtggtacgttcggtaggttaggttcgggtacggtgtaagggttcggtacgtaacggtaacctacgtttaaacgtaccgaacggtacgtaaccgtacccgttcggggaagggttaaaccggggtcccgttaacccgaccttacgtacccgtaccgtaacgaaacgtaaaccgttaaaccgttaaccgaaaccgtaacccgttcgttaccgtccgttactacggaacctaaacgtaacgaaaccttacgacggtaacgaaccgaacggtacgaaccctaccggtacctaagttactacgaacgttaacggaacggtacgtacttacggaacgtcctagtaacgttacgtaggtacggttacgtacgtaacgg

SEQ ID NO: 36511 - DNA, 501 bp, Homo sapiens
  misc_feature: GYAE6OF01AJ2Y2.14.56.F01.1.454.CMB.1.raw
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtgttggcctggtatcagcagaaaccagggaaagcccctaaggtcctgatatatgagacttctactttagaaagtgggtccatcaaggttcagcgcagtggatcgtggacagaattcactctcactatcaccagcctgacaacctgatgattttgctaacttattactgaccaactagtatcatcatctattgtaatttcggtggtagggacctaagggtggaggtacaaacgtacgtgtggctgcacattctgttacc

SEQ ID NO: 36512 - DNA, 574 bp, Homo sapiens
  misc_feature: GYAE6OF01DHB00.14.56.F01.1.454.CMB.1.raw
  modified_base (349)..(349): a, c, t, g, unknown or other
  misc_feature (349)..(349): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagatattaataggtggttggctggtatcagcagaaaccagggaaacgcccctaaggtcctagatatatgagtacttctactttagaaagtgggtcccatcagttcagcggcagtgatcgngggacagtaatcactctcactatcaccagcctgactaacctgatgtattttgactaacttattactcgaccaatagttaatactatactattactaatttaggttaactttcggggtaaggtaacgggtaccggtaaaggggttcgggtaaacgggttaaccgaaaacggttacgtaggtacgggtaccttacggacctaacccgtagttcccgttggtttaccc

SEQ ID NO: 36513 - DNA, 577 bp, Homo sapiens
  misc_feature: GYAE6OF01AE294.14.56.F01.1.454.CMB.1.raw
  modified_base (205)..(205): a, c, t, g, unknown or other
  misc_feature (205)..(205): n is a, c, g, or t
  modified_base (358)..(358): a, c, t, g, unknown or other
  misc_feature (358)..(358): n is a, c, g, or t
  modified_base (562)..(562): a, c, t, g, unknown or other
  misc_feature (562)..(562): n is a, c, g, or t
tcagcgtctagtaccacgaccggtgctcgatttagcagacgtctgaacacacgaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagngtcacatcacttgccgggcagtcagaatattaataggtgttggcctggtatcagcagaaaccagggaaacgcccctaaggtcctagatactatgagtacttctaacgtttagaaacggttcggggtacccaatcgtaaaggttcacggcgganaggtggatcgtgggacagtacttcactctcactatcactagcctgaccaacctgattgtattttgactaactttatacctacgacctaactagtactatactactaagttctaatttacgttaactttcgggtagggacgggtaccggaaggttcggggaacgtacggaaacgtacgtggttacggacgttccggactaccgtnttcgtcggtttaccc

SEQ ID NO: 36514 - DNA, 559 bp, Homo sapiens
  misc_feature: GYAE6OF01ANLIH.14.56.F01.1.454.CMB.1.raw
  modified_base (278)..(278): a, c, t, g, unknown or other
  misc_feature (278)..(278): n is a, c, g, or t
  modified_base (387)..(387): a, c, t, g, unknown or other
  misc_feature (387)..(387): n is a, c, g, or t
  modified_base (548)..(548): a, c, t, g, unknown or other
  misc_feature (548)..(548): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattaataggtggttggcctggtatcagcagaaaccgagggaaacncccctaaggtcctagatatatgagacttactactttaggaaagttgggtacccagtcaaggttcagcggcaggtggatcgtggacagtaatcactctcactactcaccngcctgaccaactgatgtatttgactaactttagttactcgaccaatacgtactacatactattactaagtttgttaagtttcgggtagggtaacgggtaaccgtaagggtagggtaacggtaaccgaaacggtacgttggacggtcctacggaccaccgtntcgttgttacc

SEQ ID NO: 36515 - DNA, 614 bp, Homo sapiens
  misc_feature: GYAE6OF01B7AYD.14.56.F01.1.454.CMB.1.raw
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattaataggtgttggctggtatcagcaagaaaccgagggaacgcccctaaggtcctagatatatgtagactttctaattttaaggaaaggttcgggtaccctaagtacgaaggtttcaggcggacaggtgatcgtagggacagaattcactctacactatcaccacgcctacgacctaacctgtaacttagtatttttacgactaaactttatttaactcgaacctaaactagtactactattacctattacgtaatttaggttaagtttccgggttagggtaacggggaaccgtaaaggggtacgggtaagggtaactaaaacggtaccgtaggttacgggtacgttacggacctaaccgtacgttccgttggtttaccc

SEQ ID NO: 36516 - DNA, 515 bp, Homo sapiens
  misc_feature: GYAE6OF01ALE9K.14.56.F01.1.454.CMB.1.raw
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
  modified_base (505)..(505): a, c, t, g, unknown or other
  misc_feature (505)..(505): n is a, c, g, or t
tcagcgtctagtaccacgaccggtgctcgatttagcagacgtctgaacacacaaagggggagtcagacccagtcaggacacagcatggacatgagggtcccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtgggtccatcaaggttcagcgcagtggatcgtggacagaattcactctcactatcacngcctgcaactgatgattttgctaacttattacctnaccaacagttatacatctatctattagtaagtttcgggtaggacgggtaccgtaagggtggacggtacaaacggactggtcggctggacacccgtntccgttgttc

SEQ ID NO: 36517 - DNA, 616 bp, Homo sapiens
  misc_feature: GYAE6OF01BI2CS.14.56.F01.1.454.CMB.1.raw
  modified_base (363)..(363): a, c, t, g, unknown or other
  misc_feature (363)..(363): n is a, c, g, or t
  modified_base (472)..(472): a, c, t, g, unknown or other
  misc_feature (472)..(472): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtaccagatgtgacatccagatgacccagtcctccttccaccctgtctgcatctgtaggagacagagtcaccatcacttgccgggccagtcagtaatattaagtaggtggttaggcctggtatcgagacaagaaaccgagggaacgaccccgtaaggtcctagatatatgagtacttctaacgtttagaaaggtcgggtacccagtacgtaaggttcaggcggngagtggactcggtagggaactaggtaacttcgactctacacttatccaccgacgtcctgactaaccgtgacttgtatttgactaattatactacgacctaatagttacnctaactactactacttaatttagttaacgtttcggggagggtaacggtacgggtaacgggtagggtaaccgggttaaccaaacgggtaacgttcgggtacggaccgttacgacccgtacctacggttccttggttccttaaccg

SEQ ID NO: 36518 - DNA, 679 bp, Homo sapiens
  misc_feature: GYAE6OF01CIR63.14.56.F01.1.454.CMB.1.raw
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtcctcccttccaccctgtctgcatctggtaggagacagagtcaccatcacttcggccgggccagtcagtaaatattaagtaggtggttggcctggtatcagcaagaaacgagggaaacgcccctaaggtcctagatatagtgagtactttactactttaaggaaacggtcgggtacccaagtacgtaaggttcaaggcggacgtaggtggtactacggtaggggtaactaggtaaactttcgtaatttacctactaacttaactaccctaacccgtacgtaccccttacggaaccctaaacccgtggtaacgtttaggttaacgtttttacgaaccttaaaccttttacgttaacctacgtaaccctaaactagttaactactaacttacgtaattaccttaagtttacgttaacggttttccgggagggtacgggaaccgtaagggttcgggtaacggtacgaaaaccggtagtaggtcggacgtacggacctactacgttcgtggttcc

SEQ ID NO: 36519 - DNA, 649 bp, Homo sapiens
  misc_feature: GYAE6OF01CX35G.14.56.F01.1.454.CMB.1.raw
  modified_base (374)..(374): a, c, t, g, unknown or other
  misc_feature (374)..(374): n is a, c, g, or t
  modified_base (407)..(407): a, c, t, g, unknown or other
  misc_feature (407)..(407): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggcctcccaggtgccagatgtgacatccagatgacccagtctcccttccaccctgtctgcatctgtaggagacagagtcaccatcactcgccgggccagtcagaatattaataggtgttgctggtatcagcaagaaaccgagggaaacgcccctaaggtcctagatatatagagtacttactaactttaaggaaacggtcggggtaccccagtacgaaacggtttcaggcggcgagtggatcgngggacagtaattcactcactactactaccaccngcctacgacctaacctagtattggttattttacgaaccttaaacgtttactttacctacgaaccctaaactaagttaactactaactacttattaccttaagttttacggtttacgttttacgggtacggggtaaacggggtaccgtaaaggggttacgggtaaacgggtaaccgtaaaacggtaaacgttcgggtacggacgttaccggacctaaccgttaagtcccgtttagttaccccg

SEQ ID NO: 36520 - DNA, 715 bp, Homo sapiens
  misc_feature: GYAE6OF01A6467.14.56.F01.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (458)..(458): a, c, t, g, unknown or other
  misc_feature (458)..(458): n is a, c, g, or t
  modified_base (499)..(499): a, c, t, g, unknown or other
  misc_feature (499)..(499): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacagtccagatcgacccagtcctccttccacctgtctgcatcgtggtagganacagacgtcaacatcacttcggccggcagtcagtaatattaagtaggtggttcggccttaggtatcgagcgaacgaaaccgagggaaccnccccgtaaggtcctgtaatactatacggtagtactttactaacgtttaaggaaacggttcggggtaccctagttaccggaaagggtttccagggtccggtacggtagtaggtaacgtcgggtaggaactaaggtaattaccctacttaccgtacgtaacccttanacccgaacccgtacgtaccctacgtaaccgttaaaaccgtntagtttacggtaattttacgtaacctttaactttaacgttacccaagttacccaaagttacttaataccctaacttacgttactttacgttaacgttttacggttaaacgtttccggggtaagggtaaaccggggtacccggtaaaggggtagggtacggtaacgaaacggttaggcgtacgggtctaaccggccttaaccgtctcgttacgttcc

SEQ ID NO: 36521 - DNA, 640 bp, Homo sapiens
  misc_feature: GYAE6OF01ANWY7.14.56.F01.1.454.CMB.1.raw
  modified_base (199)..(199): a, c, t, g, unknown or other
  misc_feature (199)..(199): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccacctgtctgctatctggtaganacagagtcacatcacttcggccggcagtcaagtaattattataggtggttaggccttggtatcagcaagaaccgaggaaacgtccccgtaaggtcctagactactagtgtacgtacttacgttaacgtttaaggaaacggtcgggtacctaagtacgtaagggttaccgaggtccggataggtacggtacgtcgtagggaactagtacttcgaactctactaacgtactaccaccgtacgcctacgacctaaccgtgtatcgttactttacgaacttaaccgtttaatacctacgacccgtaaatacttaacgtaccacttacgtataccgttattaacgttacgttacgggtaaggtacggtacgtaagggtaccggtaacggtaacgaacggttgtacggtaccgtataccggaccaccgttacgtccgttgttacccc

SEQ ID NO: 36522 - DNA, 591 bp, Homo sapiens
  misc_feature: GYAE6OF01B1T5S.14.56.F01.1.454.CMB.1.raw
  modified_base (405)..(405): a, c, t, g, unknown or other
  misc_feature (405)..(405): n is a, c, g, or t
  modified_base (468)..(468): a, c, t, g, unknown or other
  misc_feature (468)..(468): n is a, c, g, or t
  modified_base (475)..(475): a, c, t, g, unknown or other
  misc_feature (475)..(475): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatccacttcggccgggccaggtcagtaaatattaagtaggtggttggcctggtatcagacaagaaaccagggaaacgcccgtaaggtcctagatatatgagtacttctaactttagaaaggtcgggtacccatacgaggttcaggcggcaggtgactcggtggacagtacttcacttctctactactacctaccncgtcctagacaactgtactgttattttcgacttaactttacttactacgacctaacacgttanactactntactctaatttagttacgtttcgggtacgggtacgggtaccgtaaggggtcgggtaacggtaacgaaacgtacgtggtacggacgtacgaccctaaccgtcgttcgttcgttcccg

SEQ ID NO: 36523 - DNA, 604 bp, Homo sapiens
  misc_feature: GYAE6OF01A0X01.14.56.F01.1.454.CMB.1.raw
  modified_base (358)..(358): a, c, t, g, unknown or other
  misc_feature (358)..(358): n is a, c, g, or t
  modified_base (435)..(435): a, c, t, g, unknown or other
  misc_feature (435)..(435): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttcggccgggccagtcagaatattaagtaggtggttggcctggtatcagcaagaaaccgagggaaacgccccgtaaggtcctagatatatgacgtactttctacgtttaggaaggttcgggtcccatcgtaggttcgagcggnagtggatcgtaggacagaacttcgacttctacactactccaccacgcctagactaaccgtagtactagttattttanaccttaactttacttacctacgaccctaacgagttacctacacttactacttcttaatttacggttacgtttcggggacggtaacgggtaccgtaaggggttacgggaacggttaaccgaaacggtaccgttgggtacgtcgtacgaccgtacctcttcgttcgttacc

SEQ ID NO: 36524 - DNA, 818 bp, Homo sapiens
  misc_feature: GYAE6OF01AKB8W.14.56.F01.1.454.CMB.1.raw
tcagcgtctagtaccacgaccggtgctcgatttagcagacgtctgaacacacaaagggggagtcagacccagtcaggacacagcatggacatgaggtccccgctcagctcctggggctcctgctgctctggctcccaggtgccagatgtgacatccagatcgacccagtcctcccttccaccctgtctgcatctgtaggagacagagtcaccatcacgtcgccggccagtcagaatagttaagtaggtggttgcgtggtatcgagacaacgaaaccgagggaaccgccccgtaaggtcctagatagtagtgtacgtactttacgttaacgtttaaggaaacggttcggggtacccctagttaccgtaacgggtttaccgaggtaccgggtacgtagggttcggtaacgttccggtagggggtaacctaaggtaaactttacccgaacccgtttcctacctaaccttaacctacccgaaccccgtacgtccccttacgaacccctaaaccgttacggtaagtttcgtttaacgttttaccggtaacccttttaaacgttttaactttaaccgtacccgtaacctaaaccgtacgtttaacctaaccttaacttacctaacgtttaccgttaagtttttaacggtttaaccgggttttaccggggtaacggggtaaacgggggtaaaccccggttaaaggggggttaccgggttaaaaccggggttaaaccggtaaaacccggttaacggttacgggttaccggtaacccggttacgaaccccgttaacccgtttctttaccggtttccgttttaacccg

SEQ ID NO: 36525 - DNA, 701 bp, Homo sapiens
  misc_feature: GYAE6OF01DIJEC.14.56.F01.1.454.CMB.1.raw
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacaggatcaccatcacttgccgggcagtacagaatattaagtaggtggttcgctggtatcagacaagaaaccgaagggaacgtaccccgtaaggtcctagatatagtgagtactttactaacgttttaaggaaaggtcggggtacctaagtacgtaaacggttcgaacggtcggacgtaggtacggtaacttccggtaggggaacaaggtaaactttccacttctacctaactactacccaaccgtcggtacctacgaacccgtaacctagtaacgttaggtaattttggaaacctttaacgtttacttaaccgtcgtaacctaacgaacggtttactacctacgtacttaacttacgttaagttttacggtttaaaggtttcgggtaaggggaaaccggggaccgttaaaggggtacgggttaaaccggtaacgaaaacggtacgggtttacggacggtaaccgttcggaaccttaacccgtaatttcgtcggtttaaccc

SEQ ID NO: 36526 - DNA, 756 bp, Homo sapiens
  misc_feature: GYAE6OF01CKDZN.14.56.F01.1.454.CMB.1.raw
  modified_base (473)..(473): a, c, t, g, unknown or other
  misc_feature (473)..(473): n is a, c, g, or t
tcagcgtctagtaccacgaccggtgctcgatttagcagacgtctgaacacacgaaagggggagtcagacccagtcaggacacagcatggacatgacgggtccccgctcagctccgtggggctcctgctgctctggcctcccgaggtcgaccagatgtacgacactcccagactacgaacccctagttccctcccttccacccgtgtcctgactatcgtagtagagaacagactccaactatactacgtcgccggacagtacagtaattaagttaaggtaggtggttcggccttaggtactaccgaggaacaaacggaaacccggagggtaaaccacccccgttaaggtacctaggtataagtactaggtaactacctttacgtaacgtttaaggaacggttcggtaccaatacggttaaggtccaggacggactaggtagactcggaaggaactaagtactcgtactccgtanactaactacaacccagtcctaacggtaccctaaacgttagaacgtttacgttaacgttttacgaaccgtttaaactttaacgtttacccgtaacgaaccttaaacgtacgttaaactaacctacgtacgttacctttaacgttactttaagggttacgtttaacgggggtaacgtaacgggttaaaccggaaggttacgggtaaccggttaaacggttaaaccgtagggtaccgtagggtaccctagtaacccgttagtaccctttgggtaaccctttacccg

SEQ ID NO: 36527 - DNA, 636 bp, Homo sapiens
  misc_feature: GYAE6OF01AWU31.14.56.F01.1.454.CMB.1.raw
  modified_base (163)..(163): a, c, t, g, unknown or other
  misc_feature (163)..(163): n is a, c, g, or t
  modified_base (423)..(423): a, c, t, g, unknown or other
  misc_feature (423)..(423): n is a, c, g, or t
  modified_base (457)..(457): a, c, t, g, unknown or other
  misc_feature (457)..(457): n is a, c, g, or t
  modified_base (628)..(628): a, c, t, g, unknown or other
  misc_feature (628)..(628): n is a, c, g, or t
tcagcgtctagtaccacgaccggtgctcgatttagcagacgtctgaacacacaaaggggagtcagacccagtcaggacacagcatggacatgaggtcccgctcagctcctgggctcctgctgctctggctcccaggtgccagatgtgacatccagatgacccngtcctccttccaccctgtctgctatctggtagagtacagacgtccaacatcctacgtggcccggccagttcaagtaattattaagtacggtaggttcgtccgtaggtatctagacaagaaaccgacggaaaccgcccgtaaggtcctagacttagttagtagacgttacttacttaacgtttaagaaacgggttccggtacctatacgtaaggttcaggtacgtcgtacgtagtactgtaggactagtaacttcacttcnctaactctacacctacgtcctgtaccctaacgtntaagtcgttacgtttcgaacttacttagttactacgtaaccaagttagtactaactactactacttacttatttacggttaacgttcgggaaacgggtcgtaaacggtagggtaacgtaaccgggtacaaacggttagcgttagccgttacgccgttaacctattccggtnttaacccg

SEQ ID NO: 36528 - DNA, 716 bp, Homo sapiens
  misc_feature: GYAE6OF01AWMAU.14.56.F01.1.454.CMB.1.raw
  modified_base (147)..(147): a, c, t, g, unknown or other
  misc_feature (147)..(147): n is a, c, g, or t
tcagcgtctagtaccacgaccggtgctcgatttagcagacgtctgaacacacgaaagggggagtcagacccagtcaggacacagcatggacatggacgggtccccgctcagctccgtgggctcctgctgctctggcctccgaggtcnccagatgtgacatcagatcgacccagtcctcccttccaccgttgtctgctatcgtaggtaggagacgagcgtaccactagtcctacgtcggccggcagtacgtaataagttaagttaagtgggttcggttcgcctaggtactacgacgacgtaaacggaaaccggtaacggtaaaccgtacccgttaacggtcctagtaacttagtaacgacgtaactttaactttaccgtttaagttaaacggtaacgggtcccggtactaacgttacgaaggttcgacggaggtacgtaggtaggacgttacgggacgaacagtacgttccctaagtcctaacgtaactacgaacctaccgaactccgtacgaacctaacgtagttacgtagttacttacgtaacttacttaacgtacctactaacacttaagtctaacttactacgtaagttaccttaagttacggttaccggtaggtaacgggaaccgtaacgggtaggttaacggtaacgtaaacggtacgtacgggttcgtacggtacgaccgtaacctacgttacgttcgttacggttaccc

SEQ ID NO: 36529 - DNA, 948 bp, Homo sapiens
  misc_feature: GYAE6OF01B2XJN.14.56.F01.1.454.CMB.1.raw
tcagcgtctagtaccacgaccggtgctcgatttagcagacgtctgaacacacaaagggggagtcagacccagtcaggacacagcatggacatgacggtccccgctcagctccgtggggctcctgctgctcgtggcctaccgaggtcgaccagtagtcgtcgacactaccgagtacgtaccgacccgtacgttcccttccccttacccgtacccgttggtcctacggtacctaacgttcggttaagggtaacgggaacgtaaccgacggtaacgttacccaacctacgttacccgtaacccggtttccggggaccccgggtaccctaaggttaccgtaaaggtttaaaacgtttaacgtttaagggttaacggggttcgggtttaccggtaccggttaggttacctaccgaacggtaaccgaaaaccgggaaacccgggtaacgggggtaaacccccttaaccccggtaaacgggtttccgtaaagttaaacgttaagttaccggtacggtaaaccgtttaccgttttaaccgtttaacgggtttaaacgggtaaaccgggtttcccgggtaacctaacggttaccggtaaggggttaccgcgggtaacggtacgttaacggttacggtacgtttacggggaggttaaaccgacgtttaacctaccgttcccgttactaaccgttaacctaccgtaccgtaaccgaccgtacctacgtaacccgtaccgtagttacgttaacgttacgtttaccgtaaacctttaacgtttacctaacgttacccgaacttaacgtaacgtacgttaactaccgttactacgtttaacgttaacgtttaggttacgtacggggtaccgggtaagtaccggtaaggggtaccgtaaccggtaaaccgaaggttccgggtagtccgtacgtacgtacctaacggttctccgttcggtaccc

SEQ ID NO: 36530 - DNA, 766 bp, Homo sapiens
  misc_feature: GYAE6OF01DKZ0C.14.56.F01.1.454.CMB.1.raw
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
  modified_base (520)..(520): a, c, t, g, unknown or other
  misc_feature (520)..(520): n is a, c, g, or t
  modified_base (575)..(575): a, c, t, g, unknown or other
  misc_feature (575)..(575): n is a, c, g, or t
  modified_base (632)..(632): a, c, t, g, unknown or other
  misc_feature (632)..(632): n is a, c, g, or t
  modified_base (643)..(643): a, c, t, g, unknown or other
  misc_feature (643)..(643): n is a, c, g, or t
tcagcgtctagtaccacgaccggtgctcgatttagcagacgtctgaacacacgaaagggggagtcagacccagtcaggacacagcatggacatgacgggtccccgctcagctccgtggggcctcctgctgctcgtggcctcccgtaggtcgaccgaagtgtgtacgacacgtccgaagactaccgaccctacgttcccttccctcccgaccctcgtcctcgacttacgttcgtacggtaacggtacgacgtacgtaccgtaccaacctctccgtaaccggttccggaccccgggacctacggtacgtaagttaaacgtttaaagttaaggttacggggttggttccgggtaccgttagggtacttagaccgtacgaaacgaaacggaaccggtaaccgtaacccggtaacgtcgtagtatacgtagcggtaactactttacgtacgttaaggtaacgggtccggtacctagtacgttanacggcgtcggntaggtnacgtagtaggaacctagtactacnctaccgttacaactaccgtaccaccgccgtaaccgtccgtaacctaaaccggttntaacggttacgtttacgttacgttaaccttaaacgttactttaacgtacaacttaanactcgtaactnttacttacgtattaacgttagttagggtaccgggtaggaccgggtaagtaacgggtaggtaaccgttaacgtaaggtaccgttaggtcgtaacctcgtaacgtactcttcggttcttacccgg

SEQ ID NO: 36531 - DNA, 899 bp, Homo sapiens
  misc_feature: GYAE6OF01AYUL0.14.56.F01.1.454.CMB.1.raw
  modified_base (121)..(121): a, c, t, g, unknown or other
  misc_feature (121)..(121): n is a, c, g, or t
tcagcgtctagtaccacgaccggtgctcgatttagcagacgtctgaacacacaaagggggagtcagacccagtcaggacacagcatggacatgacggtccccgctcagctcctgggctccngctgcctcgtgctcctaggtcgccagtatgtgaacactaccgagtaactaccgtaccctacgtcccttacccttacccgtaaccctcggtccttcgtacctacgttacgttacggtaaggtaacggaacgaacggtaccttaccccgaaccaccttaacccgttccggttaccggggccccgggtaccgtaacggttaaccgaaagttaaacttaaggtttaaggtttacgggtttagggttcggtaaccgttgggtaacttccgaacggaccgaaaacggtaaaccccggggaaaacggtaaaccccgtaacccccgttaaagggttcctaaggtttaacctaagttaaggtttgaaccgtttaacctttaacccgtttaagttaaaaaccggggtaccgggttacgttaaccctaacgtaaccgtaacggtttaccgacgggtaccgggtagaacgggttacgtaccgggtttcgaacggggtaacacgtttaaccttaaccctacgtttaccgacctttaaacgtaacccttacgaacccgttccgtaacccgtacccgtactaaccgttaacggtatttacgggttaacttttacgggtaacccttaaccgtttaaacttaaccggttacgtaacctaaccgttagtaccttaacgactttacgttaccttaacgtttacgttaggttacgttacgggtacggtacggtacggtacgtaacggtacgtacgtaacgtcgtaagtcgtaccgtcgatacgtcctggtcttacccg

SEQ ID NO: 36532 - DNA, 544 bp, Homo sapiens
  misc_feature: GYAE6OF02HDUXN.14.56.F01.1.454.CMB.1.raw
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattaataggtggttggcctggtatcagcagaaaccagggaaagccctaaggtcctgatatatgagacttctactttagaaagtgggtacccatcaaggttcagcggcagtggatctgggacagaattcactctctactatcaaccagcctgaccaacctgaactgtattttgactaaactttattactcgacctaacagttatcaatctaatctatttagtaagtttcggtggtaagggacctaagggtacgggtaagggtactaaacggaacttggtaggacgttcgacctaaccgacttcgtagttccg

SEQ ID NO: 36533 - DNA, 493 bp, Homo sapiens
  misc_feature: GYAE6OF02GZ66J.14.56.F01.1.454.CMB.1.raw
  modified_base (422)..(422): a, c, t, g, unknown or other
  misc_feature (422)..(422): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaaggtcctgatatatgagacttctactttagaaagtggggtcccatcaaggttcagcggcagtggatctgggacagaattcactctcactatcaccagcctgcaacctgatgattttgctaactttattactgaccaanagtatcatcatcattgtaatttcggtgagggaccaaggtggaggtcaaacgactgtggctgcacatctgtc

SEQ ID NO: 36534 - DNA, 513 bp, Homo sapiens
  misc_feature: GYAE6OF02GB5IX.14.56.F01.1.454.CMB.1.raw
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctggatatatgagacttctactttagaaagtggggtcccatcaaggttcagcggcagtggatctgggacagaattcactctcactatcacagcctgcaactgatgattttgctaacttattactgtaccaacagtatcatcagtcattgtaatttcggtagacgggacaagggtggaacggtacaaacggtaactgtacggtctcggaccacctatcgtgttacc

SEQ ID NO: 36535 - DNA, 491 bp, Homo sapiens
  misc_feature: GYAE6OF02HBDTF.14.56.F01.1.454.CMB.1.raw
  modified_base (447)..(447): a, c, t, g, unknown or other
  misc_feature (447)..(447): n is a, c, g, or t
  modified_base (485)..(485): a, c, t, g, unknown or other
  misc_feature (485)..(485): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccaggggaaagcccctaaggtcctgatatatgagacttctactttagaaagtggggtcccatcaaggttcagcggcagtggatctgggacagaattcactctcactatcaccagcctgccaacctgatgattttgctaacttattactgccaacagtatcatcatcattgtaatttcggngaggaccaaggtggaaggtacaagactgtggctgcacntctgtc

SEQ ID NO: 36536 - DNA, 545 bp, Homo sapiens
  misc_feature: GYAE6OF02FF83L.14.56.F01.1.454.CMB.1.raw
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (376)..(376): a, c, t, g, unknown or other
  misc_feature (376)..(376): n is a, c, g, or t
tcagcgtctagtaccacgaccggtgctcgatttagcagacgtctgaacacacaaagggggagtcagacccagtcaggacacagcatggacatgagggtccccgctcagctcctgggctcctgctgctctggctcccaggtgccagatgtgacatccagatgacccagtctccttccaccctgtctgcatctgtaggagacagagtcaccatcacttgccgggcagtcagatattaanaggtgttgcctggatcagnagaaaccngggaaancccctaaggtcctgactatatgagtacttctactttagaaagtcgggtccatcaaggttcagcggcagtggatcgtgggacagtaattcactctcactatcaccngcctgctaacctgatgattttgactaactttattacctgaccaactagtactcagtccattctaattgttaaacgtttggtacgggagggtaccgaagggtcggtaaggtacctaaaacggtaaccttaggtacggtacttcggacctaaccagttccgtgtttacccg

SEQ ID NO: 36537 - DNA, 502 bp, Homo sapiens
  misc_feature: GYAE6OF02IGMOA.14.56.F01.1.454.CMB.1.raw
  modified_base (278)..(278): a, c, t, g, unknown or other
  misc_feature (278)..(278): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaacnccctaaggtcctgatatatgagcttctacttagaagtgggtccatcaaggttcagcggcagtggatcgtgggacagtaattcactctcactactcaccagcctgaccaactgatgtatttgactaacttattactcgaccaactagtatcatcatctattgttaatttcggtaggagggaccaagggtggaaggtacaaacgagtgtgctgacactatctgtac

SEQ ID NO: 36538 - DNA, 644 bp, Homo sapiens
  misc_feature: GYAE6OF02GCWVG.14.56.F01.1.454.CMB.1.raw
tcagcgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcactgccggccagtcagaatattaagtaggtggttggcctggtatcagacaagaaaccgagggaaacgaccccgtaaggtccgtagattatataggacgtactttacgttaacttttaaggaaaggttcggggtacccaagttacgtaaaggttccgaggacgggcgtaaggtcggtagttcggtaggggactaaggtaacttaccaccttcctactacttacgtaccaaccgacgtccctgaccaacctagattacgtattttacgacttaactttaacttaccttacgacctaactagttactacctatacattacgtatttagttaacgtttgggtacggaacgggttacgtaaggggtaggtaacggtaaccgtaaacggtacgttgggtacggtacgtcggaccctaccgtactttcgtcgttaccg

SEQ ID NO: 36539 - DNA, 748 bp, Homo sapiens
  misc_feature: GYAE6OF02JK3AC.14.56.F01.1.454.CMB.1.raw
tcagcgtctagtaccacgaccggtgctcgatttagcagacgtctgaacacacaaaggggagtcagaccagtcaggacacagcatggacatgagggtcccgctcagctcctgggctcctgctgctctggcctcccaggtgccagatgtcgacagtccagatcgacccagtctccttccaccctgtctgcatctcgtaggagactagagtccaccatcacttgcccgggcctaggtcagaacttattaactaggtaggttggtccgtaggttactacgtagtaccaagtaaaccgaaggggaaacgtaccccgtaaagggttccctagtaacgtaacttacgtagtaacgtaaccgttctttaacggttttaacgtaaacgggttacgggggttaccccgtaaagtacctaaacgggtttacctagggaccggtctaaggtttgggtaaccgttcgttagggggaacctaaggaaacgttttccaaccgtttaccgttaccgacgttaacttaccgtaacccgacgtacccgttacgccgtaaaaccctgtaacgttacgtacgttttacggacttaaacctttacgttaacttacgtaacccgtactaacggttaactacctaaccttctaacttacgtacttagtttaacgtttaggtacggtaagggtaccctaaagggtcggttaaaggtctaaaaccggtcgtaaggttggtacctaggtaccaacccgtcttacgttcggttac

SEQ ID NO: 36540 - DNA, 873 bp, Homo sapiens
  misc_feature: GYAE6OF02H5CHE.14.56.F01.1.454.CMB.1.raw
  modified_base (124)..(124): a, c, t, g, unknown or other
  misc_feature (124)..(124): n is a, c, g, or t
  modified_base (187)..(187): a, c, t, g, unknown or other
  misc_feature (187)..(187): n is a, c, g, or t
tcagcgtctagtaccacgaccggtgctcgatttagcagacgtctgaacacacaaagggggagtcagacccagtcaggacacagcatggacatgacgggtccccgctcagctccgtggggctccngctgctctaggcctcccagggtcgccagatgtgacactccagatcgacccagtcctccttccncccgtgtctgacactcgtgtaggacgactagacgtcacctatctaacgttcggcccgggctaacgtcgaaacgtaattaagttaagttaggggttacggttacggtaccgtgggtaactccgaacgtacgaaacgggtaaaacccgaagggggaaaacccgtaccccggtaaacggttacccgtaagtaacgtaacttaaggttcgtaaacgtaaccttttacgtttaacgtttaaaagggaaacgggtttccggggtaaccctaagtaaccggttaacggttaccgaggtaccggagtacggaggtactacggtacgggtaacaagtaacttccaccgtacgtacctaacttactaccgtaacccgacgtaccctacggtaaccctacgtaacggttaacgtcggtttaaactttaccgtaaccgtttaaacgtttacgttaaccgttaaccgtaacgtaaaaccgttaggttaacccttaacgttaacttaccgttaaaccgttaccgttttaaacgtttccggtttaaagggtttacccgggggttaacggggttaacccggggtaaacccgggttggggttaaacgggtaaccggttaaaccggtaaaaccggtaccgggttttagacggggttcccgaaacggttcccccaacggttacgtttacccgttagtttaccccg

SEQ ID NO: 36541 - DNA, 539 bp, Homo sapiens
  misc_feature: GYAE6OF02FLW3E.14.56.F01.1.454.CMB.1.raw
  modified_base (130)..(130): a, c, t, g, unknown or other
  misc_feature (130)..(130): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
tcagcgtctagtaccacgaccggtgctcgatttagcagacgtctgaacacacaaagggggagtcagacccagtcaggacacagcatggacatgagggtccccgctcagctcctggggctcctgctgctcnggctcccaggtgccagatgtgacatccagatgacccagtcctccttccacctgtctgcatctagtaggagacagagtccacatcactgccggcagtcagaatatataggtgtgctggtatcngcagaaacagggaacncccgtaaggtcctgatatatagagtacttattacgttaagaaggtcgggtccatacgaaggtcaggcgntagcggatcgtaggganagtaatcactcncactntcacngctcgactactgatgtatttcataacttatacctnaccatacgtatcatactatcttagttagttaagtttcggtagggtacggacggagggtaagggtggtaaccgtaaccgtaaggtacgggtacgtcgtacgttccaaccgtagttacgtagtttacccg

SEQ ID NO: 36542 - DNA, 989 bp, Homo sapiens
  misc_feature: GYAE6OF02IB4FB.14.56.F01.1.454.CMB.1.raw
tcagcgtctagtaccacgaccggtgctcgatttagcagacgtctgaacacacaaaggggagtcagacccagtcaggacacagcatggacatgagggtccccgctcagctccgtggggctccgtgctgcttcgtggctcccaggtcgccagatgtgacatccaagatcgaccagttcctcccttcccacctgtctgactatcgtggtaggacgacgagcgtaccgaccatccgtacgttccggccgggtaccaggtaccaagtaaattaagtttaacgtaggttgggttcgtccgttaggtactcgacggacgaacgaaaccggaacgggtaaaccccggtaacccgtacggttacccgtagtaacgtaacgttacggtaggtacgtaacctttaccgttttaaacgtttaacgggtaaaggttaccggggggtacccctaaggtttaaccggaaagggtttaccgacggtaccggtagggtaaccggttgggtaacgttcggtaacggggtaccgtaagttaaaccgtttacctaacgttaccgtttacccgtaaacgttaacttacccgtaacccttaaaccgggtccccgttaaacccgtacccgtaaaccgtttacgggtaaaccgtttaggtttttaaacggttttacttaaacccgtttaaaactttttaaaccggttaacccgttaaccggttaaacccgtaaacggtaaacgtttttaaccgtaacccgtttactaacctttaaacccgttttaaacgtaaaccgggtttttttaaggtttaaaccggggttttacgggtaaccgggggtttaaaacggggtaacccccgggttaaaagggggggtttaaccgggttaaccggggtttaaaacccgaaaaccggggtttaaccgggttaaccggttaaccgggggttaacgtacccggttaccccggaaaccggttttaacgtttacccggtttacccgttttaaccccggg

SEQ ID NO: 36543 - DNA, 484 bp, Homo sapiens
  misc_feature: GYAE6OF01COFTL.23.47.E03.1.454.CMB.1.raw
  modified_base (480)..(480): a, c, t, g, unknown or other
  misc_feature (480)..(480): n is a, c, g, or t
tcagacgcgagtatcacgaccggtgctcgatttagactcgcgcacagagagaagggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaagggccgctggcgtcccagccaggtttcgtggcagtggaagtgggacagacttcactctcaccatcggcagtctagagcctgaagattttgctagtttattactgtcagtcagcgcagcagctggatcacgttcggccaagggacacgactacgaaattaagcgaactgtgctgcacatctgtcttcatcttcccgctatctgaatctcgctctgagcggctggcaaggcnatag

SEQ ID NO: 36544 - DNA, 489 bp, Homo sapiens
  misc_feature: GYAE6OF01C2UWP.23.47.E03.1.454.CMB.1.raw
  modified_base (460)..(460): a, c, t, g, unknown or other
  misc_feature (460)..(460): n is a, c, g, or t
  modified_base (483)..(484): a, c, t, g, unknown or other
  misc_feature (483)..(484): n is a, c, g, or t
tcagacgcgagtatcacgaccggtgctcgatttagactcgcgcacagagagaagggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaagggccgctggcgtcccagccaggtttcgtggcagtggaagtgggacagacttcactctcaccatcggcagtctagagcctgaagattttgctagtttattactgtcagcagcgcagcagctggatcacgttcggaccaagggacacgactcgaaattaagcgaactgtgctgcaccatctgtcttcatcttcccgctatctgaatctcgngtctgacgcgggctggacaggcnngtacg

SEQ ID NO: 36545 - DNA, 486 bp, Homo sapiens
  misc_feature: GYAE6OF01BK15O.23.47.E03.1.454.CMB.1.raw
  modified_base (436)..(436): a, c, t, g, unknown or other
  misc_feature (436)..(436): n is a, c, g, or t
  modified_base (447)..(447): a, c, t, g, unknown or other
  misc_feature (447)..(447): n is a, c, g, or t
  modified_base (481)..(481): a, c, t, g, unknown or other
  misc_feature (481)..(481): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaagggccgctggcgtcccagccaggtttcgtggcagtggaagtgggacagacttcactctcaccatcggcagtctagagcctgaagattttgctagtttattactgtcagcagcgcagcagctggatcacgttcggccaagggacacgactcgaaattagcgaactgtggctgcaccatctgtcttnactctcccgcntctgaatctcgctctgacgcgggctggcaaggcngatag

SEQ ID NO: 36546 - DNA, 521 bp, Homo sapiens
  misc_feature: GYAE6OF01C25ZP.23.47.E03.1.454.CMB.1.raw
  modified_base (515)..(515): a, c, t, g, unknown or other
  misc_feature (515)..(515): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgtgacacatattttgcctggtaccagcagaaacctggccagcctcccaggctcctcatctatgatgcgtaccaaaagggccgctggcgtccagccaggtttcgtggcaggtggaagtgggacagacttcactctcaccatcggcagtctagacgcctggaaagtattttgctagtttattactgtcagcagcgcagcagctggatcgacgttcggaccgaagggacacgactacgaaattaagcgtaactgtggctgacaccatcctgtccttcacttccttcccgcctatctagtaactaccgtcgtcgtctggacggtcgggctcgggacaagggccngagtag

SEQ ID NO: 36547 - DNA, 483 bp, Homo sapiens
  misc_feature: GYAE6OF01CR5CB.23.47.E03.1.454.CMB.1.raw
  modified_base (479)..(480): a, c, t, g, unknown or other
  misc_feature (479)..(480): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaaagggccgctggcgtcccagccaggtttcgtggcagtggaagtgggacagacttcactctcaccatcggcagtctagagcctgaagattttgctagtttattactgtcagcagcgcagcagctggatcacgttcggccaagggacacgactcgaaattagcgaactgtggctgcaccatctgtcttcatctcccgcatctgatactcgctctgagcgggctggcaggcnntag

SEQ ID NO: 36548 - DNA, 525 bp, Homo sapiens
  misc_feature: GYAE6OF01C2FIJ.23.47.E03.1.454.CMB.1.raw
  modified_base (447)..(447): a, c, t, g, unknown or other
  misc_feature (447)..(447): n is a, c, g, or t
  modified_base (517)..(517): a, c, t, g, unknown or other
  misc_feature (517)..(517): n is a, c, g, or t
tcagacgcgagtatcacgaccggtgctcgatttagactcgcgcacaggagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaacctggccagcctccaggctcctcatctatgatgcgtacgaaaagggccgctggcgttcccagccaggtttcgtggcagtggaagtgggacagacttcactctcacatcggcagtctagagcctgaagtatttgctagtttatacgtgtctagctagcgcaggtcagcgtggactcgacgttcggaccaagggacacgactacgaaattagacgtaactgtagctgacacatctgtcttnattacttcccgactacttctagtaactccgtacgcgtacgtcggacggccgggtctcgggacgagggcgngtacgtag

SEQ ID NO: 36549 - DNA, 490 bp, Homo sapiens
  misc_feature: GYAE6OF01ESQY1.23.47.E03.1.454.CMB.1.raw
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtaccaaaagggccgctggcgtcccagccaggtttcgtggcagtggaagtgggacagacttcactctcaccatcggcagtctagagcctgaagattttgctagtttattactgtcagcagcgcagcagctggatcacgttcggcaagggacacgactcgaaattaagcgaactgtggctgcaccatctgtcttcatcctcccgctatctgaatctcgcgtctgacgcgggctggcaaggcncngtag

SEQ ID NO: 36550 - DNA, 493 bp, Homo sapiens
  misc_feature: GYAE6OF01DFLGI.23.47.E03.1.454.CMB.1.raw
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaacctggccagcctccaggctcctcatctatgatgcgtcgaaaagggccgctggcgtcccagccaggtttcgtggcagtggaagtgggacagacttcactctcaccatcgcagtctagagcctgaagtattttgctagtttattactgtctagcagcgcagcagctggatcgacgttcggccaagggacacgactacgaaattagacgactgtgctgcaccatctgtctcattcctccgcctatcagtatacgtcgtcgtctgacggcggctcggacaggcgngntag

SEQ ID NO: 36551 - DNA, 500 bp, Homo sapiens
  misc_feature: GYAE6OF01B63IJ.23.47.E03.1.454.CMB.1.raw
  modified_base (474)..(474): a, c, t, g, unknown or other
  misc_feature (474)..(474): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggcctcctcatctatgatgcgtaccaaaagggcccgctggcgtcccagccaggtttcgtggcagtggaagtgggacagactcactctcaccatcggcagtctagagcctgaagtattttgctagtttattactgtcagcagcgcagcagctggatcgacgttcggcaagggacacgactacgaaattaagacgtaactgtgctgcacctatctgtcttcacttctcccgctatctgaactctcgcgttcngacgcggctcgggacaaggccngntg

SEQ ID NO: 36552 - DNA, 594 bp, Homo sapiens
  misc_feature: GYAE6OF01BUJ00.23.47.E03.1.454.CMB.1.raw
  modified_base (345)..(345): a, c, t, g, unknown or other
  misc_feature (345)..(345): n is a, c, g, or t
  modified_base (379)..(379): a, c, t, g, unknown or other
  misc_feature (379)..(379): n is a, c, g, or t
tcagacgcgagtatcacgaccggtgctcgatttagactcgcgcacaggacgagaagggggaactgcctcagttaggacccacgagggaaccatggaagcccccagctcagcttctcttcctcctgcttactctggctcccagggggaaacgagccgacgcctcctccctgccagggccagccagagtgttggacacatatttgcctggtaccagcagaaacctgggcccagccctacccgaggtcctccgtcactcctatgatgcgtaccaaaagggccgcgtgggccgtcccacggcccgacgggtttcgaggcaggtggaaggtgggacagtacgttcactcncaccgatcggcacgtactaagcgcctagaacgtntttgctagtttatactgtacgagcagcgcgagcagtctaggatcgacgttcgacgaagggcacgactacgaaagttacgacgtaacgtcggtcgtctcgacctacctagttccgtgttcccttactacgttcccgttcccgcctacttcttacgtaacttaccgtcgtacgttcgtcggacgggtccggacgtcggacgaacggccgcgtgtacg

SEQ ID NO: 36553 - DNA, 497 bp, Homo sapiens
  misc_feature: GYAE6OF01AR9DL.23.47.E03.1.454.CMB.1.raw
  modified_base (493)..(493): a, c, t, g, unknown or other
  misc_feature (493)..(493): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaagggccgctggcgtcccagccaggtttcgtggcagtggaagtgggacagacttcactctcaccatcggcagtctagagcctgaagtattttgctagtttattactgtcagcagcgcagcagctggatcgacgttcggccaagggacacgactacgaaattaagacgaactgtggctgcaccatctgtcttcatcctccgcatctgaactcgtcgtcgtctcgacggcggctcggacaaggcgnagtg

SEQ ID NO: 36554 - DNA, 516 bp, Homo sapiens
  misc_feature: GYAE6OF01DLW7W.23.47.E03.1.454.CMB.1.raw
  modified_base (284)..(284): a, c, t, g, unknown or other
  misc_feature (284)..(284): n is a, c, g, or t
  modified_base (319)..(319): a, c, t, g, unknown or other
  misc_feature (319)..(319): n is a, c, g, or t
  modified_base (510)..(510): a, c, t, g, unknown or other
  misc_feature (510)..(510): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacattattttgcctggtaccagcagaaacctggccagccctcccaggctcctcatctatgatgcgtaccaaaagggccgctcggcgtcccagccaggtttcgnggcaggtggaaggtgggacagacttcactctcacntcgcagtcagagcctgaagtatttgctagtttattactgtcagcagcgcagcagctggacttcgacggttacggacccgaaagggacacgacgtacgaaattaagaccgtaatggtacgctgcaccatcttgtctctactccttcccgctatctgaatcgtcgtcgtctgacggcgggcgtggacgaggcntagtag

SEQ ID NO: 36555 - DNA, 710 bp, Homo sapiens
  misc_feature: GYAE6OF01C33E7.23.47.E03.1.454.CMB.1.raw
  modified_base (232)..(232): a, c, t, g, unknown or other
  misc_feature (232)..(232): n is a, c, g, or t
  modified_base (280)..(280): a, c, t, g, unknown or other
  misc_feature (280)..(280): n is a, c, g, or t
  modified_base (326)..(326): a, c, t, g, unknown or other
  misc_feature (326)..(326): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccagggggaaagagccacgctctcctgcagggccagccagagtgttgacacatattttgcctggtaccagcagaaacctggccagcctccaggctcctnatctatgatgcgtaccaaaaggccgctggcgtcccagccaggtttcgnggcagtggaagtgggacagacttcactctcacatcggcagtctagngcctagagtatttgctagtttattactgtcagtcagcgacacgacagtccgtaggacttaccgtaccgttaccgggacccgtaaagggggtaccaaccggtaccttaacggtaaaacgttaacgggaaccgtaaaccgttgggtttacggggaccttacgggaccctaacccgtaacgtttcccggtttacgggtttacccttttacccgttaaccgtttaacccccgttttcccccgggtacccttaaccgtttaacccgttacgggtaaaaccttacccggttacccggttaaccggtttcccggttaacgggaaccggggtcccggggtacccgttacggggaacccggtaaggggtacccgtaaccgtacggtaaccggg

SEQ ID NO: 36556 - DNA, 553 bp, Homo sapiens
  misc_feature: GYAE6OF01AQQ3F.23.47.E03.1.454.CMB.1.raw
  modified_base (367)..(367): a, c, t, g, unknown or other
  misc_feature (367)..(367): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaagagccacgctctcctgcagggccagccagagtgttgacacatattttgcctggtaccagcagaaacctggccagcctccaggctcctcatctatgatgcgtccaaaagggccgctggcgtcccagccaggtttcgtggcagtggaagtgggacagacttcactctcaccatcggcagtctagagcctggaagtattttgactagtttaattactgtcagcaggcncagcagtctggatccgacgttcggaccgaaagggacaacgactacgaaagttagacgtaactgtcggctcgacaaccgtatcgtcgttaccttcacttcccttccccgcctagttcctacggaaacttcccgtcggtccgttcgtggacgggtcgggccgttacgggaccaagggccgagtagtag

SEQ ID NO: 36557 - DNA, 510 bp, Homo sapiens
  misc_feature: GYAE6OF01ELXHB.23.47.E03.1.454.CMB.1.raw
  modified_base (504)..(504): a, c, t, g, unknown or other
  misc_feature (504)..(504): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtaccaaaagggccgctggcgtcccagccaggtttccgtggcagtggaagtgggacagacttcactctcaccatcggcagtctagagcctgaagattttgctagtttattactgtcagcagcgcagcagctggatcacgttcggacaagggacacgactacgaaattaacgcgtaactgtcggctgacaccatcctgttcttcatccttcccgctatctagaacttacgtcgcgtctgaggtccgggctggacaaggcgtnagtacg

SEQ ID NO: 36558 - DNA, 536 bp, Homo sapiens
  misc_feature: GYAE6OF01AET2T.23.47.E03.1.454.CMB.1.raw
  modified_base (287)..(287): a, c, t, g, unknown or other
  misc_feature (287)..(287): n is a, c, g, or t
  modified_base (506)..(506): a, c, t, g, unknown or other
  misc_feature (506)..(506): n is a, c, g, or t
  modified_base (532)..(532): a, c, t, g, unknown or other
  misc_feature (532)..(532): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagccctcccaggctcctcatctatgatgccgtaccgaaaagggccgctcggcgtcccgagccgaggtttcgnggcgaggtggaaggtgggacagacttcactctacaccatcggcagtctagacgcctagaagtagtttgacttagtttaattacgtgtcacgcagcgtcacgcagctggactcgtacggtcggaccgaaggacacgtactacgaaattacgacgaacgtggtgctacgacacctatctagttctcacttcccgtccacctatctataactcgtcgcgtcnggacggcggcgtacggcgaaggcgangtag

SEQ ID NO: 36559 - DNA, 523 bp, Homo sapiens
  misc_feature: GYAE6OF01E1VF2.23.47.E03.1.454.CMB.1.raw
  modified_base (310)..(310): a, c, t, g, unknown or other
  misc_feature (310)..(310): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtaccaaaagggccgctggcgtcccagccaggtttcgtggcagtggaagtgggacagacttcactcncaccatcgcagtctagagctgaagtatttgctagtttattactgtctagcagtcgcagcagcgtggactcgacgttcggaccgaaagggacacggactacgaaagttaacgcgtaacgtgtggctgacaccatctcgtcttcactcctcccgctatctagtaacttaccgtcgtcgttcgtggacgtcgggctcggacgaagggcgcgagtag

SEQ ID NO: 36560 - DNA, 566 bp, Homo sapiens
  misc_feature: GYAE6OF01AL0MK.23.47.E03.1.454.CMB.1.raw
  modified_base (347)..(347): a, c, t, g, unknown or other
  misc_feature (347)..(347): n is a, c, g, or t
  modified_base (465)..(465): a, c, t, g, unknown or other
  misc_feature (465)..(465): n is a, c, g, or t
  modified_base (562)..(562): a, c, t, g, unknown or other
  misc_feature (562)..(562): n is a, c, g, or t
tcagacgcgagtatcacgaccggtgctcgatttagactcgcgcacagagagaagggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtaccgaaaaggccgcttggtcgtcccaggtccctaggtttcgtaggcgaggtggaagtgggtacagactcactctcaccagtcgcagtctagcgcctagaagtnttttgctagtttattacgtgtcagtccgagccgtacagcagctaggattccgacggttacggaccgtaaggacacggtacctacgaaagttacggactaacgtgtacggtctcgaccnctaagtcgtacgttacttctaacgttccctcccgtactacgtcttacgaacttcgtcgcgtttacgcgacggtcggtctacggacgaacgcgtacgntacg

SEQ ID NO: 36561 - DNA, 571 bp, Homo sapiens
  misc_feature: GYAE6OF01AD61Y.23.47.E03.1.454.CMB.1.raw
  modified_base (563)..(563): a, c, t, g, unknown or other
  misc_feature (563)..(563): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcaagaacctggccagcctcccaggctcctcatctatgatgcgtaccgaaaagggccgctcggccgtcccagccgtaggtttcgtggcgagtggaagtgggacagacttcactctcaccatcggcagtctagacgcctagaagtatttgactaagtttattactgtacagacagcgcagcgagctaggactcgacggttcggacgaacgggacacgtacacgtaaatacgacgtaacgtggtacgtctacgccacctaattccgttgttaccttctaccttcccgttcccgacctatccgttagtaacttaccgtcggtccttcgtcggaccgggtcgggtccgtacgggactaaagggccngaatacgg

SEQ ID NO: 36562 - DNA, 769 bp, Homo sapiens
  misc_feature: GYAE6OF01EK2HV.23.47.E03.1.454.CMB.1.raw
tcagacgcgagtatcacgaccggtgctcgatttagactcgcgcacagagagaagggggaactgctcagttaggacccagagggaaccatggaagccccagctcagcttctcttcctcctgctactctggctcccgaggggaagagccacgctctcctgcagggccagccagagtgttgacacattattttgcctggtaccagacaacgaaacctggccacgccctccgaggtcctcctcatctatgatgacgtaaccgaaacgggccgcgtcggccgtcccacgtccgtagggtttcgtggactaggtagggtaaggtcggggaactacggtacctttccgaccgttaccgtacccaaccgtacgttacccgggaccgtaacggtaccgttaaggaccgtacccgttaaggtaaacgttacgtttttacgacgttttaaagtttaactttacgttacgttaccgacggtacaaggtccgtacgacgacgtacgggtacgttacggaacgttaccggtacgggttacccgggaaccggaaacgggtaaacctaccgtaaaccgttaacggtaaaaacgttacggaaccgttaaacggtggttacggcctacgaacccgtacctaacgttccgttacgttccttaccgtacctttccccggtttaccccgacctaacgttaccgtacgtaaccgtttacccgccggttaccggtacggtccggacgggtaccgggtccggtacgggaccgaagggtcccggtataacggtg

SEQ ID NO: 36563 - DNA, 739 bp, Homo sapiens
  misc_feature: GYAE6OF01BICYG.23.47.E03.1.454.CMB.1.raw
  modified_base (144)..(144): a, c, t, g, unknown or other
  misc_feature (144)..(144): n is a, c, g, or t
  modified_base (325)..(325): a, c, t, g, unknown or other
  misc_feature (325)..(325): n is a, c, g, or t
tcagacgcgagtatcacgaccggtgctcgatttagactcgcgcacagagagaagggggaactgctcagttaggacccagagggaaccatggaagccccagctcagcttctcttcctcctgctactctggctcccgaggggaaanagccacgcctctcctgcgacgggccagccagagtgttagacactattatttcgcctggtaccagcaacgaacctggaccacgccctcccgacggtcctcctctactctagtgtacgtcgaccgtaaccgaaaacgggcccgtcgtcggcccgtacccgaggtcccgttacgggtttccggnggccgtagggtaggtaaagggtcgggaacacgtaccgtttccaaccttctaccaacctacgtccggacgtacgtacgtacggacgtacctaggtaacgttacgtttgtacttaagttttaacttcgtagtacgagtcgacgtcgacgtacggcgaggtacgtcggtacgtccgtaccggttaccggaccggaaacgggtaccaaccggtaactaacgggtaaacgttacggaaccgtacgtcggtacgaccgttacgaaccgtaccgttaacgttccggttacggtttaccctttaccgtaaccccgtttcccgttacccccgtacgtaccgttacgtaccggttaaccgttacccgtaccggtcgttacgtacgggccgtacgggtccgtacgggacgacggccagtagtacg

SEQ ID NO: 36564 - DNA, 934 bp, Homo sapiens
  misc_feature: GYAE6OF01BYU12.23.47.E03.1.454.CMB.1.raw
  modified_base (144)..(144): a, c, t, g, unknown or other
  misc_feature (144)..(144): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaanagccacgctctcctgcagggccagccagagtgttgacacatattttgcctggtaccagcaagaaacctggccagccctcccgaggcctcctcatctatgatgaccgtaccgaaaacgggccgcgtcggccgtaccagtcccgtaggtttccggtggaccgtaggtagggtaaaggttacggggaactacgtacttcctaactccttaccaaccctaagttccgggacctaacggttaccgttaaggaaccggtacccgttaaggtaaaacggtttacgtttttacggaccgtttaaaggttttttaaacgttttaccggttacgtttaccggtaaacgggtaccgtaacggtacccggtaaccgaacggttacccggaacgggtcccggtttaacgggtaacccgtttacccggtaaaccccgggggttttacccgggggaaacccccggttaaaaacggggggaaaccccgtaaaaccgggttaaacccccgttaaacgggttaaaaaaaccggttttaaaccggggtaaaccccgggttaaaaccggtttacgggggttaccggggtaaccggtttaaccgggaacccctttaaaccccggtaaacttttccccgggtttacggttttaaccctttttaccgtaaacccgttttccccccggtttacccccccggtaccctaacgtttacccgtagttaaacccgttcccgtaccgggttccgttaccggtcgggacgggtacccggggtctacggggacccggtaaccggaccgtccgttaagacgg

SEQ ID NO: 36565 - DNA, 833 bp, Homo sapiens
  misc_feature: GYAE6OF01EDCEC.23.47.E03.1.454.CMB.1.raw
  modified_base (151)..(151): a, c, t, g, unknown or other
  misc_feature (151)..(151): n is a, c, g, or t
  modified_base (680)..(680): a, c, t, g, unknown or other
  misc_feature (680)..(680): n is a, c, g, or t
tcagacgcgagtatcacgaccggtgctcgatttagactcgcgcacagagaggaaggggggaactgctcagttaggacccagagggaaccatggaacgccccagctcagcttctcttcctcctgctactctcggcctacccgaagggggaanacgccacgctctcctgccgagggccagccagagtgttgacactattatttcgccgtacggtaccagacaacggaaccgtcggccacgccctccgacggtccctcctctacttctagtcgacgtcggaccgttaaaccggaaacgggtcccggcgtaccgggcccgtaccgacgtccggttacggtttcgggtcggacgtagggtacggggtaaggtacgggacgtaacgttacctttaccgaccttaccgtaccaaccgtacgttacccggagttaaccggttcgtaacgggtacggtaccggttaaggttaaacgttttaacgttttcggtaaccgtttaaagtttttacggtttaacttcggttaccggtacggtaaccgacgacgggtacgacgttaccggacgtacggtaccgtaacggttaccggtaccggttacccgggaacggtaacggaaccgtaaccggtaacgtaacggtaaacgtacggtaacgttacggtcggtacgtcgtaccgactacccggttnttccgttacgttccgtttaaccctccgtttacccaccgtttccctagttaaccgttacgtaaccttcccgggttcccgtcgggtttaacgggcccggggttaccggggtaccggtcggtaaaccgggtacgggaccgggtactcggttaagcg

SEQ ID NO: 36566 - DNA, 771 bp, Homo sapiens
  misc_feature: GYAE6OF01CPQCQ.23.47.E03.1.454.CMB.1.raw
  modified_base (147)..(147): a, c, t, g, unknown or other
  misc_feature (147)..(147): n is a, c, g, or t
  modified_base (498)..(498): a, c, t, g, unknown or other
  misc_feature (498)..(498): n is a, c, g, or t
tcagacgcgagtatcacgaccggtgctcgatttagactcgcgcacagagaggaaggggggaactgctcagttaggacccagagggaaccatggaagccccagctcagcttctcttcctcctgctactctggctcccgagggggaaanacgccacgctctcctgacagggccagccagagtgttgacacattatttgcctggtaccagcagaaaccctggcccagccctccgaggtcctcctacatctaatgatggaccgtaaccgaaaacgggccgacgtcgggaccgttacccgaacggtcccgttaggggttttaccggtcgggaccgtaaggggttagggaaaggttcgggggaacctaagtacctttacaccttcgtaccacccgtagttaccgggacctaggtttactaaggacgtaccgtaggtaaaacggttgtttttaccggaacttaagttttactttaaccgtggttacgaacgtacgagtcccgaanagacgacgtcgtaggacttaccgtaacggttccgggaaccgtaagggaacctaaccggtaactaaacgggtaaaacgtttacggaaccgtaacgtacggttacgggacttcggaacctaaccggtattacccgtttacggttaccttacgtaacccttcccggtttaccccaggttacctaccggtaaaggtaacctttaccggtcggttaccggtactggggaaccgggtccgggacgttacgggaacgtaagggccgtaacgtaacgtagg

SEQ ID NO: 36567 - DNA, 874 bp, Homo sapiens
  misc_feature: GYAE6OF01BCUIQ.23.47.E03.1.454.CMB.1.raw
  modified_base (128)..(128): a, c, t, g, unknown or other
  misc_feature (128)..(128): n is a, c, g, or t
tcagacgcgagtatcacgaccggtgctcgatttagactcgcgcacagagaggaaggggggaactgctcagttaggacccagagggaaccatggaagccccagctcagcttctcttcctcctgctactntggctcccgaggggaaagagccacgctctcctgcagggccagccagagtgttgacacattattttgcctggtaccagcaagaaacctggaccagccctccgaggcctctcatcgtatgactcggacgtaaccgaaaagggcccgtacgtacgggcccgtacccgaggtacccgtaagggtttccggtaggtccgtagggtaggggtaaacgggtacgggaaaccgtaagggtacctttacggaaaccctttaccgttacccaaacccgtaacgttaccggggtaactaaacgggttacctaaaacgggtaccggtaacccgttaggtaaaacggtttagtttttacggaacccgttttaaaggttttaaccgtttaacgttacggtaacgaagtaccgtaaacggaccggacaacgggtacctaagggttccgtaacggggttaacttaaccgggtaaccgggtttaaccgggaaaccccggtaaaacggggaacccggtaaaccggtaaaccgtttaaaccgggtaaaaatttaaacccggggaccgttaaaacggtttcggggtaacggttacccgttaccgaaaccgtaacctaacgtttacggttccggtttaaccctttaaccgttacccttaccccgttaccccggactaacttaccctaggttaaaccttcgtacccggtacgttcgtaacgggacgggtacccggacgtacgggacgaacgggtcgaaagtggtaacg

SEQ ID NO: 36568 - DNA, 845 bp, Homo sapiens
  misc_feature: GYAE6OF01DW7YT.23.47.E03.1.454.CMB.1.raw
  modified_base (145)..(145): a, c, t, g, unknown or other
  misc_feature (145)..(145): n is a, c, g, or t
tcagacgcgagtatcacgaccggtgctcgatttagactcgcgcacagagagaaggggggaactgctcagttaggacccagagggaaccatggaacgccccagctcagcttctcttcctcctgctactctggctccgaggggaaangccacgctctcctgcacgggccagccagagttgttacgacactatttacttttcgccgttaggtaccagaccaaacgaaaccgtcggaccacgccctacccgaggtcctccctacactctatgagtcgaccgtaaccgaaaacgggcccgtacgtcgggccgttacccgaacggtcccgttaagggttttccggtcggaccgtaaggggttaggggtaacgggttacgggggaaccgtaacgggttaaccctttaccgtaacccgttacccgttacccaaccgtaacgttacccgggaccttaacggttaccgtaacggaccgtacccgttaaggtaaacgtttacgtttttacgaactttaaggttttttaacttaccgttaggttaccgtaacggtaccgacggtaccggaccgaacggacgtacggtcgttacgggtaaccttaccggttaccgggtttaccgggaaaccccggaaaggggtaacccgaaccggtaaccgttacgaaaaccgtttaacggttaaaccggtaccggtaaacggtttggtacggtccgtacgtacccgaacttacgtcgtttaccgttcttacctcccttccgtccctactaacttccgtaacgttaaccgtccggtccggttaccgttcgaccgggcgggtacccggtcgtacggaaccgggtcggcgtaacggtacg

SEQ ID NO: 36569 - DNA, 969 bp, Homo sapiens
  misc_feature: GYAE6OF01AXK00.23.47.E03.1.454.CMB.1.raw
  modified_base (170)..(170): a, c, t, g, unknown or other
  misc_feature (170)..(170): n is a, c, g, or t
  modified_base (210)..(210): a, c, t, g, unknown or other
  misc_feature (210)..(210): n is a, c, g, or t
tcagacgcgagtatcacgaccggtgctcgatttagactcgcgcacagagaggaaggggggaactgctcagttaggacccagagggaaccatggaacgccccagctcagcttctcttcctcctgctactctgctccagactaccacggagaattgtgtagacacgagtccncacgccctacccgttgttctttcgtcgtccggaggggacncgacgtcctacttcccgtacctcccgtggaccgagggtccctaagttaccgagaagttaaacttaaaccgagttcggactcgacggtccttagggtacaaccctaaaaacgtaaaccgcggaccgacggtacccgtacccgtaacggtccttaccctacttaagtttccgtttaacgccgtttacggtacccctttaacccggaacggtttacccgggggttaccccttcggtaccccggtacccgtaccggtacgttaaccggtacgtacggtcgggacggttacggggttacgggttacggacggtaacgtaaccgtttccctttaaccgaacccgttttacaacccccgtaaacgtaccgacccggttaaacggtccgtaaaccccggggtcggtaaaccgtaacccgggttcgttttaaaacgggttaaaccgtttttggggtttttttacccggggtttaaattttttaaacccgggtttaacgtttacccccggggtaaattaacccccggggttttaacgggttaccggtaaaacccgttttaacggtttaaccggggtttacccgtttttaccggggtttaaccggggaaacccggggtttaaacccgggacttaaacgggttcggaacgggtttaacaacgggttaccaaaggggtttacccgatttggggaacccggtttcaaccggggttactcccttaaattcccggttacgtttaccaccggtttacgtttcccccgctttaaacg

SEQ ID NO: 36570 - DNA, 557 bp, Homo sapiens
  misc_feature: GYAE6OF01B744T.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaacctggccagcctcccaggctcctcatctatgatgcgtaccgaaaagggcccgctggccgtccccagcctaggtttcgtggcaggtggaaggtgggacagacttcactctcaccatcggcagtctagacgcctagaagtattttgactagttttattactgtcagacagcgcagcagcgtggatccgacgttcggacccgaaagggacaacgactacgaaattaacgacgaactggtgctgacacctattccgtacgttccttactacttcccgttaccccgcctagtcctagtaacttccgtcgtaccgttcgtggacggcgggtcgtacggacgaaggcgtacagtacg

SEQ ID NO: 36571 - DNA, 781 bp, Homo sapiens
  misc_feature: GYAE6OF01BH14I.23.47.E03.1.454.CMB.1.raw
  modified_base (144)..(144): a, c, t, g, unknown or other
  misc_feature (144)..(144): n is a, c, g, or t
  modified_base (305)..(305): a, c, t, g, unknown or other
  misc_feature (305)..(305): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaagngccacgctctcctgcagggccagccagagtgttcgacactattatttcgcctggtaccagacaacgaaacctcggccacgccctcccgaggtcctcctcactctatagatcgaccgtaaccgaaacggtccgcgtcggccgtccgagccgtaggtttccgnggacgtaggtaggaacggtacgggactaaggtaccttaccgaccttccgtaccaaccgtacgtaccggacgttacgtacgtaaggaccgtaccgtaggtaaacgtttagttttacgtacgttaacggttttacttacgttcgtaacgacggtaccgaacggcccggaccgtaacggcgtacggtacggttacgggtaacttccgggtaaccccgggttacggaacccggaaacgggacctaaacggtaaccgttaacggtaaaacgtaacgtaacgggtaacgttcgggtaccggtactaaccggtactaacccgttacgttcccggttaacttacccgtttaccttaccctttacccccgttacccggtaaccttacgttacccgttaataacccggttcccttccgggtaccgttacggtccgggaccgggtcccggttacggtcgggaaccggaaccgggcgtaagtacgtgg

SEQ ID NO: 36572 - DNA, 637 bp, Homo sapiens
  misc_feature: GYAE6OF01CW1US.23.47.E03.1.454.CMB.1.raw
tcagacgcgagtatcacgaccggtgctcgatttagactcgcgcacagagagaagggggaactgctcagttaggacccagagggaaccatggaacgcccagctcagcttctcttcctcctgctactctcggctccgaaggggaaacgcgtccacgcttcctcctgcgacgggccacgcctagtagtcgttcgacactatttacgttttcgccgtacggtaccagtcaacgaaccgtcggccacgccctccgaggtcctaccgtcacttcgtacgtcgacgtcggaccgtaacgaaacggtccgacgtcggccgtaccgacgtccgtacggtttcgcggcgtacggtacggaggtacggactacgtaccttcgctctacacgtacgtcgacacgtcgtacgacgtcgtacgtagttacttacgtagttaacgtttactacgtcgacgtacgcgtacgcgacgagcgtacgcgtagtacgtcgtacggacggacgacggacacgaacgtacgtaagtacgacgtacgtcgacgtcgtcgactactcgttctcgtctactccttccgtccactctacgtataccgttacgcgtacgtcggtcgacggtccggacgtaccggtacacggtacgacgtgtacg

SEQ ID NO: 36573 - DNA, 482 bp, Homo sapiens
  misc_feature: GYAE6OF02HAT21.23.47.E03.1.454.CMB.1.raw
tcagacgcgagtatcacgaccggtgctcgatttagactcgcgcacagagagaagggggaactgctcagttaggacccagagggaaccatggaagccccagctcagcttctcttcctcctgctactctggctcccaggggaaagagccacgctctcctgcagggccagccagagtgttgacacatatttgcctggtaccagcagaaacctggccagcctcccaggctcctcatctatgatgcgtccaaaagggccgctggcgtcccagccaggtttcgtggcagtggaagtgggacagacttcactctcaccatcggcagtctagagcctgaagattttgcagtttattactgtcagcagcgcagcagctggatcacgttcggccaagggcacgactcgaaattaagcgaactgtggctgcaccatctgtctcatcttccgcatctgaatactcgctctgagcgggctggccaaggcgcatag

SEQ ID NO: 36574 - DNA, 504 bp, Homo sapiens
  misc_feature: GYAE6OF02IDGGL.23.47.E03.1.454.CMB.1.raw
  modified_base (469)..(469): a, c, t, g, unknown or other
  misc_feature (469)..(469): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagccctcccaggctcctcatctatgatgcgtaccaaaagggccgctggcgtcccagccaggtttcgtggcagtggaagtgggacagacttcactctcaccatcggcagtctagagcctgaagtattttgctagtttattactgtcagcagcgcagcagctggactcgacgttcggacaagggacacgactacgaaattaagcgaactgtgctgcaccatctgtcttcattcctcccgcctatctagaacttacncgtcgtctgacgcgggctggacgaggcgacatacg

SEQ ID NO: 36575 - DNA, 482 bp, Homo sapiens
  misc_feature: GYAE6OF02JDDPX.23.47.E03.1.454.CMB.1.raw
tcagacgcgagtatcacgaccggtgctcgatttagactcgcgcacagagagaagggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaagggccgctggcgtcccagccaggtttcgtggcagtggaagtgggacagacttcactctcaccatcggcagtctagagcctgaagatttgcagtttattactgtcagcagcgcagcagctggatcacgttcggccaagggacacgactcgaaattaagcgaactgtgctgcaccatctgtcttcatctcccgcatctgaatctcgcgtctgagcggctggcaaggcgcatacg

SEQ ID NO: 36576 - DNA, 546 bp, Homo sapiens
  misc_feature: GYAE6OF02HV38G.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtaccaaaagggccgctggcgtcccagccaggtttcgtggcagtggaagtgggacagacttcactctcaccatcggcagtctagagcctgaagtattttgctagtttattactgtctagctagcgcagcagctggactcgtacgttcggaccgaagggacacgactacgaaattaacgacgtaacgtgtggctcgcaacctattccttcccttcaccttccgttaccccgcctaacttccgtagtaacttacctcgtcgttccgtgacggtccgggtcgtcggacgaacgggccgacataggc

SEQ ID NO: 36577 - DNA, 499 bp, Homo sapiens
  misc_feature: GYAE6OF02HNVWT.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaagggccgctggcgtccccagccaggtttcgtggcagtggaagtgggacagacttcactctcaccatcggcagtctagagcctgaagattttgctagtttattactgtcagcagcgcagcagctggatcacgttcggccaagggacacgactcgaaattaagcgaactgtgctgcaccatctgtcttcattccttcccgccatctagtaactacgtcgccgtctgacgcgggctgggcaaggcgcatacg

SEQ ID NO: 36578 - DNA, 483 bp, Homo sapiens
  misc_feature: GYAE6OF02FG1H1.23.47.E03.1.454.CMB.1.raw
  modified_base (466)..(466): a, c, t, g, unknown or other
  misc_feature (466)..(466): n is a, c, g, or t
  modified_base (480)..(480): a, c, t, g, unknown or other
  misc_feature (480)..(480): n is a, c, g, or t
tcagacgcgagtatcacgaccggtgctcgatttagactcgcgcacagagagaagggggaactgctaagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctccaggctcctcatctatgatgcatccaaaaagggccgctggccgtccagccaggtttcgtggcagtggaagtgggacagacttcactctcaccatcggcagtctagagcctgaagattttgctagtttaatactgtcagcagcgcagcagctggatcacgttcggccaagggacacgactcgaaattaagcgaactgtgctgcaccatctgttcttcatccttcccgcatctgaatactcgctctgngcggctggcaggcnatg

SEQ ID NO: 36579 - DNA, 504 bp, Homo sapiens
  misc_feature: GYAE6OF02G6194.23.47.E03.1.454.CMB.1.raw
  modified_base (443)..(443): a, c, t, g, unknown or other
  misc_feature (443)..(443): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaagggccgctggcgtcccagccaggtttcgtggcagtggaagtgggacagacttcactctcaccatcggcagtctagagcctgaagattttgctagtttattactgtcagcagcgcagcagctgatcacgtcggccgaaggacgacgactacgaaattaagacgaactgtgctgcaccatctgtcttctactcncccgtttttttccactctgtaactactcgtcgtctcgacgcggcgtcggcgaggcgcatag

SEQ ID NO: 36580 - DNA, 498 bp, Homo sapiens
  misc_feature: GYAE6OF02HGG2E.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaagggccgctggcgtcccagccaggtttcgtggcagtggaagtgggacagacttcactctcaccatcggcagtctagagcctgaagattttgcagtttattactgtcagcagcgcagcagctggatcacgttcggccaagggacacgactcgaaattaagcgaactgtggctgcaccatctgtcttcacttccttcccgcctatctgaatctcgtcgtctgagcgggtcgtcggcaagggcgcgatacg

SEQ ID NO: 36581 - DNA, 504 bp, Homo sapiens
  misc_feature: GYAE6OF02HPB1W.23.47.E03.1.454.CMB.1.raw
  modified_base (421)..(421): a, c, t, g, unknown or other
  misc_feature (421)..(421): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaagggccgctggcgtccagccaggtttcgtggcagtggaagtgggacagacttcactctcaccatcgcagtctagagcctgaagatttgctagtttattactgtcagcagcgcagcagctaggatcgacgttcggcctaagggacacgactacgaaattaagacgaacttgngctgcaccatctgtctcattcctcccgctatctagaactacgtcgccgttcgtgacggcggtcgtcggacaaggcgcgtatcg

SEQ ID NO: 36582 - DNA, 499 bp, Homo sapiens
  misc_feature: GYAE6OF02FVQCU.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggcctcctcatctatgatgcgtccaaaaagggccgctggcgtcccagccaggtttcgtggcagtggaagtgggacagacttcactctcaccatcggcagtctagagcctgaagattttgctagtttattactgtcagcagcgcagcagctggatcacgttcggccaagggccacgactcgaaattaagcgaactgtggctgcaccatctgtctcatcctcccgcatctgaactacgtcgcgttcctgacgcgggctcgggacaaggcgcagtacg

SEQ ID NO: 36583 - DNA, 520 bp, Homo sapiens
  misc_feature: GYAE6OF02GWFQ2.23.47.E03.1.454.CMB.1.raw
  modified_base (519)..(519): a, c, t, g, unknown or other
  misc_feature (519)..(519): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctccaggctcctcatctatgatgcgtaccaaaagggccgctggcgtcccagccaggtttcgtggcagtggaagtggggacagacttcactctcaccatcggcagtctagacgcctgaaagtattttgctagtttatttactgtcagctaacgtggcgcctggcctatcaccgttcggccaacgggactcgacgtggagatagaaacgtacgtgtggctcgcaccatctgtcttcacttccttcccgccatctagactactcgcgttctacgacggtccgggctcggacgaaggcacagtgng

SEQ ID NO: 36584 - DNA, 541 bp, Homo sapiens
  misc_feature: GYAE6OF02H9AHG.23.47.E03.1.454.CMB.1.raw
  modified_base (231)..(231): a, c, t, g, unknown or other
  misc_feature (231)..(231): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaacctggccagcctcccaggctcctnatctatgatgcgtccaaaaggccgctggcgtccagccaggttcgtggcagtggaagtggacagacttcactctcaccatcggcagtctagagcctgaagtattttgactagtttattactgtacagtcagcgcagcagctgatcgacgtcgacgaacgggacacgactacgaaattacgacgtaacgtgtagctcgcaccattctgttccttacgtacttcccgttaccgccgtactcctacgtaacttaccgtcggtccgtcgtacggacggtccgggtcctcgggaccgtaacgggcgtcctagtacg

SEQ ID NO: 36585 - DNA, 543 bp, Homo sapiens
  misc_feature: GYAE6OF02GM3E2.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggcctcctcatctatgatgcgtaccgaaaagggccgctggcgtcccagccaggtttcgtggcagtggaagtgggacagacttcactctcaccatcggcagtctagacgcctagaagtattttgctagtttattactgtctagcagcgcagcgagtcgtagatcgtacggttcggacccgaagggaccaccgtactacgaaagttaagaccgtaacgtgtacggctcgaccacctatcgtcgttcttctacttcctacccgcctatcctagacttacgtcgtcgtctaggcgtcgggcgtcggcgaagggcacgagtacg

SEQ ID NO: 36586 - DNA, 559 bp, Homo sapiens
  misc_feature: GYAE6OF02JWSVT.23.47.E03.1.454.CMB.1.raw
  modified_base (280)..(280): a, c, t, g, unknown or other
  misc_feature (280)..(280): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatatttgcctggtaccagcagaaacctggccagcctcccaggcctcctcatctatgatgcgtccaaaagggccgctggcgtcccagccaggtttcgnggcaggtggaagtgggacagacttcacgtctcaccatcggcagtcctagagcctagaacgattttgactagtttattactgtcagtcagtcgcagcagctgatcgacgttcgacgtaacggacacgacgtacgaaattaacggaccaacgtggtacgcgtgaccaccgatcgtcgtacttaccctattccctttcccgaccgtcttaccgtacgtaactcccgtccgtccgttacgtcgaacggtcgggtcgtacgggaccagggaccgccgtagtacg

SEQ ID NO: 36587 - DNA, 547 bp, Homo sapiens
  misc_feature: GYAE6OF02HDA9Y.23.47.E03.1.454.CMB.1.raw
  modified_base (328)..(328): a, c, t, g, unknown or other
  misc_feature (328)..(328): n is a, c, g, or t
  modified_base (378)..(378): a, c, t, g, unknown or other
  misc_feature (378)..(378): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggcctcctcatctatgatgcgtaccaaaagggccgctggccgtccccagccaggtttcgtggcaggtggaaggtgggacagacttcactctcaccatccggacngtctagacgcctgaacgtattttgctaagttttattactgtcagcagcgnagcagctggatcacggttcggccaaggggaccacggtaactacggaaatttaaggcctaaacgtggtcggtctagacctacacgttctgtcttcacgttccttcccgcctattcctagaacttacgtcgtccgtacgtcggacggcggtctcgggcaacggcgacagtg

SEQ ID NO: 36588 - DNA, 536 bp, Homo sapiens
  misc_feature: GYAE6OF02FONYI.23.47.E03.1.454.CMB.1.raw
  modified_base (285)..(285): a, c, t, g, unknown or other
  misc_feature (285)..(285): n is a, c, g, or t
  modified_base (477)..(477): a, c, t, g, unknown or other
  misc_feature (477)..(477): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggcctcctcatctatgatgcgtaccgaaaagggccgctggccgtcccagcctaggtttcgnggcaggtggaggtgggacagacttcactctcaccactcggcagtcagacgctgaagtatttcgctagtttattactgtcagcagcgctagctagcgtgatcgacggttccggaccgaagggaccacgactacgaaagttaacgacgaacgtgcgtactgaccacattctcttctactcttccttcccgactntcctagtactacgttcgccgtcgtgacggcgggtctacggaccgaaggccgatagtacg

SEQ ID NO: 36589 - DNA, 498 bp, Homo sapiens
  misc_feature: GYAE6OF02G6AHI.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagtcagattgttgacacatattttgcctggtaccagcagaaacctggccagcctcccaggctcctcatctatgatgcgtccaaaagggccgctggcgtcccagccaggtttcgtggcagtggaagtgggacagacttcactctcaccatcggcagtctagagcctgaagattttgctagtttattactgtcagcagcgcagcagctgggatcgacgttcggccaagggacacgactacgaaattaagcgaactgtgctgcaccatctgtcttcattcctcccgctactctagactacgtcgcgtctgagcggctcggcacggcgacgatacg

SEQ ID NO: 36590 - DNA, 533 bp, Homo sapiens
  misc_feature: GYAE6OF02I7SY4.23.47.E03.1.454.CMB.1.raw
  modified_base (389)..(389): a, c, t, g, unknown or other
  misc_feature (389)..(389): n is a, c, g, or t
  modified_base (447)..(447): a, c, t, g, unknown or other
  misc_feature (447)..(447): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgtgacacatatttgcctggtaccagcagaacctggccagcctcccaggcctcctcatctatgatgcgtaccgaaaacgggccgacgtcggccgtcccgacgccgtaggtttcgtggaccaggtggaaggtgggacagacttcactctacacccatccggcagtctaagcgccgtagaatatttgacgtagtttatactgcagtcagcgacagcngctgatcgtacgtcgacgaaggacacgacgtacgaaataagcgaagtgcgctgctacntctgtcttctatcctcccgctactctataacgtcctcggtcctacgtggaccgtcgggtccgtggcctaacgggcctacgacgtag

SEQ ID NO: 36591 - DNA, 734 bp, Homo sapiens
  misc_feature: GYAE6OF02G758C.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatatttgcctggtaccagcaagaaacctggccagccctcccgaggcctcctcatctatgatcgccgtaccgaaaacgggccgcgtcgggccgtaccccgacggtcccgtaagggtttccggtgggaccgtaggtacggggtaaaggttcgggggaaccgacggtacctttaccgtaccttcctaccacccgacgtccggcctacgtccgtaaggaccgtaccgtaggtaagttattttcgactttagttttatttaacgtgtaccgagtcgacgccgtacgacgacgtacggcgtaggtactaccggtaccggttccgggaacccggtaaacgggtaaccgaacccggtaacgtaaccggtaaaacgttaaacggaaccgttaacgttgggtaccgtaccgtaccgactaccgtacgttaccttcgttccttacttcctttaccctcccgtacctacgttaccgtacgttaacgtaccgttccggtaccgttacgtaccgggtaggtccggggtacgtacgggtaccggaccgggtacggacgtacgtagg

SEQ ID NO: 36592 - DNA, 639 bp, Homo sapiens
  misc_feature: GYAE6OF02JOSF2.23.47.E03.1.454.CMB.1.raw
  modified_base (238)..(238): a, c, t, g, unknown or other
  misc_feature (238)..(238): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
tcagacgcgagtatcacgaccggtgctcgatttagactcgcgcacagagagaaggggggaacgtgctcagttaggacccagagggaaccatggaagcccagctcagcttctcttcctcctgctactctggctcccaggggaaagagccacgctctcctgcagggccagcccagagtgttgacacatattttgcctggtaccagcagaacctggccagcctcccaggctcctcatctangatgcgtaccgaaaggccgctcgggccgtccgacgccaggtttcgtggcagtcggaagtggggacagcttcnctcncacatcggcagtctagcgcctgaacgtagttttcgcttagttttaacttacgtcggtactagcaaggtccgacgacgccaggtctaggtactacccgtaaggtcccggtaacggaaacggggtaccaaccggtacctacggtaaacttaacggacggtaaccgttgtacgggtactcgggaactaccgtattccgttacggttacttacccgttaattccccgttacccgtcctacgtttcgtacgtaactcggttacccgtacggtttcaacggtacggtccgggtaccgttgggacccgaagggtacccgtagtacggtaacg

SEQ ID NO: 36593 - DNA, 506 bp, Homo sapiens
  misc_feature: GYAE6OF02FL0Y7.23.47.E03.1.454.CMB.1.raw
  modified_base (501)..(501): a, c, t, g, unknown or other
  misc_feature (501)..(501): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgtctggtaccagcagaaacctggccagccctccaggcctcctcatctatgatgcgtaccaaaagggccgctggcgtccagccaggtttcgtggcaggtggaagtgggacagacttcactctcaccatcggcagtctagagcctagaagtattttgctaggttttatttacgtgtcagcagcgcagcagctggatcacggttcggccaaagggacacgactacgaaattaacgcgaactgtgctgcacatctgtcttcactcctcccgcatctatactacgtcgctcgtgacgtcggctcggacgagcgtanagtcg

SEQ ID NO: 36594 - DNA, 662 bp, Homo sapiens
  misc_feature: GYAE6OF02FO4QE.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacattattttgcctggtaccagcagaacctggccagcctccaggctcctcattctatgatgacgtaccgaaaagggccgacgtggccgttccccacggccgtacggtttcgtggcgaggttaggaaggttgggacgagacttcgactctcaccatcggcagtctagcgctagagtatttgctagttttattactgtcagtcagcgacgagacgacggtctggtactacgtaccggttacggaccggtaaacggaccgaaccggtacctaacgtaaacgttaacgacggtaaacgttggtacggtcgtcggacctacccgtaactcgttcgttacctttacctaaccttcccttaccccgtaccgttaccgttaccgttacggtaaaccttacccggttaccgggtccgttaccggtcgggtaaccgggtccggggtacggttaccgggaccggtaacgggcccggtacggtacctaacggg

SEQ ID NO: 36595 - DNA, 734 bp, Homo sapiens
  misc_feature: GYAE6OF02IVPTM.23.47.E03.1.454.CMB.1.raw
tcagacgcgagtatcacgaccggtgctcgatttagactcgcgcacagagagaagggggggaactgctcagttaggacccagagggaaccatggaagccccagctcagcttctcttcctcctgctactctggctcccaggggaaagagccacgctctcctgcagggccagccagagtgttgacacattattttgcctggtaccagcagaaacctggccagcctccaggcctcctcatctatgatcgacgtaccgaaaaggccgcgtcggccgtacccgacgccgtaggtttacgtggcaggtggtaaggtacgggacacgtacttacactctcgaccagtccgacagttctagacgtacctagtaagtagtttagactagtttattactgtacagcacggacgacaggtacaggtacctagggtaattacccgtaaccggttacccggggaacccgtaaacgggggtaacccaaccggtaaaccgttaaccgtaaaaacggtttaaaagggtacccggtaaaaccggttcgtaacgggggtacccttacggaaccgtaaaccccttaagtttacccttaccggttttaccttacccgtaaccgttttaccccgttacccccgtaccgtacttaaccgttacggtaaacctttacccggttacggtaacccgttacggttaacggacggtcccggggtacggtacggtaccggaaccgggacgtacggaacgtagg

SEQ ID NO: 36596 - DNA, 534 bp, Homo sapiens
  misc_feature: GYAE6OF02F2OBY.23.47.E03.1.454.CMB.1.raw
  modified_base (426)..(426): a, c, t, g, unknown or other
  misc_feature (426)..(426): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtaccaaaagggccgctggcgtcccagccaggtttcgtggcaggtggaagtgggacagacttcactctcaccatcgcagtctagagcctgaatatttgctagtttattactgtcagcagcgcagcagctggatcacggttcggaccaaggggacacgactacgtaaagttaagcgtaacgtgnggtctcgacaccgatctcgttcttcgtacttccttcccgcctattcctagtaactcctccggccttcgtcggacggcgggtcgtcggaccgtacggcgtaccagtacg

SEQ ID NO: 36597 - DNA, 669 bp, Homo sapiens
  misc_feature: GYAE6OF02G5N30.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagagccacgctctcctgcagggccagccagagtgttgacacatattttgcctggtaccagcagaaacctggccagccctcccaggctcctcatctatgatgcgtaccgaaaagggccgctggccgtccccagccgtagggtttcggtggcaggtggaaggtgggacagtacttcactctcaccatcggacagtactagacgccgtagaagttatttagcttaagtttatttactgtcagtctagccgactagcctaggcgtaggactaccgtaccgtcgggtacccgaaggggtaccaacggtaactaccgtaaaattaacggaaccgtaacgttggtacggcttacgaccgtacctaacgttccgttgttccctttacgtaccttttccccgttacccccgaccgttaccttccgttacgttaaacccttacccggtttccggtacccggtttcggttacgggtacggggtcccggggtacgttacgggggacccgtaacggggtcccggtaacgtaacgtaacgg

SEQ ID NO: 36598 - DNA, 705 bp, Homo sapiens
  misc_feature: GYAE6OF02IN7AU.23.47.E03.1.454.CMB.1.raw
  modified_base (148)..(148): a, c, t, g, unknown or other
  misc_feature (148)..(148): n is a, c, g, or t
tcagacgcgagtatcacgaccggtgctcgatttagactcgcgcacagagagaaggggggaactgctcagttaggacccaggagggaaccatggaagccccagctcagcttctcttcctcctgctactcgtggcctccgaaggggaaangccacgctcctcctgacgcggcagccagtagtgtgacacgtattatttcgcctaggtaccagactaacgaaacctggaccacgtccctccgacggctacctcaatctatgacgtcgaccgtaaccgaacgggccgcggtccggtccgtaccgacgtccgttagggttaccgtggtacgtagggtacgggtaggtcgggtaacgacgtaaccttcctaaccgttccgacaaccgcgtccgaacgacgttcggaacggtccgacgtaacggtaagttacgttttcgaacgtttaacggtttaactttacgtacgaccgtagtacgacgacgtcgagacgtacggcgtacggtataccggtaccgttacgggaacccggtaacggacccttacggtaaaccggttaaactaacgtaacggtacgtacggtggacgtagacgtacctacgactagttccgttcaacgttaccgtcccttaccgacctattaccgacgttaaccttcggcgtaccggtcgtaggaccgtcggacgttacggacgtacggccctaagacgtcg

SEQ ID NO: 36599 - DNA, 653 bp, Homo sapiens
  misc_feature: GYAE6OF02HKLIT.23.47.E03.1.454.CMB.1.raw
  modified_base (145)..(145): a, c, t, g, unknown or other
  misc_feature (145)..(145): n is a, c, g, or t
  modified_base (528)..(528): a, c, t, g, unknown or other
  misc_feature (528)..(528): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagngccacgctctcctgcacgggccagccagagtgtgacacagttatttgccgttgtaccagcacgaaacctggccacgcctcccaggcctcctcatctatgatcgaccgtaccgaaaagggccgacgtcggaccgtcccacgccgtacggtttcggtcggtctagggtaggaaggtcgggtaacgacggtacctttacgactccgtaccaccgtacgtccggacacgtcgtaaggtacaccgtacgtaagtatttcggtcttagtttattaacgtgtacagtacgtagcacgacgcacggtactcggactcgtaccggtaccggacgaaacggtaccaccggtactacgtaaagtaacgacgtacgtagtgcgacgtccaccgtntactccgttcttactacttcccttaccggaccttacgttaccgacgttaacgttacccgtcggtaccgttcgtaacggtacgggtaccgtcggttaggacccgtaagggtcccgacgttagtacg

SEQ ID NO: 36600 - DNA, 619 bp, Homo sapiens
  misc_feature: GYAE6OF02GHJGN.23.47.E03.1.454.CMB.1.raw
  modified_base (143)..(143): a, c, t, g, unknown or other
  misc_feature (143)..(143): n is a, c, g, or t
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
tcagacgcgagtatcacgaccggtgctcgatttagactcgcgcacagagagaagggggaactgctcagttaggacccagagggaaccatggaacgccccagctcagcttctcttcctctgctactctggctccgaggggaaanacgccacgctctcctgcacggccagccagagtgtcgacactattagtttcgcttggtaccngcaagaacctggaccacgccctccgagtctccctcatctatgatcgcgtaaccgaacggtccgactcggaccgtccacgtcgtacggtttcgnggctaggnggtaggtcggactgtaccttcactcgtacncagtccgatacgtcaggactaccgtaggacgtttattcggaactttagtttaacgttcgcgtttacgacgtactacggacaccgtagacgttacggcgttacggtactccggttaccggtacggaccggtaaggaccgtacgacgttaaacgaagttacggaacgttacggtacgtgtactcgacacctgttactcgtctagtcccgtcctaccgataccgtgtactacgttcgtccacgttcgacggtcggtcggtcttacgggactacggctaagtcgtacg

SEQ ID NO: 36601 - DNA, 699 bp, Homo sapiens
  misc_feature: GYAE6OF02GXJPY.23.47.E03.1.454.CMB.1.raw
  modified_base (590)..(590): a, c, t, g, unknown or other
  misc_feature (590)..(590): n is a, c, g, or t
  modified_base (678)..(678): a, c, t, g, unknown or other
  misc_feature (678)..(678): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctggcctcccgaggggaaagcgccacgctctcctgcagggccagccagagtgttgacactattagttttgccttggtaccagcaacgaaccgtggccacgcctccgaggcctcctcactctagtgacgtcgacgtaaccgaaaacgggcccgtcgtccgggccgtacccacgtaccgtacgggttttcgacggctaggtcgggaacggttcggggaactacggtacctttccaccgttccgtacctaaccgtacgtaccggtacctaacggtccgtaagacccgtaacgtaggtaaacgtttacgtttaggtaccttaaagtttttaactttacgttcgtacaacggacgtaacggtaccgacgagtccgaagttccggaacgtcgtaccggtaccggttacgaaccgggtaacggaccgtaacggtacctacggtaaaagttacggacgtaacggtgtaccgntacgacctactacgttcgtcgttcctacgtccttaccgtcaacctactagtacgaccttacgtccggtctcgtacgacgggctaccgnggtaccgcggctcgtagtccg

SEQ ID NO: 36602 - DNA, 693 bp, Homo sapiens
  misc_feature: GYAE6OF02HKU53.23.47.E03.1.454.CMB.1.raw
  modified_base (144)..(144): a, c, t, g, unknown or other
  misc_feature (144)..(144): n is a, c, g, or t
tcagacgcgagtatcacgaccggtgctcgatttagactcgcgcacagagagaagggggaactgctcagttaggaccagagggaccatggaagccccagctcagcttctcttcctcctgctactctaggcctcccgaggggaaanacgccacgctactcctgcagggccagacagagtgttgacatatatttgcctggtaccagcagacctgcacgcctccagtctcctatactctatgagtcgtaccgtaccgaaacgggccgtacgtccggtccgtacccgaccgtaccgtacgggtttcggtacggtacgtaggttacggtaaggggtacgggactacggttaccttacctaaccgttccgttaacccgaccgtacgtacggggtacctaggtacgtagtaccgtacggtaacgtaacgtttagttttacgactttaacggttttactacgtttaggtcctaggtacgaccggacgaccgacggacttacgacggttacgactaccgttacggtacgggaccgtaaggaccgaacggtactaacggtaaacgttaacggtactaacggtggtcgacctcgactactattccgacttctaactccgttacctacccgtactagtacacgtactacgtcgtagttccggtacggtccggacggtcggtacggacgtaccggacgacgtgacgg

SEQ ID NO: 36603 - DNA, 694 bp, Homo sapiens
  misc_feature: GYAE6OF02GV1L8.23.47.E03.1.454.CMB.1.raw
  modified_base (407)..(407): a, c, t, g, unknown or other
  misc_feature (407)..(407): n is a, c, g, or t
  modified_base (443)..(443): a, c, t, g, unknown or other
  misc_feature (443)..(443): n is a, c, g, or t
  modified_base (554)..(554): a, c, t, g, unknown or other
  misc_feature (554)..(554): n is a, c, g, or t
  modified_base (642)..(642): a, c, t, g, unknown or other
  misc_feature (642)..(642): n is a, c, g, or t
tcagacgcgagtatcacgaccggtgctcgatttagactcgcgcacagagagaaggggggaactgctcagttaggacccagagggaaccatggaagccccagctcagcttctcttcctcctgctactctaggctaccaggggaagagccacgctctcctgcaggccagccagagtgttacgacacaattattttcgcctaggtaccagcaagaaacctcggacctagccctcccgaaggtcctcctacacttcgtatcaagtcgtacgtaacgaaaacgggtccgactcgggccgtacccaggtacccgttaaggtttcggaggacgagggttacgggaaggttagggaactacggtacttacgaaccgtcctacaaccgaggttccggacttagaccgttaaggacncctaagtaagttactttcgacttatttactttacgngtacagtactagcctagaccgacgtagtcgtaacggtacttccgtaacgggtcggtaaccgaagggtacctaacggtaaccgtaagttaaaacggttacgacgttaaacgnggtacgtacctaacgggacctaaccgtacgttaccgttcgttaccttaccgttacttcccggttccaacgttaactcgtacgttaacnccgttcggaccttgacgttagccggtatcggacctaagggccttacagtacg

SEQ ID NO: 36604 - DNA, 895 bp, Homo sapiens
  misc_feature: GYAE6OF02F410K.23.47.E03.1.454.CMB.1.raw
tcagacgcgagtatcacgaccggtgctcgatttagactcgcgcacagagagaaggggggaactgctcagttaggacccagagggaaccatggaagccccagctcagcttctcttcctcctgctactctggctcccaggggaaagacgccacgctctcctgcaggccagccagagtgttgacacgattattttgcctggtaccagtcaagaaacctcggccacgcctccaggctcctcatctatgatcgccgtacgaaaagggcccgcgtacggtccgtcccgagtaccgtacggtttcggtcggactaaggtcgggtaaggtacggggtacaacggtaccttacgtaaccttccgtaccaacctagtaccgggtacaaggttacctaaggtacgtccgtaggaaacgttaattttcgggactttaaggtttaatttaccgtagttaccgaaggaccgtaacggaccggtaaccgtaaggaccttaacgggtcgttaaaccggggtaaacttaccggtaaaccgggtttaacccggggaaacccggtaaaacgggggtaaccccgtaaaccgggtaaaccggtttaaaaccggtttaaaaaaacggtttaacgggttaaaccggtaaaaccgtttaccggggtaggggttaaccctacggggtaaccccttaaaccccgtaagtttcccgttacgggttttaaacccgttcctttaaaacccgggtttccctttaaccccccggtaagttaacccgttacggttttaaccgtaaacggttaacccgttcccgggtaacccgtttaaccgggttaacggtaacccgggggttaccgggttaccgaaccggggggttaaccccgaagggttaccccggtaaacccgttaggtaaccgg

SEQ ID NO: 36605 - DNA, 549 bp, Homo sapiens
  misc_feature: GYAE6OF01ADKBQ.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaattttgtagcctggtatcagcagagaccagggcaagttcctcaactcttgatctatgatgcatctctatttggagccgaggggtctcatctcggttcaggtggcaggcggatcgtgggaccgtctttcacttctcaccatccaccacgccctccacgccctgaacgtattgttgacctaactttattaccttcgttaccaactagttactcgaaggtacttcggttcccggttagggtaccggttccgggaccccgtacggggaacccgtaacggggtacggaaacttcgaaggtaacggtaacgg

SEQ ID NO: 36606 - DNA, 493 bp, Homo sapiens
  misc_feature: GYAE6OF01DWMW4.37.23.C01.1.454.CMB.1.raw
  modified_base (488)..(493): a, c, t, g, unknown or other
  misc_feature (488)..(493): n is a, c, g, or t
tcagtagtgtagatcacgaccggtgctcgatttagtacacgtgattagggattgggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtctggggccgagggaccacggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnn

SEQ ID NO: 36607 - DNA, 476 bp, Homo sapiens
  misc_feature: GYAE6OF01CWPG7.37.23.C01.1.454.CMB.1.raw
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaattttgtagcctggtatcagcagagaccagggcaagttcctcaactcttgatctatgatgcatctcatttggagccaggggtctcatctcggttcagtggcagcgatctgggaccgctttcactctcaccatcaccagccctcagcctgaagatgttnctaacttattactgtcacagtatcaggntgtcccgtggacgttcggccagggaccaaggtagaatcagcgtaacg

SEQ ID NO: 36608 - DNA, 519 bp, Homo sapiens
  misc_feature: GYAE6OF01BY47U.37.23.C01.1.454.CMB.1.raw
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcagtcaggacatccgcaattttgtagcctggtatcagcagagaccagggcaagttcctcaactcttgatctatgatgcatctcatttggagccaggggtctcatctcgtcagtgcagcgatcgtggaccgtctttcactctcaccatcaccacgcctcagcctgaanatgtanctaacttattactcgtacaacgagtatacgaggtatcggtacccgttggtaccggtttccgggaccccgtaacggggaaccgtaacgggtaacggtaaatccgaagggtaccgtaaaccgg

SEQ ID NO: 36609 - DNA, 600 bp, Homo sapiens
  misc_feature: GYAE6OF01CNNKX.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgctaattttgtagcctggtatcagcagagaccagggcaagttcctcaactcttgatctatgatgcatctctatttggagccgaggggtctcatctcggttcagtggcagcggatcgtgggacctctttcacttctcaccatccaccacgcccctacgacgtcctaggaaacgtgtttacgttacgaaccttaaacttttacgttaccgttacgtaacctaacgtaagttactacgtaacgggtacgttacccggttacccgggtacgggttacccgggtttacccgggaccccggtaaacggggtaacccggtaaaggggtaacggtaaacgtaccgtaaacgggaaccggttaaacggg

SEQ ID NO: 36610 - DNA, 498 bp, Homo sapiens
  misc_feature: GYAE6OF01CSR6J.37.23.C01.1.454.CMB.1.raw
  modified_base (493)..(498): a, c, t, g, unknown or other
  misc_feature (493)..(498): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtctggggccgagggaccacggtcaccgtctcctcagcctccaccaagggcccatcggtcttccccctggcgccctgctccaggacgcacctcccgagacgcacagcggccctgggctgcctggtcaaggactacttccatctacactactgacgcgggctggcaaggcgcatagnnnnnn

SEQ ID NO: 36611 - DNA, 598 bp, Homo sapiens
  misc_feature: GYAE6OF01CBC95.37.23.C01.1.454.CMB.1.raw
  modified_base (151)..(151): a, c, t, g, unknown or other
  misc_feature (151)..(151): n is a, c, g, or t
  modified_base (157)..(157): a, c, t, g, unknown or other
  misc_feature (157)..(157): n is a, c, g, or t
  modified_base (296)..(296): a, c, t, g, unknown or other
  misc_feature (296)..(296): n is a, c, g, or t
  modified_base (372)..(372): a, c, t, g, unknown or other
  misc_feature (372)..(372): n is a, c, g, or t
tcagtagtgtagatcacgaccggtgctcgatttagtacacgtgattagggtagtttggggggcacgaagtctctctcagtcaggacacagcagtcggacatgagggtccctggctcagctctgggactctgcctgctctggctccaggtancgggtntgacattctgactgaccctagtctccttcacctgtctgcatctgtaggacgtacagtagtccaccatcacgttgccggtcagtcggacttattacgtactggttcgcctaggtaatcaacgtagaaaccgagggaaacncccctaaggtcctagactctatgatcgcctctagttggaacgtcgggtccatcaaggttcaggcgcagtgtatcgnggacagattcactctacacatacatacgctagacagtcctagtactagttactttacgacttaactttatttacgtagttactagtctaacttaacgttaacgttcgggtaagttacgttaccgggaccggtaacgggtaccgtaggggttacgaacggtacgtaaccggaaacggtacgttggtacgtaccgttaggacctaacgtattccgtagttccttaccg

SEQ ID NO: 36612 - DNA, 591 bp, Homo sapiens
  misc_feature: GYAE6OF01B72CZ.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaatttgtagcctggtatcagcagagaccagggcaagttcctcaactcttgatctatgatgcatctcatttggagccaggggtctcatctcggttcagtggcagcggatcgtgggaccgtctttcacttcctcaccatccgaccacgccctaccacgcctagaagacttcggtttacgactaaacctttatttaaccttggttacctaaacgtagttaactacgtaacgggtattcggttccttcgggttaccgggtaccggttttccggggaacccccggtaacgggggtaacccgtaaacgggggttaaggggtaaaacgttaccggtaaaaaccgggttaaaccggg

SEQ ID NO: 36613 - DNA, 499 bp, Homo sapiens
  misc_feature: GYAE6OF01D3MOL.37.23.C01.1.454.CMB.1.raw
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctattagagacagagtcaccatcgcttgccgggcagtcaggacatccgcaattttgtagcctggtatcagcagagaccagggcaagttcctcaactcttgatctatgatgcatctcatttggagcgagggtctcatctcggttcagtggcagcggatcgtgggacctctttcactctcaccatccaccagtccctccagcctagaagatgttnactaacttattactgtacaacatatnaggtattggtcccgtaggacggttccggcccgaagggaccgtaagggtagaaactcaagacgtaaacg

SEQ ID NO: 36614 - DNA, 494 bp, Homo sapiens
  misc_feature: GYAE6OF01DNIG1.37.23.C01.1.454.CMB.1.raw
  modified_base (387)..(387): a, c, t, g, unknown or other
  misc_feature (387)..(387): n is a, c, g, or t
  modified_base (481)..(481): a, c, t, g, unknown or other
  misc_feature (481)..(481): n is a, c, g, or t
  modified_base (486)..(494): a, c, t, g, unknown or other
  misc_feature (486)..(494): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaaagaactcagtgtatctacacatgaacaaccttagagtcgaggacacggctgtttattactgtagaaaaggccactatggagtctggggccgagggaccacggtcaccgtctcctcagcctccaccaaggcccatcggtctcccctgcnccctgctccaggagcacctccgagagcacagcgccctgggctgcctggtcaaggactacttccatctacactactgagcgggctggcaaggcgnatagnnnnnnnnn

SEQ ID NO: 36615 - DNA, 560 bp, Homo sapiens
  misc_feature: GYAE6OF01DXXYZ.37.23.C01.1.454.CMB.1.raw
  modified_base (343)..(343): a, c, t, g, unknown or other
  misc_feature (343)..(343): n is a, c, g, or t
tcagtagtgtagatcacgaccggtgctcgatttagtacacgtgattagggattgggggcagaagtctctctcagtcaggacacagcatggacatgagggtccctgctcagctcctggggctgctaatgctctgggtctctggatgcagtggggatattgtgatgcatcagtcccactctccctgcccgtcacccctggagagccggcctccatctcctgccaggtctagtcagagcctcctgcatggaaatggacacaacttattggattggtatctgcagaagccagggcagtctccacactctgatctattcggtctaatccgggcctccgggtcctgacnggttcagtgcagtggatcaggcacagatttcacactgaagatacagacagagtagggaggcgtaggaggtagttagggtttaggggttttattacgttgtactaagtggtacgtaacgggtaccttaacgtaaaccgttacccgtaccgggtacgttacccgtacccgtttaccgggtacccgaaacggggaccgtaaccggtacgtgggtaaacgg

SEQ ID NO: 36616 - DNA, 736 bp, Homo sapiens
  misc_feature: GYAE6OF01ADHY2.37.23.C01.1.454.CMB.1.raw
tcagtagtgtagatcacgaccggtgctcgatttagtacacgtgattagggagttgggggcagaagtctctctcagtcagggacacagctatggacatgagggtccctgctcagctcctgggactcctgctgctctggctcccaggtagcggtgtgacattctgatgaccagtctcatcctcctgtctgcagtctgttagagacgaggagtcaccatcgcttgccgggcgagtcaggacatccgcaattttgtagcctggtatcgagcagacgaccgaggggctaaaggttccctacgaaacgttcgttagacgttctatagattcgcaatcgtctaagttttgggagccgaaggggttcctacgtaattcgttcggtttacaacggttcgggacgtaaggccgggtaagttccgttacgggggaaccctcgttttccaacgttcttaccgaccctaagtcccaaacccgtaaggaccccttaccaacggtccctagtaaacgtacgtttcgttaaggaccttaaactttacgtttaaccgttagggttaaaccctaaaccgtaagggttaaacttccggaaacgggttaagtttaccgggttaaccccggtttaggggtaaccccggttttcccgggggaacccccggttaaagggggtaaacccccggttaaagggggtttaaccgggaaaaaccggtttcccgggtaaagggtaaacccgggttaaaacccggg

SEQ ID NO: 36617 - DNA, 536 bp, Homo sapiens
  misc_feature: GYAE6OF01BQHT8.37.23.C01.1.454.CMB.1.raw
  modified_base (528)..(536): a, c, t, g, unknown or other
  misc_feature (528)..(536): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccaggggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaggccactatggagtcgtggggccgagggaccacggtcaccgtctcctcacgcctccaccgaagggcccatccggtccttcccccgtggccgccctgcctccgacggacgccaccgtccgagacgcacgacgccggccccgtggggcctcggccctgggtccaaggtacctacttcccatcctacaccttactgacggcgggctcgggcaaggcgacagtacgnnnnnnnnn

SEQ ID NO: 36618 - DNA, 668 bp, Homo sapiens
  misc_feature: GYAE6OF01D4OEK.37.23.C01.1.454.CMB.1.raw
tcagtagtgtagatcacgaccggtgctcgatttagtacacgtgattagggagttgggggcagaacgtctctctcagtcaggacacagcatggaccatgagggtccctgcgtcagctcctgggactcctgctgctctggctccaggtagcggtgtgacattctgatgacccagtctccatcctcctgtctgcatctgttagagacagagtcaccatccgcttggccgggcagtcaggactagtccgctaattttgagcctaggtactcagcagacgaccgagggctaagttcctctaacttcttagattctatgattgctatcgtcagttttgggacgtccgtaggggttctacgtacgttccgtttacgggtttcgaaggttcgggaccgtagggtaccggtaacgttccggttacggggtaaccccgttctttttaccgaaccgtttcctaccgtaacctactttacccaacctaacggtcccctaccgacgtcccgttaggaacgtagttcgtttaccgacctttaacgtttacgttaccgtacgtaccgaacgtagtaccgtacgaacgggttagttccgggtcccggttaggtaccggtttcccggaaccccggtaagggtacccgtaagggttacggaaacttccggaaacggtaccgtaacg

SEQ ID NO: 36619 - DNA, 574 bp, Homo sapiens
  misc_feature: GYAE6OF01AH8FS.37.23.C01.1.454.CMB.1.raw
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaacgaccaaaaactcactgtatctgcaaatggacggcctgagatccgaggacacggctgtgtattatgtgcgagagtattttagactacaaagtttcgagtgactggtatgatgcttatgataccgtggggaccaaagggaccagtggtccaccgtctcttcacgcctccaaccgaacgggcccagttccggtcccttcccccgtggcccgtccctgcctccgaggacgccacccgtccgagacgccacgcggcccggcccgtgggcctccggccgtcgggtaccaagggaccttaccgttcctacttacctaaccaccgaccgtggacgggccgggtaccgg

SEQ ID NO: 36620 - DNA, 731 bp, Homo sapiens
  misc_feature: GYAE6OF01BZ90C.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcggtgtgactattctgatgacccagtctccatcctcctgtctgcatctgttagagacagagtcacatcgcttgccgggcagtcaggacatccgactaattttgagtcctggtatcagcagacgaccagggactaacgttcctactaacttcgttgatctatgatgctatctactagttcggacgtccgtagggtctacgtagttccgttacggttcaggttcggacgtacggtccgggtaacttccggttaccggggtaacccttcgtttttacccacctttccgtacccgtaaaccctaacgttacccgaacccgtaccggtaccccgttacccgtaaccggtacccgtaacggtaaacgttacgtttcgtttaaccggacccgtttaaaaccgttttaccgtttaaccggttacgtttaacccgaaacgttaacgtttaaacgtacggtaaaccggttacgttacccgggttcccggttaacgggttaacccggtttccccggggaaacccgtaaccggggtaaaccgttaacgggggttaaccgaaacgttaacccggtaacgggtaaacccgttaaccgggg

SEQ ID NO: 36621 - DNA, 594 bp, Homo sapiens
  misc_feature: GYAE6OF01CDO74.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcagtcaggacatccgctaattttgtagcctggtatcagcagacgaccagggcaagttcctcaactcttgatctatgatgcatctctatttggacgcgagggtctcatcgtcgttcaggtggcaggcggtagtcgtgggaccgtcgtttcactcctacaccataccaccacgccctcgacgccctagaagtcttgttacgtacctaaactttacttaactcgttaaccaacgtaagttaactaccgtaaggtacgttaccggttaccccgggtagggtacccgggtttcccgggaaccccggtaacggggtaaacccggtaaacggggttaacgaaaacggttaccgaaacgggtaaccggtaaaccggg

SEQ ID NO: 36622 - DNA, 530 bp, Homo sapiens
  misc_feature: GYAE6OF01BZBLH.37.23.C01.1.454.CMB.1.raw
  modified_base (517)..(517): a, c, t, g, unknown or other
  misc_feature (517)..(517): n is a, c, g, or t
  modified_base (522)..(530): a, c, t, g, unknown or other
  misc_feature (522)..(530): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccaggggaaggggctggagtggggtggccaacatagcgagcgatggaagtgagagaaattatgtggactctgtgaagggccattcaccatctccagagacaactccaaagaactcagtgtatctacacatgaacaaccttagagtcgaggacacggctgtttattactgtagaaaaggccactatggagtcgtggggccgagggaccacggtcaccgtctcctcagcctccaccaagggcccatccggtcttccccctggccgccctgcctccacggagccacctccgagacgcacgacgccggcccgtgggcctcgcccgtgggtaccaacggacctaccttccattcctaacacctactgacggcgggctgggaccaagggcnagtgnnnnnnnnn

SEQ ID NO: 36623 - DNA, 650 bp, Homo sapiens
  misc_feature: GYAE6OF01DGI1J.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttggccgggcgagtcaggacatccgctaattttgagcctggtatcagcagacgaccgagggacaagttcctacaactcttgatctatgatgctatctctatttggagccgtaggggtctcattcgtcggtttcaggttgcgagcggtactcgtcgggacccgtctttccaccgttctaccacctatccacctacgccctaccacgtccctagaacgtagttcgttacaccgttaaacttttaacgttaaccttcggttaacctaaccgtaaggttaacttaccggtaaagggtaaccgtttccgggttaacccccgggtttagggttaaccccgggttttcccggggaacccccggtaacgggggtaaacccccgtaaacgggggttaacggaaaaccggtttaccgaaacgggtaaccggttaaaacccggg

SEQ ID NO: 36624 - DNA, 516 bp, Homo sapiens
  misc_feature: GYAE6OF01CB3OA.37.23.C01.1.454.CMB.1.raw
  modified_base (504)..(504): a, c, t, g, unknown or other
  misc_feature (504)..(504): n is a, c, g, or t
  modified_base (508)..(516): a, c, t, g, unknown or other
  misc_feature (508)..(516): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccaggggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtcgtggggccgagggaccacggtcaccgtctcctcagccctccaccaacgggcccacgtccggtccttccccctggccgccctcgcctccacggacgccacctcccgagacgcacacgccggccctgggctgcctggtcaaggactactccatctacacttactgagcgggctcggcgaaggcgnatgnnnnnnnnn

SEQ ID NO: 36625 - DNA, 556 bp, Homo sapiens
  misc_feature: GYAE6OF01DJB2L.37.23.C01.1.454.CMB.1.raw
  modified_base (200)..(200): a, c, t, g, unknown or other
  misc_feature (200)..(200): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacatccagatgacccagtctccttccacctgtctgcatctgtagganacagatccacatcacttcggccggcaggtcgactattacgtacctggttcgctggtatcaacagaaaccaggaacgaccccgtaaggtcctagatctatgatcgccctctacgtttaggaaaggccggggtacccatcgaaaggttcaggcggacagtgtatcgtaggacagtaatcaactctacacctatacagtacgcctgcagcctagattgtattttagacttaactttattactgtacagtacaactataagtgggaagtacgttccgggaccgaagggaccgtagggttacgaagtaacgtaacgaaacgtaagtggtacggactcgaccaactattcttcgtcttaccg

SEQ ID NO: 36626 - DNA, 496 bp, Homo sapiens
  misc_feature: GYAE6OF01AQIPD.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcagtcaggacatccgcaattttgtagcctggtatcagcagagaccagggcaagttcctcaactcttgatctatgatgcatctcatttggagccaggggtctcatctcgttcagtggcagcggatcgtgggaccgctttcactctcaccatccaccagccctccagcctgaatatgttagctaactttattactgtacaacagtatctaggatcggtcccgtggtaccgttcggaccccgagggacctaaggtcggaaatcgaagagtaacg

SEQ ID NO: 36627 - DNA, 563 bp, Homo sapiens
  misc_feature: GYAE6OF01CD2F3.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgctaattttgagcctggtatcagcagacgaccagggcaagttcctacaactcttgattctatgatgctatctctagtttggacgccgtagggtctcatcgtcggttcaggtcggcaggcggtatcgtgggtacccgtctttccacgttcctacacctatcccaaccgtactccctaccacgccctagaacgtctcgttgacctaactttattacctagtacaactagtactcgtaaggtcgttcggtcccggttagggtacccggttccgggacccgaacgggtaccgtaagggtacgaaacgttcgaaacggtacgtaacgg

SEQ ID NO: 36628 - DNA, 538 bp, Homo sapiens
  misc_feature: GYAE6OF01E31ZM.37.23.C01.1.454.CMB.1.raw
  modified_base (361)..(361): a, c, t, g, unknown or other
  misc_feature (361)..(361): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttggccgggcgagtcaggacatccgcaattttgtagcctggtatcagcagagaccagggcaagttcctcaactcttgatctatgatgcatctctatttggagccaggggtctcatctcgtcagtggcagcggatcgtgggaccncgtttcactcctcaccactccaccacgccctccagccctagaagtatgttagctaacttattaactgtaccaactagtatcgaagtagtcggtcccggtacgggtaccggtttcccgggacccgtaacggggacccgtaaacggggtacggtaaagtaccgtaagaaccgtaaacgg

SEQ ID NO: 36629 - DNA, 563 bp, Homo sapiens
  misc_feature: GYAE6OF01DONCV.37.23.C01.1.454.CMB.1.raw
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (557)..(563): a, c, t, g, unknown or other
  misc_feature (557)..(563): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaaatttatgtggactctgtgaagggccattcaccatctccagagacaacctccaaagaactcagtgtatctacacatgaacaaccttagatcgagacacggcttgtttattactgtagaaaaggccactatggagtcgtgggggccgaggggaacccacggtccaccgtctccctcacgccctccaccaaggggccccatccgggtcttccccccgtggccgcccctgcctcccacggagccacctccgagagccacacgcggcccgtgggcctcgccgtggccgaacggaccgttaccttaccacttcctacctacttaactcggacgtcccggggctgggacaacgggtcgaccgagtacgntnacgtnnnnnnn

SEQ ID NO: 36630 - DNA, 538 bp, Homo sapiens
  misc_feature: GYAE6OF01CSGSM.37.23.C01.1.454.CMB.1.raw
tcagtagtgtagatcacgaccggtgctcgatttagtacacgtgattagggattggggcagaagtctctctcagtcaggacacagcatggacatgagggtccctgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccagggaaagcccctaaggtcctgatctaatgatgcctcactttggaaagcgggtccatcaaaggttcagcgcagtgtatctagggacagtaattgaactctcaccatcagtagcctgcaagcctgatcgtattttgactaactttattactgttcagacacttaataagtggggaataagttccgggaccgtaggggaaccgtagggtttagaggaatacgaaaacgtaaccgtggtacgggactggaccgaacctaactgtcggttacc

SEQ ID NO: 36631 - DNA, 562 bp, Homo sapiens
  misc_feature: GYAE6OF01C44BG.37.23.C01.1.454.CMB.1.raw
  modified_base (226)..(226): a, c, t, g, unknown or other
  misc_feature (226)..(226): n is a, c, g, or t
  modified_base (424)..(424): a, c, t, g, unknown or other
  misc_feature (424)..(424): n is a, c, g, or t
  modified_base (554)..(562): a, c, t, g, unknown or other
  misc_feature (554)..(562): n is a, c, g, or t
tcagtagtgtagatcacgaccggtgctcgatttagtacacgtgattagggattggggggggtccctgagactctcctgcatagactcatacttgagtatgagttcattcttcatgggctgggcccgccaggctccgaggggaaggggctgggagtgggtggccaacatagcgagcgatggaagtgagagaaattatgtggactctgtggaagggccattcacatcncagagacaactccaagactcagtgtatctacacatagaaacaaccttagagtcgaggacacggcttagtttattactagtaagaaaagccaactagtggagtcgtcggggcgagggaccacggtcaccgtctcctcacgcctccaaccgaacggcccagtccggtccctccccgtggccctccctgcctccgaggacnccacctccggagacgccaacgcggcccggcccgtgggcctcggtccgtgggtaccaacggtaccttaccttccctattaccaactacttactcggaggccgggtcgtacggacgaacgggcgacgatcgnnnnnnnnn

SEQ ID NO: 36632 - DNA, 522 bp, Homo sapiens
  misc_feature: GYAE6OF01BL7PG.37.23.C01.1.454.CMB.1.raw
  modified_base (508)..(508): a, c, t, g, unknown or other
  misc_feature (508)..(508): n is a, c, g, or t
  modified_base (514)..(522): a, c, t, g, unknown or other
  misc_feature (514)..(522): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccaggggaaggggctgggagtgggtggccaacatagcgagcgatggaagtgagagaaatttatgtggactctgtgaagggccattcaccatctccagagacaactccaagactcagtgatctacacatgaacaaccttagagtcgaggacacggctgtttattactgtagaaaaggccactatggagtcgtggggccgagggaccacggtcaccgtctcctcacgccctccaccgaacgggcccaatcccgggtccttcccccgtggccgccctcgcctccgaggacgcaccctccgagactcacacgccggcccgtgggctcgcctggtcaaggctacttccatctacactactgagcgggctggacgacggcganagtgcnnnnnnnnn

SEQ ID NO: 36633 - DNA, 510 bp, Homo sapiens
  misc_feature: GYAE6OF01ESUU6.37.23.C01.1.454.CMB.1.raw
  modified_base (497)..(497): a, c, t, g, unknown or other
  misc_feature (497)..(497): n is a, c, g, or t
  modified_base (502)..(503): a, c, t, g, unknown or other
  misc_feature (502)..(503): n is a, c, g, or t
  modified_base (505)..(510): a, c, t, g, unknown or other
  misc_feature (505)..(510): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccaggggaaggggctgggagtgggtggccaacatagcgagcgatgggaagtgagagaaattatgtggactctgtgaagggccattcaccatctccagagacaactccaagaactcagtgtatctacacatgaacaaccttagagtcgaggacacggctgtttattactgtagaaaaggcactatggagtctggggccgagggaccacggtcaccgtctcctcagccctccaccaacgggcccatccggtccttccccctggccgccctgcctcccgaggacgcacctcccgagacgcacagccggccctgggctgcctggtcaaggctactccatctacactactgacgcgggctggcaaggcgnatagnngnnnnnn

SEQ ID NO: 36634 - DNA, 543 bp, Homo sapiens
  misc_feature: GYAE6OF01AOAR8.37.23.C01.1.454.CMB.1.raw
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttggccgggcgagtcaggacatccgctaattttgtagcctggtatcagcagagaccgagggcaagttcctcaactcttgatctatgatcgcatctctagtttggagccgaggggtctacgattcgttcggttcgaggtcggcaggcggtatcgtcgggaccgtctttcactctacacctatccaccncgccctaccgacgcctagaacgtnttcggttacgtactaacgtttattaccttcgtacaactagtatcgaagtacgtcggttccgtgggtaccggtccggaccgacgggaccgtaaggtacgaaatcgagtacgtaacg

SEQ ID NO: 36635 - DNA, 524 bp, Homo sapiens
  misc_feature: GYAE6OF01EHEVF.37.23.C01.1.454.CMB.1.raw
  modified_base (251)..(251): a, c, t, g, unknown or other
  misc_feature (251)..(251): n is a, c, g, or t
  modified_base (422)..(422): a, c, t, g, unknown or other
  misc_feature (422)..(422): n is a, c, g, or t
  modified_base (518)..(524): a, c, t, g, unknown or other
  misc_feature (518)..(524): n is a, c, g, or t
tcagtagtgtagatcacgaccggtgctcgatttagtacacgtgattagggattggggggggtccctgagactctcctgcatagactcatacttgagtatgagttcattcttcatgggctgggcccgccaggctccaggggaaggggctgggagtgggtggccaacatagcgagcgatggaagtgagagaaattatgtggactctgtgaagggccattcaccatctccagagacaactccaagaactcagtntatctacacatgaacaaccttagagtcgaggacacggctatttattactgcgcgagagaaggactgggcggtttcgactactggggccagggaaccctggtcaccgtctcctcagcctccaccaacgggcccatccggtcttccccctgggccgccctgcctccagggacncaccctcgagacgcacagccggccctgggctgccgtggtcaacggctacttccatctacactactgacgcgggctggcaacgggccgacagtacgnnnnnnn

SEQ ID NO: 36636 - DNA, 718 bp, Homo sapiens
  misc_feature: GYAE6OF01AONGM.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgctaattttgtagcctggtatcagcagagaccgagggactaacgttcctacaactcttgattctaatgatgctatctctagtttggacgccggtaggggtctacgtacgttccgtcggttcgaggtcggacgtacgggaccgggtatccggttaccggggtacccgttacctttccgtaacccttccgtaccctaacccgtactaccccaaccccgtaaccgtcccccgtacccgacgtacccgttaacggaaaggttaccgtttaggtttaaccggtaccttaaaccgtttttaacctttaaccgttacgtttaacccgtaaaccgttaacggtacttaccggtaaacgggtacgtttacccgggttacccgggttacggggttacccggttacccgggaccccgggtaaaccggggaacccggtaaacgggttaacgggaaaaccttacggaaacgggtaaacccggttaaccggg

SEQ ID NO: 36637 - DNA, 710 bp, Homo sapiens
  misc_feature: GYAE6OF01DH6VI.37.23.C01.1.454.CMB.1.raw
  modified_base (188)..(188): a, c, t, g, unknown or other
  misc_feature (188)..(188): n is a, c, g, or t
  modified_base (472)..(472): a, c, t, g, unknown or other
  misc_feature (472)..(472): n is a, c, g, or t
  modified_base (704)..(706): a, c, t, g, unknown or other
  misc_feature (704)..(706): n is a, c, g, or t
  modified_base (708)..(708): a, c, t, g, unknown or other
  misc_feature (708)..(708): n is a, c, g, or t
  modified_base (710)..(710): a, c, t, g, unknown or other
  misc_feature (710)..(710): n is a, c, g, or t
tcagtagtgtagatcacgaccggtgctcgatttagtacacgtgattagggattggggggtccctgagactctcctgcatagactcatacttgagtatgagttcattcttcatgggctgggcccgcaggctccgaggggagggctggagtgggtgccaacatagcgagcgatggaagtgagagaaattntgtggactcgtggtaggaacgggcctattccaccattcctaccaaggacgaaccaaccgacccaaaagtaacctcccggtgaccagttccgtagaaccaaaagttcggaaacctaggttccgtaggaacggaccggaccggaaggaccgtaacggtcttttaattttacgttaccgcggaccggacggaaggaaggtaacggtcggttcggggtccggttttaccgaacgttaccggtcggggacccgaacgggtacccctgggtacccacccggttcctaccncggaccgtcccctaccgaaccggacgggcccctagttccccggttccccttcccccgtggcccgtccctcgccctaccggacggaccgccgtaccgtaccggagacgcgacgccggtccggccgtcgggctcggtccgttacggaccgtaacggttaccttaccgttacctactaccgtaacctacgtaccgtgggaccggtccgggtacgcggacgacgcgacgtagtagnnngngn

SEQ ID NO: 36638 - DNA, 543 bp, Homo sapiens
  misc_feature: GYAE6OF01DHJO3.37.23.C01.1.454.CMB.1.raw
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
  modified_base (537)..(543): a, c, t, g, unknown or other
  misc_feature (537)..(543): n is a, c, g, or t
tcagtagtgtagatcacgaccggtgctcgatttagtacacgtgattagggattgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaactttccttttgactggttattatcccctagtgaccactgggccaggaaccctggtcaccgtctcctcacgccctccaccgaacgggcccagttccggtccttcccccgtcggcccacccctcctcccaagacgcacctcgtcggggcaccgacgccggcccgtcgggctcgcctggtcaacggtactacttccatcctacactactgacgcggcgtcggnaggcncatagnnnnnnn

SEQ ID NO: 36639 - DNA, 625 bp, Homo sapiens
  misc_feature: GYAE6OF01DD9EU.37.23.C01.1.454.CMB.1.raw
  modified_base (151)..(151): a, c, t, g, unknown or other
  misc_feature (151)..(151): n is a, c, g, or t
  modified_base (244)..(244): a, c, t, g, unknown or other
  misc_feature (244)..(244): n is a, c, g, or t
  modified_base (345)..(345): a, c, t, g, unknown or other
  misc_feature (345)..(345): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtntgacattctgatgacccagtcctccatcctccctgtcctgcatctgttagagacagagtcaccatcgcttggccgggcagtcaggacatccgnaattttgagcctggtatcagcagagaccgaggcaagttcctacaactcttgatctatgatgcatctctatttggacgccgtagggtctcactcgtcggttnaggtggcgaggtcggatccgtgggtacctctttacgacttctacctaacctactccaaccgacgtccctaccgacgtcctaggaacgtagttcgttacgtaccgtttaaactttacgttaaccgttcggttaactaacgtagttaaccgtacgtaacgggttacgttcccgggttacccggtagggttaaccccggtttcccggggaaccccgtaacggggaaccccgttaaacggggtaaccggaaacgtttaccgaaacggtaacccggtaaaccggg

SEQ ID NO: 36640 - DNA, 594 bp, Homo sapiens
  misc_feature: GYAE6OF01AWWJ4.37.23.C01.1.454.CMB.1.raw
  modified_base (246)..(246): a, c, t, g, unknown or other
  misc_feature (246)..(246): n is a, c, g, or t
  modified_base (352)..(352): a, c, t, g, unknown or other
  misc_feature (352)..(352): n is a, c, g, or t
  modified_base (587)..(594): a, c, t, g, unknown or other
  misc_feature (587)..(594): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaagggctggagtgggtggccaacatagcgagcgatggaagtgagagaaattatgtggactctgtgaagggccattcaccatctccagagacaactccaagactcagtntatctacacatgaacaaccttagagtcgaggacacggctagtttattactgtaagaaaaggccactatggagtcgtggggccgagggaccacggtcaccgtctccncacgcctccaccaacgggcccagtccggtccttcccccgtggccgccctcgcctccgacggacgccaccctcccgacgacgaccacgacgccgggccccgtcgggcctcggcccgtggttacccgaaacgggtaccttaaccgttacccgtaacttacccgttaacctaccttaccgttacggaacggtcccggggtacctcggggaccgaaaggggcccgacaacggtagcagnnnnnnnn

SEQ ID NO: 36641 - DNA, 924 bp, Homo sapiens
  misc_feature: GYAE6OF01D3IZ9.37.23.C01.1.454.CMB.1.raw
  modified_base (910)..(910): a, c, t, g, unknown or other
  misc_feature (910)..(910): n is a, c, g, or t
  modified_base (912)..(912): a, c, t, g, unknown or other
  misc_feature (912)..(912): n is a, c, g, or t
  modified_base (915)..(915): a, c, t, g, unknown or other
  misc_feature (915)..(915): n is a, c, g, or t
  modified_base (918)..(918): a, c, t, g, unknown or other
  misc_feature (918)..(918): n is a, c, g, or t
  modified_base (920)..(921): a, c, t, g, unknown or other
  misc_feature (920)..(921): n is a, c, g, or t
  modified_base (923)..(924): a, c, t, g, unknown or other
  misc_feature (923)..(924): n is a, c, g, or t
tcagtagtgtagatcacgaccggtgctcgatttagtacacgtgattagggattggggggggtccctgagactctcctgcatagactcatacttgagtatgagttcattcttcagtggcgtcgggccctgaggcctaccgaggggaagggctgggaggtgggtcgaccaaatagtagcgagcgagtaggaagtgaagtaagtaaaatttgtggtacggtaccttcgtaggtaggaaacggggcctaatttaccaacctaacttcctaccgaagaaacgaacctaaacctaccaaaagtaactcgtaaggttattaactacctaaccaataacgtaacgaaaaacctaaaccgtttaaggacgtacggaacggaacctacggtacttttagttttaatacgtaaggtaaaaaggaaaccggcctaagttagtagggtaacgttccgggacgggggaacccggaacggggtaaacccctaccgggttacccgaacccggttacccttaccccggttaacgaacccggtacccccttaacccggaaaaccccgggtaaaaccggggtccccctaagggtttccccggttttacccccctttaccccccggtgggacccccgtcccccgtaggtaccccttaacccgggaacgggaaccgtaccccgtaaaccccgttacccggggaaaacgaccggaacccggaaaccggacccggggttacccccgggtaccccgggttcggggtacccttacccgggtacccggttaacggggtaaacccgtaaaccgggttaacccttttaacccgttacccgttaaacttaacccgttaaaccctaacgttaaccggtaccggacggggacccgggttacgtacgggaaaccggaaccgggccgtaacgaaggttaccgnanacncananngnn

SEQ ID NO: 36642 - DNA, 567 bp, Homo sapiens
  misc_feature: GYAE6OF01DNHW4.37.23.C01.1.454.CMB.1.raw
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
  modified_base (558)..(567): a, c, t, g, unknown or other
  misc_feature (558)..(567): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccaggggaaggggctggagtgggtggccaacatagcgagcgatggaagtgagagaaattatgtggactctgtgaagggccgattcaccatctccagagacaactccaagaactcagtgtatctacacatagaacaaccttagagtcgaggacacggcttgtttattactagtaagaaaaggccaatagtggagtcgtggggaccgaggaccgacggtcaccgtctcctcagccctaccaaccaacgggcccagtccggtcccttcccccgnggccnccctcgcctccgaggacncacctccgagacgcacgagccggcccgtgggcctcggcccgtgggtaccaagggaccttaccgttccaagttcctaaccgacttacgtggaacggccggggtctcggggaccgaacgggccgtacagttagnnnnnnnnnn

SEQ ID NO: 36643 - DNA, 661 bp, Homo sapiens
  misc_feature: GYAE6OF01B6FHV.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacatttctgatcgacccagtcctccactccctccctgtctgctatctgttagagacagacgtcaccagtccgtcgttcggccggggacgtaggtccgaaggacctacgtccggtacttaaagttttggtacgtccttaggtactcgagacaggacgaccgagggactaacgttcctactaacttcttagtacttactagtcgtatcgtactacttctacgttaagtttcgggaacggtccggtaacggggtttcctacgtacgttccgttcgggttaccgtaggtcgggtacgacgggtcggtacgtcggtacgggtaccgttctttcgaccttccgtacaccgtactaccacccacgtaccctccgacgtccgtaagtaacgtcgtacgttacgtaccttaacgtttacttacgttactaactaacgtagtactacggtagtacgtcggtccggtaggtaccggtccggaccgtaggaccgtaaggtagaacgacaggtacgtacgg

SEQ ID NO: 36644 - DNA, 620 bp, Homo sapiens
  misc_feature: GYAE6OF01BPJ3W.37.23.C01.1.454.CMB.1.raw
  modified_base (451)..(451): a, c, t, g, unknown or other
  misc_feature (451)..(451): n is a, c, g, or t
  modified_base (611)..(620): a, c, t, g, unknown or other
  misc_feature (611)..(620): n is a, c, g, or t
tcagtagtgtagatcacgaccggtgctcgatttagtacacgtgattagggattggggggggtccctgagactctcctgcatagactcatacttgagtatgagttcattcttcatgggctgggcccgccaggctccgaggggaagggctgggagtgggtggccaacataggcgagcgatggaagtgagagaaattatgtggactcgtggtggaagggccgtattccaaccatcctccaagacgaaccaactccaaagaactcagtgtatctacacatacgaaacaaccgttagagtcgaggacacggtcttagttttaactacgtagtaaaggaaaacggcctaacgtagtgggacgttcggtgggggaccggaaggggacccacgggtccacccggtcctcctcacgccctaccaaccggaacgggccctagtcccgggtcccttccccgnggcccgccctcgcctaccggacggacgcccaccgtcgacgacgcacgcggccggtccgtcgggctcggcccgtggtaccgaaggtacccttaccgttccactacctaactaccttacgcggacgggccgggtcgtgggaaccgaacgggtccactagtgnnnnnnnnnn

SEQ ID NO: 36645 - DNA, 853 bp, Homo sapiens
  misc_feature: GYAE6OF01D1XUJ.37.23.C01.1.454.CMB.1.raw
  modified_base (126)..(126): a, c, t, g, unknown or other
  misc_feature (126)..(126): n is a, c, g, or t
  modified_base (843)..(843): a, c, t, g, unknown or other
  misc_feature (843)..(843): n is a, c, g, or t
  modified_base (845)..(846): a, c, t, g, unknown or other
  misc_feature (845)..(846): n is a, c, g, or t
  modified_base (848)..(853): a, c, t, g, unknown or other
  misc_feature (848)..(853): n is a, c, g, or t
tcagtagtgtagatcacgaccggtgctcgatttagtacacgtgattagggattggggggggtccctgagactctcctgcatagactcatacttgagtatgagttcattcttcatgggctgggcccncaggctccgaggggagggctggagtgggtcggaccaacagtagcgagcgagtggaaagtgaagaagtaaatttagtggtggacttcgtggtaggaacggggcctattccaacctatcctacgaagaacgaaccaaacctccgaaaagtaacctcgaaggttctaacttcctaaacaactaataacgaaaaccctaaaccgtttaaggacggttaccggaaggtaaccgtacgggttacttttaacggtttttaaacttaaccggtagggttaaaaaggtaaaaacggaccttaacgttaaggttcggggaacgttccggggtacggggggacccgtaaacgggggtaaccccaccggggttccaaccccggtttcctcccgtacgaccggtccccttacccggaaacccggaaccggggtcccctacggtttccccgggttcccctttccccccgggtggaccccgtccccgttaggccccgttaccgggaacgggtacccgaccccgtaacccggtaccggaaacgaccggacccgtaaacccggccggggtccccgggtaccccggtggggtcccgttaccgggtcccggttaacgggtaaccgtaaaccgggttaccctttaacccgttaccctaacgttacccttaaacccgacgttaacggcgggtaacgggtccgggtaacgtcgggaaaccgacgggccagtaaggtcgncnncnnnnnn

SEQ ID NO: 36646 - DNA, 701 bp, Homo sapiens
  misc_feature: GYAE6OF01DUI3W.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttggccgggcagtcaggacatccgctaattttgtagtcctggtatcagcagagaccagggcaagttcctcaactcttgatctatgatgcatctctagtttgggagccgtaggggtcctacgtatcgttcggtttcaggtggacgagtcgggtattcgtcgggtacccgtcttttaccgaccgttcctaccgtaaccacttacccaacccgtaccgtccctacccgaccgtacccgtaggtaaacgtcgtttaacggtttcggtaacctttaaaccgttttacgtttaaccgttacgttaaccgtaaaccgttaacggtttaacgttacggtaacgggtaacgtttacccggggttacccccgggtttaacggggttaccccgggttttacccgggaacccccgggtaaacgggggtaaacccgttaaacggggttaaacgggtaaaccgttaacccggaaacgggtaaccggttaaaacccggg

SEQ ID NO: 36647 - DNA, 603 bp, Homo sapiens
  misc_feature: GYAE6OF01APLVO.37.23.C01.1.454.CMB.1.raw
  modified_base (594)..(603): a, c, t, g, unknown or other
  misc_feature (594)..(603): n is a, c, g, or t
tcagtagtgtagatcacgaccggtgctcgatttagtacacgtgattagggattggggggggtccctgagactctcctgcatagactcatacttgagtatgagttcattcttcatgggctgggcccgccaggctccaggggaaggggctgggagtgggtgccaacatagcgagcgatggaagtgagagaaattatgtggactctgtgaagggccattcaccatctccagagacaactccaagaactcagtgtatctacacatgaacaaccttagagtcgaggacacggcttgtttattactgtaagaaaacggccactagtggagtcgtggggccgagggaccacggtccaccggtcctccgtcacgccctccgaacccgaacggggcccctacgtcccggtccttccccccgtggcccgcccctgcctcccgacggacgcccacccgtacccgacgacgccacgacggcccgggcccgtcggggcctcggcccgttcgggtaccgaacgggtaacccttaccttaccctacttacctacctacccttaacgtcggacggccggggcgtacgggccggaacggtcgacagtacgnnnnnnnnnn

SEQ ID NO: 36648 - DNA, 672 bp, Homo sapiens
  misc_feature: GYAE6OF01C0EHL.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctccaggtagcgggtgtgacattctgatgacccagtctccacttcctccctgtctgcatctgttagagacagagtcaccatcgcttcggccgggcgagtcgaaggacacgtccgactaattttcgtacgtccgtggtactcagcaggagaccgaggacctaacgttcctacgaacttcgttagtattctatgatgctactctcgtacgtttgggacgtccggtagggtctactacgttccgtcggtttgacggttcggactacgggacggtacgttccggtacgggtaccgttctttacccgacttccgtaccaacccttacctccaacccgtacgtccccgtactaaccggtccctaaggtaacgtacgtttacgttacgtaaccgtttaacttagtttacctacgttaacctaacgtagttaaccgttacgtaaccggtacgtttaccgggtcccgtaggggttacccggttaccggaccccggtaagggtaaacccgtaaggggtacgtaaagtaccgaaggtaaccgtaacggg

SEQ ID NO: 36649 - DNA, 578 bp, Homo sapiens
  misc_feature: GYAE6OF01CUGA8.37.23.C01.1.454.CMB.1.raw
  modified_base (310)..(310): a, c, t, g, unknown or other
  misc_feature (310)..(310): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaattttgagcctggtatcagcagagaccgagggcaagttcctacaactcttgatctatgatgcatctnatttgagccgtaggggtctcgattctcggttcaggtggcaggcggatcgtgggccgtctttccacgttcaccacctatccaccacgccctaccgacgtcctagaagtacttggttacgtacctaaatttacttacttacgttacaactaacgttatacgtaaggtattccggtacccggttgggtaacccggtttccgggaccccggtaagggaacccgtaaacggggttaacggtaaatacccggaaaggtaacccggttaaacggg

SEQ ID NO: 36650 - DNA, 811 bp, Homo sapiens
  misc_feature: GYAE6OF01BI8QV.37.23.C01.1.454.CMB.1.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
tcagtagtgtagatcacgaccggtgctcgatttagtacacgtgattagggattgggggggtccctgagactctcctgcatagactcatacttgagtatgagttcattcttcagtgggctcgggcccgcaggctccgaggggaaggggctgggaggtgggtcggccaacatagcgagcgagtggaagtgagaagaaattagtgtggactgtggnggaagggccatcacntcncaganacactcaanacncatgtatctagacaagtggacgctagagcgtaccgaggacacggtnttaggttgttaattagttcggtacgacggtaaagtagttaacgttttaaacgaacctttaaacgttaaaggtttcgaaggttacgtaacgttagggttaataggttactttacgttagtacgtaacgttaccgggtcggggaacccgtaaagggtacccgtagttcggtacccgtaccgttccgtacgttaccgaccgtacccctacccgaaacccggtaaaccgggtccccttaaccggtttcccggttcccccgttaccccccggtcgggtcccccgtccccgtaccggtcccgtaccgggaaccgggacctcccgtaaccccggtaccgggaacgacccggtacccgaacggaccccggggtaccccgggcccggttacggggtcccgtacccgggttacccggtacgggttaacccggtaaacccgggttaccctttaaccccgtttacctaacccgttaacccttaacccgtaaccgttaccgggtacgggaaccggggtcccggggtaccg

SEQ ID NO: 36651 - DNA, 668 bp, Homo sapiens
  misc_feature: GYAE6OF01B5ULE.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttggccgggcgagtcaggacactccgctaattttgacgtccgtgtatcagcagacgacgagggctaagttcctacaacttcttgactctatgtatgactatctctagtttcggacggtaccgtaggggttactcgtacgttccgttacggtttcgaggtcgggacgtacggaccgggtacgttacggtaccgggtacccgttcctttaccgaccttaccgtaccacctactccaacccgaccgtcccgtacccgaccgtacccgtaagaacgtcgttacggttacgtaaccgttaaacttttacgttaccgttacgttaaccaacgttacgttaacttacggaacgttacggttcccggttacccgggttagggttacccggttcccgggacccggtaagggaacccggtaaagggtacggtaaacgtacggtaaaggtaccggtaaaccg

SEQ ID NO: 36652 - DNA, 750 bp, Homo sapiens
  misc_feature: GYAE6OF01EK679.37.23.C01.1.454.CMB.1.raw
  modified_base (227)..(227): a, c, t, g, unknown or other
  misc_feature (227)..(227): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttggccgggngagtcaggacatccgctaacttttgtagcctggtatcagcagagaccagggcaagtttcctcaacttcttgtatctatgatgctatctactagtttgggacgccggtaagggggtctacgtacttccgttcgggttcgaggtcgggaccgagggccgggtaagtccggttccggggtaacccgttccgttttaccctacccgttacccttaccgaaccctaaccttacccgaacccctaccggtacccccttaccccgtaccgtaccccgttaacggtaaacggtacgtttacggtttaccggtaaccttaaacgtttttaactttaaccgtttacgttaacctaaacgttacgttaaacgttaaccgtacgggtacgtttacccggggttaccccgggttacggggttaaccccgggttacccggggtacccccggtaaaccgggggtaaccccggtaaacgggggttaaaccgggtaaaacggttaacccggtaaacggtaaacccgggttaaacccgggg

SEQ ID NO: 36653 - DNA, 655 bp, Homo sapiens
  misc_feature: GYAE6OF01A87SX.37.23.C01.1.454.CMB.1.raw
  modified_base (192)..(192): a, c, t, g, unknown or other
  misc_feature (192)..(192): n is a, c, g, or t
  modified_base (633)..(633): a, c, t, g, unknown or other
  misc_feature (633)..(633): n is a, c, g, or t
tcagtagtgtagatcacgaccggtgctcgatttagtacacgtgattagggtagtttgggggggtcccttgagactctcctgcatagactcatacttgagtatgagttcattcttcatgggctgggcccgcaggctccagggagggctggacgtgggtgccaacatagcgagcgatggaagtgagagaaattntggtggactctcgtgaagggccattcaccattcctccagacgaccaactccaagtactcagttgtaattcgtacacatcgaacaacccttaggaggtcgaggacacggctgtttattactgtagaaagccatatggagtcgtggggccgtagggaccacgggtcaccgtctccgtcacgtccctaccaaccaaacgggccccaacgtccgggtaccctttaccccccgtggcccgtacccgtgcctccgacggtacgccgtacccgtccccggacgacggaccaccgacgaccggtaccccgttcggggcttcggcccgttagggtaccgaacgggtaccctttaacgttacccgtacgttaccttaaccaccgttaccgtcggaaccggtccggggaccttcgggacccgaaacgggtcccgacctaacggttaccggcnccgaacgtcgcatcggctcgcg

SEQ ID NO: 36654 - DNA, 665 bp, Homo sapiens
  misc_feature: GYAE6OF01CFD0R.37.23.C01.1.454.CMB.1.raw
  modified_base (226)..(226): a, c, t, g, unknown or other
  misc_feature (226)..(226): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttggccggnagtcaggacatccgctaattttgagcctggtatcagcagagaccagggacaagttcctacaacgtcttgattctatgatgctatctactagtttggacgccgtaggggttctacgtactcgtcggttacaggttcggcgtaggacggtagttccggtggggtacccttccgttttacgaacccgtttcctaccctaaaccctacttaccccgaacccgaccggtccccttacccgaacgtccctaaggtaacgtatttacggttacgacccttaaaacttttacgttaacttcggtaacctaaacgtaagttaactacgtaaggttacttaccgggttccccggttagggtaacccggtttcccgggaaccccggtaaaggggtaaacccgtaaacggggttaacggaaacttaccggaaacggtacggtaaaaccggg

SEQ ID NO: 36655 - DNA, 635 bp, Homo sapiens
  misc_feature: GYAE6OF01EM8U4.37.23.C01.1.454.CMB.1.raw
  modified_base (229)..(229): a, c, t, g, unknown or other
  misc_feature (229)..(229): n is a, c, g, or t
tcagtagtgtagatcacgaccggtgctcgatttagtacacgtgattagggagttgggggcagaagtctctctcagtcaggacacagcatggacatgagggtccctgctcagctcctggactcctgctgcctctggctcccaggtagcgggtgtgacattctgatgacccagtctccgatcctccctgtctgcatctgttacgagacagagtcaccatcgcttgccgggntagtccaggacactccgctaattttgacgtccgtggtatccagcaggagtaccagggactaacgttcctacaactcttgatctatgatgctatctctagttcggagccgaagggtctacgacttcgttccggttacgtaggtcggcgacggtccggtaagtccggttacggggtaacccgttcgttttaccgaaccttaccctacctaacccgtaacttccctaacccgtacgtaccccgtacccaaggtcccgttaaggaacgtacgttcggttacgtacctaacgtttagttaacctaggtaccaacgtacgttatacgaagggtactacggttccccgtaggtacccggttcggacccgaagggtacccgtaaagggttacgaaactccgaagaacgtaacgg

SEQ ID NO: 36656 - DNA, 938 bp, Homo sapiens
  misc_feature: GYAE6OF01CHOHL.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctcctgtctgcatctgtagacgacagacgtcacctatccgtcttggaccgggtacgacgtcgaaggaccacgtccgactaattttgtacgtcctggtactcagccagacgaccgagggactaacgttcctactaacttcgttagacttacgttagacgtagtcgtactattaccttcttagtttacgggagtaccggtaacggggtcttacgtaacgttccgttccgggtttcgaacggtcgggtacgacgggtaccgggtacggtttacccgggttaccggggtaccccgttaccggttttaccgtaaccccgtttacccgttaacccctaaacccggttaccttaaccccgtaaacccccggtaccggttacccccccttaacccgtaacccgggtttaacccccgtaagggtaaaccggtttaaccgttttcgggttttaacgttaaacccccggtttaaaaacgttttttaaccgtttaaacccggtttaccgtttaaaccgttaaaacccgtttaacgggtttaaccgttaaacccggttaaacggggggttttacccgtttaaccccggggggttttaaccccgggtttaacccggggggtttaaccccggggtttaacccccggggtaaaaccccccgggggttaaaaccggggggtaaaaccccgggtttaaaaccgggggggtaaacggttaaacccgggttaaacccgggttaaaaaacggggttaacccccgggtttaaaaaccggggg

SEQ ID NO: 36657 - DNA, 763 bp, Homo sapiens
  misc_feature: GYAE6OF01A2LMU.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacatccagatgacccagtcctccttccacctgtctgcatctgtaggagacagacgtcacctatccacgttcggcccgggccaggtccggacttagttacgtaccgttggttcggtcctggtactacaacgaacgaaaccgaagggaaccgtaccccgtaacggtcctagtatctagtcgatcgccttaccgtacgttagggaaacggtccgggtacccagtacgtaacggttcgacggtcggacgtaggttacgtacgttcggtaggtactaagttaacttaccgtaccgttacctaccacctaacgttcgtaacgtaccgtaccgtacggaccgaccgtaccgtaggtacttacggtttacgttttacgtaaccctttaacgttttaactttaccgtacgttaccgtacgttaaccctaaacgtttaacggttaaacgggttacggggtaacgttaaccggttacccggggaaccgggtaaccggggtaacggtacggggtttacggaacggttaaacccgtaaacggtaaaaccggtaacggttcgggtacggtaccgttaccgtaccccgtaacccttagtttcccgttacggtttcccttaacccg

SEQ ID NO: 36658 - DNA, 611 bp, Homo sapiens
  misc_feature: GYAE6OF01B30BN.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgtagagacagagtcaccatcgcttgccgggcgagtcgaggacatccgactaattttgtacgtccgtggtatcagcgagagaccgagggactaacgttcctactactcttgtatctatgtatgcatctctagttgagccgagggtctctatcgtcgtcaggtcggcgaggtcggtagtcgtcgggtaccgtcttcacctctccaacctactccacccgtccgaccctaccgacgtaccgtagaacgtacgttcgttaacgtacgttaactttaacttacgttacgtaacctacgtaacgtacgtacgtacggtacgttccgggttacccggtacgggttacccggttcccggtacccgggaaccgggtaccggtaaagggtaacggtaaacggtacgtaaacggaaccggttaaccgg

SEQ ID NO: 36659 - DNA, 787 bp, Homo sapiens
  misc_feature: GYAE6OF01D106P.37.23.C01.1.454.CMB.1.raw
  modified_base (128)..(128): a, c, t, g, unknown or other
  misc_feature (128)..(128): n is a, c, g, or t
  modified_base (770)..(770): a, c, t, g, unknown or other
  misc_feature (770)..(770): n is a, c, g, or t
  modified_base (775)..(775): a, c, t, g, unknown or other
  misc_feature (775)..(775): n is a, c, g, or t
  modified_base (779)..(779): a, c, t, g, unknown or other
  misc_feature (779)..(779): n is a, c, g, or t
  modified_base (782)..(782): a, c, t, g, unknown or other
  misc_feature (782)..(782): n is a, c, g, or t
  modified_base (784)..(784): a, c, t, g, unknown or other
  misc_feature (784)..(784): n is a, c, g, or t
  modified_base (786)..(787): a, c, t, g, unknown or other
  misc_feature (786)..(787): n is a, c, g, or t
tcagtagtgtagatcacgaccggtgctcgatttagtacacgtgattagggattgggggggtccctgagactctcctgcatagactcatacttgagtatgagttcattcttcagtgggctcggggcccnccaggctccgaggggaaggggctgggagtggggtggccaaacataggcgagtcgagtgggaagtgagaagtaaattagtggtggacttcgtggtaggaacgggccgtatttccaacctattcctaccaaggaacgaaccaactacccgaaagtaacctacgtagttgtaacttactaacactaatacgaaacctaaccgttagacgtacggacggtacgacggtctttagtttaacttacgtagtaaaggaaaacggtccaacgttagtcgggacgttcgggtacggggaccggtaacgggacccgtacggtaccgtaccggtcttccgctaccgtacccctacaacccggaccggtcccacgtttccccggtcccctttcccccggacgggccccgttcccgcgtccccgtaccggaacgggtaccgtcccgtaacccgtaccggaacgccgacccgaccggaccgggtccccggccccggttggggtacccgttccggtcccgttaacgggtaaccgtaaaccggttaacccgttaacccttaacccttacgtaacccttaaccgttaaaccgttccggttaacggggaccggtaccggggtccgtcgggtaaaccggaacgggtccctaagtacggtanggacngtangancngnn

SEQ ID NO: 36660 - DNA, 653 bp, Homo sapiens
  misc_feature: GYAE6OF01CVTLM.37.23.C01.1.454.CMB.1.raw
  modified_base (150)..(150): a, c, t, g, unknown or other
  misc_feature (150)..(150): n is a, c, g, or t
  modified_base (464)..(464): a, c, t, g, unknown or other
  misc_feature (464)..(464): n is a, c, g, or t
  modified_base (536)..(536): a, c, t, g, unknown or other
  misc_feature (536)..(536): n is a, c, g, or t
  modified_base (568)..(568): a, c, t, g, unknown or other
  misc_feature (568)..(568): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctccaggtagcgggtntgacattctgatgaccctagtctccatcctcctgtctgctatctgtagagacagacgtccacctatccgcttcggccgggacgtagtcgaggacactccgtactaattttgtacgtcctaggtatcagcaggacgaccgaggactaacgttcctacgaaccttcgttagaacttctattggatcgactatacgttactaggtttaggacgtaccggtacgggtctcgtacgttccgttacggttacgaaggttcgacgacggtcggtaacttaccggtcgggtacccgttcgtttaccaccttccactaacccnttaccgaccgaccgtcctaccgacgtcctaaggtaacttgtcgttacgtaaccttaacgtttactacgttanacctaaacgtagttactaacggacggttaccncgggttacccggtagggttacccgttacgggacccggtaacgggtaacgtaacgggttaacaagttacgaaggtaccgtaacggg

SEQ ID NO: 36661 - DNA, 734 bp, Homo sapiens
  misc_feature: GYAE6OF01CWP0C.37.23.C01.1.454.CMB.1.raw
  modified_base (203)..(203): a, c, t, g, unknown or other
  misc_feature (203)..(203): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatcgacccagtcctccatcctccctgtctgcatctgttaganacagagtccaccatcgcttggccgggcgagtcgaaggacactccgactaattttgtagtccgtggtatcgaagcagacgaccgaggctaagttccacaacctcttagatctatgatgactatctctagttacgacgtccgtagggttctacgactcgtcggttacaggtcgcgagggtcgtaacttccgggtacggggtaccccttcgttttaccgaacccttccgtaaccaaccgtaccttacccctaaccgacccggtccctacccgtaaccggtccttaacgggaaacgtttcgtttaccgggttaactaaccctttaaaactttccgtttaaccgtcgtttaaacccgaagtaaccgttaacgtttaaccgaaacggggttttccgtacccgggtttaaccccggggttagggggttacccccggttaaacccgggtcccccgggtaaaagggggttacccccggttaaaaggggttaaacccgggtaaactttaacccgggaaaccggttaaacccggttaacggg

SEQ ID NO: 36662 - DNA, 662 bp, Homo sapiens
  misc_feature: GYAE6OF01EU51X.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctccaggtagcggtgtgacattctgatgacccagtctccatccctcctgtctgcatctgttagagacagagtccaacctagtccgcgttcggcccggggacgtacggtacgaaggactactccggtacttaagttttcgtacgtccgttaggtactcgagcaaggacggaccgagggactaacgttccctactaactcttacgattctatgatgctatctacgtagtttggacggtccgtagggtccttcgtacgttccgttcgttacgaggtcgggactacggcggtaacgttccggttaccgggtacccgttcgtttacctaccgttccctacgaaccctacttacccgaacccgtaccgtccctaccgacgtccgtacggaagtacgttcgttacctaactaactttacttactacgttacaacgtagtacacggtacgttacgtaccggttccggtacggttaccggtccggacccggtaacgggaacgtaacgggtaagtaaacgacgtaagtaccgtaacgg

SEQ ID NO: 36663 - DNA, 509 bp, Homo sapiens
  misc_feature: GYAE6OF01E02Q3.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcagtcaggacatccgcaattttgtagcctggtatcagcagagaccagggcaagttcctcaactcttgatctatgatgcatctctatttggagcgaggggtctcatctcggttcagtggcaggcgatcgtgggacctctttcactctcaccatccaccacgccctcacgtcctagaacgtatcgttagactaacttattactgtacaactagtatctaggacttcggtcccgtaggtaccggttccggacccgagggaaccgtaggtagaaatcgagacgtaacg

SEQ ID NO: 36664 - DNA, 749 bp, Homo sapiens
  misc_feature: GYAE6OF01DML5P.37.23.C01.1.454.CMB.1.raw
  modified_base (164)..(164): a, c, t, g, unknown or other
  misc_feature (164)..(164): n is a, c, g, or t
  modified_base (225)..(225): a, c, t, g, unknown or other
  misc_feature (225)..(225): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggcctcccgaggtagcggggtgtgacatttcngatcgacccagtcctccactccctccctgtctgctatctgtaagagacagacgtccaaccntccgtcgttcgggccgggcgagtccgaaggaccacgtccggtacttaagttttggtacgtaccgttaggtataccgaggacgacggaacggaacccgaggggtacctaacggttccctactaaacttctttgatacgttagtagtatcggactatccttacgtacggttcgggtacgtccggtacggggttctacgtacgttcccggttacggttaccgtaggtacggaccgtagggtcccgggttaagtcccgggtaaccgggttaccccgtttcttaacccgtacccgttccctaccgtaacctacccgtaccccaccggtaaccctccccctaccgtacccgttacgtaaccgtaaggttacttaccggttacgtaaccgtttaactttacgttacgtacgttaactaacgttacgtaagtaccgtaggtacttaccggggttcccgtacgggttaccggtcccggtaacccgggacgggtaacggtaacggtaacgaagtacggacggtaccgtaacggg

SEQ ID NO: 36665 - DNA, 624 bp, Homo sapiens
  misc_feature: GYAE6OF01EU2NZ.37.23.C01.1.454.CMB.1.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (435)..(435): a, c, t, g, unknown or other
  misc_feature (435)..(435): n is a, c, g, or t
  modified_base (457)..(457): a, c, t, g, unknown or other
  misc_feature (457)..(457): n is a, c, g, or t
  modified_base (562)..(562): a, c, t, g, unknown or other
  misc_feature (562)..(562): n is a, c, g, or t
  modified_base (594)..(594): a, c, t, g, unknown or other
  misc_feature (594)..(594): n is a, c, g, or t
  modified_base (609)..(609): a, c, t, g, unknown or other
  misc_feature (609)..(609): n is a, c, g, or t
  modified_base (616)..(616): a, c, t, g, unknown or other
  misc_feature (616)..(616): n is a, c, g, or t
tcagtagtgtagatcacgaccggtgctcgatttagtacacgtgattagggattgggggcagaagtctctctcagtcaggacacagcatggacatgagggtccctgctcagctcctgggctcctgctgctctggctcccaggagccaaatgtgacatccagatcgacccagtccctcctacctcgtgtcngactatcgtagagacagagtacnccacactaccgtacgtccgggccgacgtacgtaccgttattaagtaccgtcggttggtaccgtcgtagtactaacgaacgaaaccgaacggaacggtaacccctacggttaccgtctacgtactacgtagtacgtcgtcccgtacctacgttaaggtaacggaccggtcccgactacgtaggtacacgacggctagtagtacgtcgacggagatactactacnctcaccatacgtacgtagtccncgtcgacgtcgattagtgttagttttcaccgttaactttattaccgtactgaactcgttaactagttaagtaggggattacgtacggtccgggaaacgttacggnggttacaacggttaatacgtaacgacggtagnggtctacgacctacnttcgttntccttacg

SEQ ID NO: 36666 - DNA, 961 bp, Homo sapiens
  misc_feature: GYAE6OF01CZ4ZR.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatcgacccagtcctccatccctccctgtctgcatctgttagagacagacgtccaccatccgtcgttcggccggggcgagtcgaggacctacgtccggtacttaaactttttcggtaacgtcccgttaggggtacttaccgaaggaccgaacggaacggtaaccccggaacgggggtacctaaaacccggttttccccttacctaaaccgtttccgtttaggtaactttcccgtttaacgttaggtaacttccggtaccgtaatttccccgtttatttaacgggttttacggggaaccgggtcccgggttaaacggggggtttcccttccgtaacgttttcccggttccggggttttacgaacgggggtttcgggacgtaccggggtaccggggttaacggtttaccggggttccgggggttaacccccgttttcgttttaccccggtaacccgtttacccttaccctaaaaccccggtcccttaaccccgaaccccgttacccggtccccccgtaccgtaacccgttcccgttaaaggtaacgggttcgtttaacggtttaccggtaaaccctttaaacgttttaaccgtttacggtaacccggtttaaaccgttaacgttaacggtttaaaccttacgggaaaccgggtttaccggttcccgggtttaccccggggtacgggtttaaccccggggttacccgggacccccgggggtaaaaacgggtaaccggttaaacgggggttaaaaccggtaaaccggtaaccggtaaacggggttaacccggtttaaaaccgggg

SEQ ID NO: 36667 - DNA, 647 bp, Homo sapiens
  misc_feature: GYAE6OF01AV7I2.37.23.C01.1.454.CMB.1.raw
  modified_base (170)..(170): a, c, t, g, unknown or other
  misc_feature (170)..(170): n is a, c, g, or t
  modified_base (470)..(470): a, c, t, g, unknown or other
  misc_feature (470)..(470): n is a, c, g, or t
  modified_base (510)..(510): a, c, t, g, unknown or other
  misc_feature (510)..(510): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
  modified_base (641)..(644): a, c, t, g, unknown or other
  misc_feature (641)..(644): n is a, c, g, or t
  modified_base (646)..(647): a, c, t, g, unknown or other
  misc_feature (646)..(647): n is a, c, g, or t
tcagtagtgtagatcacgaccggtgctcgatttagtacacgtgattagggattgggggggtccctgagactctcctgcatagactcatacttgagtatgagttcattcttcagtgggctgggcccgccaggctccgaggggaaggggctgggaggtgggtcggccaaacngtagcgagcgagtggaagtgagaagaaattatggtgactgtggtagaagggccgattccaacctatcctccgaagacgaaccaacctaccgaaagtactcgaagtgttatctacaacgatacgaaacctaaaccgtttaggacgtacgaaggtaccgacggtcttagttttacttaacgtaggtaagaaaacgcctacgttagtgggcgtcggtcggggaccggagggacccaccgggtccaccggttcctcctcaccgtccctaccgaaccgacgggccacggtcccgtccttccccgnggccgtcccctgcctccgaggaccaccgtaccgcgaggcncgaacgcggcccgtccgtcgggcttacggccgtacggacgaacggtaccttaccttaccacttaccgtaactaacgtctacggcgggtcggtaccgtgggaaccggaccggagtacgacggtancngancnnnngnn

SEQ ID NO: 36668 - DNA, 778 bp, Homo sapiens
  misc_feature: GYAE6OF01CCVOK.37.23.C01.1.454.CMB.1.raw
  modified_base (207)..(207): a, c, t, g, unknown or other
  misc_feature (207)..(207): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccgaggtagcgggtgtgacattctgatcgacccagtcctccattccctccctgtctgcattctgtagganaacgagacgtcacctatccgtacgttcggcccgggactaggtccggtaacttagtttaaccggtaccgttgggttcgccgttaggtactacaaaaccgaacggaaaacccggaacgggaaaaccgtaccccgttaacgggtccttacggactacttacgtgtaacgttccgtcccttacgtaaccggttaacggggaacggtccgggtacctacgtaccggttaacggtccgaggccggtactaggttcgtacgtacggtacggaacctaaagttacttacctaccgttacctaccaaccgttactaccgtacgtaccgtcgttacgacgtactaccgtagttacgttagtttacgtttacgtaacctttaagtttaacgttacgttacgtacgacgtaacttaacgttaaggtaacggtacggtaacgttacccgggttacgggaccgggtaaggtaaccgggttaaagggttcggaaaacggttaaccggtaaaccggtaaacggttacgttccggggtaagttacccgtaggttaaccctaccgttttacgtcggttacccttaccgg

SEQ ID NO: 36669 - DNA, 636 bp, Homo sapiens
  misc_feature: GYAE6OF01BOGRR.37.23.C01.1.454.CMB.1.raw
  modified_base (484)..(484): a, c, t, g, unknown or other
  misc_feature (484)..(484): n is a, c, g, or t
  modified_base (532)..(532): a, c, t, g, unknown or other
  misc_feature (532)..(532): n is a, c, g, or t
  modified_base (625)..(625): a, c, t, g, unknown or other
  misc_feature (625)..(625): n is a, c, g, or t
tcagtagtgtagatcacgaccggtgctcgatttagtacacgtgattagggattgggggcagaagtctctctcagtcaggacacagcatggacatgagggtccctgctcagctcctgggctcctgctgctctggcctcccaggtcgccagatgtgccattacaaatcgacccagtcctccactccctcctgtctgcatctgtaggacgacagagtcatcatctacgtcggaccggacaagtcgaggtactaagttaagaaatggtaattaggcgtaggtactcgagacgaacgaaaccggacgggaaaccgtaccctaacgcctacctacgacttcgtaaggtcggtacacctacgttaccgttaagtttaaccgaaacggttcggggttaaccctaagttaacgtacgttacgacggacgtacgtaggtcggtaactcgtacgactacgtagttacttaccactactaccaaccgtatacgacncgacgtcagctacgcgtagtaatttactttacacttacttattacgtntactaagtaactacttaactaccgtttacctacggttacggtaccgaaccggaaggtaccctaaggtaccgtaacgtaacctaagtaccggtntccgtcgtacc

SEQ ID NO: 36670 - DNA, 598 bp, Homo sapiens
  misc_feature: GYAE6OF01AUZX8.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggtcgagtcaggacatcccgcaattttgtagcctggtactcagcagacgaccagggcaagttcctcaactcttgatctatgatgcatctctagtttggacgccgaggggtctcgattccgtcggttcaggtggcgaggccgggtattccgtacgggacccgtccttttcacccgttctacccgtaacctactacccaacccgacgtcccctacccacggtccctagaaacgtattcgttagaaccttaacctttattacctacgtaaccaacagttactacgagggtacttcgggtccccgtagggtcccggtttccgggaccccgtaaggggaccgtaaagggttcgggaaaacttcgaaacggtacgtaacgg

SEQ ID NO: 36671 - DNA, 821 bp, Homo sapiens
  misc_feature: GYAE6OF01D9U6V.37.23.C01.1.454.CMB.1.raw
  modified_base (227)..(227): a, c, t, g, unknown or other
  misc_feature (227)..(227): n is a, c, g, or t
tcagtagtgtagatcacgaccggtgctcgatttagtacacgtgattagggattgggggcagaagtctctctcagtcaggacacagcatggacatgagggtccctgctcagctccgtgggactcctgctgctcgtggcctcccgagggtagcggggtgtgactattcgtgatcgacccagtcctcctactccctcctgtctgactatcgtgtagagacagactcaccngtccgcgtcggccgggactagcgaggactacgtccgtagttaatttggacgtccgtaggtactcgacgacgaacggacgaaccggtagggtacctaacgttccctacgtaccttcgttacgaacttcgtagtacggtatacggtacttacgttaccgttacgtacggtttacgggaccggtaccgggttacgggtttacctacggttacgttccgggtttacggtacggtacgggtcgggtacggtaccggggtaccgttcgggttccgggtttaccccgggtacccgttttcgtttaccccgttacccttacccgttaacccgaacccgtttaacccaccccggtaccctaccgtccccgttaaccgtaccgtacccggttaaggtaagttccggtttaaccgtttaacgttaacctttaaccgtttaacgttaccgtaacgtaaccgttaagttaccggttaacgtacggttaccggtaaccggtttcccgggtacccgggttacccggtacccggggttaacccggcccgggtaaaacggtaaccgggtaacgggtaaccggtaaagtaccgggtaaccgtaacggtcggg

SEQ ID NO: 36672 - DNA, 693 bp, Homo sapiens
  misc_feature: GYAE6OF01CQWR8.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatccctccctgtctgcatctgttagagacagacgtcacctagtccgcttcggccggggtacgagtcgaaggactactaccgtactaagttttgtaacgtccttaggtactccgagcgacgacgaaccgagggactaaggttccctactaactcgttagacttctagtagatcgactattctacgtaagtttcggacggtacccgtaggggtcttacgtacgtttccgttcgggtttaccgaaggttcggaccgtacgggccggtacgtttacccggtacggggttaccccttacgttttacccgaccgttaccttaacccgaacctaccgttaccacccgtacggtcccctaccgtaccgtacctaggaaacgttcgttacgttacgtacctaacgttttactacgttcgtaaccacgttaactacgtaccgaaggttccttaccggtccggttacgggtaccggttccggaccgtaaacgggtacgtaaacgggtagactaaccgaagtccgtaacg

SEQ ID NO: 36673 - DNA, 795 bp, Homo sapiens
  misc_feature: GYAE6OF01CGX72.37.23.C01.1.454.CMB.1.raw
  modified_base (367)..(367): a, c, t, g, unknown or other
  misc_feature (367)..(367): n is a, c, g, or t
  modified_base (425)..(425): a, c, t, g, unknown or other
  misc_feature (425)..(425): n is a, c, g, or t
  modified_base (495)..(495): a, c, t, g, unknown or other
  misc_feature (495)..(495): n is a, c, g, or t
tcagtagtgtagatcacgaccggtgctcgatttagtacacgtgattagggattgggggcagaagtctctctcagtcaggacacagcatggacatgacgggtccctgctcagctccgtgggacctcctgctgcctctcggcctcccgagggtaggcgggtgtacgactagtttccgtaggaactaccggaacccccgtagttcccctccctaacccttccccctaccccgttggttacctcgaccttaagttccgttaaggtaacgaacggtaacacggtactaccaaccgtagtccggtccgttcggggaccgggactacggtacgaacggtactacgtccgtattaacgtttcggacgtcgtagtntacgagcgaagacgacgaggcttacctcctactacgttctagtactactagtgtactntacctattccgtacgttaaggttcgggacgtacggtggtacctgtaacgtcggttagtcgagtcgacggnggtacgtacggtccgtacggtaccctcgtacctctaccgacctaaccgtacctaacccgaccctacccgtacccgtacgtacccgtagtaacgtaacgttacgttacggttaaccttaaccgtttaaccgtttaacctttaaccgtaccgttaaaccgtagtaccttaaggaccgttacgggtaccgtttaccccgggtacgggttacccggttaaccccggtccggggtaaaacccggtacggtaaaccgggttaaccggaacggtaaaccctaacggtaacccgggttaacgtaccgg

SEQ ID NO: 36674 - DNA, 719 bp, Homo sapiens
  misc_feature: GYAE6OF01A795Q.37.23.C01.1.454.CMB.1.raw
  modified_base (704)..(704): a, c, t, g, unknown or other
  misc_feature (704)..(704): n is a, c, g, or t
  modified_base (713)..(713): a, c, t, g, unknown or other
  misc_feature (713)..(713): n is a, c, g, or t
  modified_base (717)..(717): a, c, t, g, unknown or other
  misc_feature (717)..(717): n is a, c, g, or t
  modified_base (719)..(719): a, c, t, g, unknown or other
  misc_feature (719)..(719): n is a, c, g, or t
tcagtagtgtagatcacgaccggtgctcgatttagtacacgtgattagggagttgggggggtccctgagactctcctgcatagactcatacttgagtatgagttcatttcttcagtgggctcgggccccgcaggctccgagggaagggctggaggtgggtgccaacgatagcgaagcgatgggaagtgaacggaagtaaatttagtggttaggaaccttcgttgggtacggaaacggggtccccgtaactttccaaccctacttccgtacccgaaggaacgaacctaaaccctccgaaaacggtaccttaccaggttactacgttaccgtaactacaacgtagaaaccctaaaccgttagaacggtacggacggtaccgacggttacgttgttttaattcgttagaaaggtaaacgtccctaacgttgagggtacgtccggtgggaccggacggaccgaccgtcgaccgtctccgtcacggcctaccgacccgaacggccctacgtccggttcccttacccccggtgcccgtccctacgtccctccgtaagtccgccacccgtcccgagtcgaccacgtaccgccggccgtcggctcgtcggtggtacacggtacttacctcgtacgttcctaacctctaccgtgaacgggtcggcccggttaggaaccggcgggtaccgacgttacgtaacgggcttaccggngacgcttanctgngn

SEQ ID NO: 36675 - DNA, 801 bp, Homo sapiens
  misc_feature: GYAE6OF01AOXD8.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctcgtggcctccgaggtaggcgggtgtgactattctgatcgaccctagtcctcctactccctcctgtctgctagtcttagtacgagacagtacgtccacctagtccgtcgtcggccgggacgacgtacgacggactacgtccgtacgtttaagttttaggtacgtccgttaggtactacgacgacgaacgacggaccggacggaccttaaccgttccctacgtaacctttcgttacgtacttacgttaagtacgtacgtcgtaactccttcgttaacgttacggtttacggggaccgtacggtacggggtcctacgttacgttccgttccgggttagtacggtacggacggtaacggtcgggtacggttccgggtaccggttcccggtttcctttacccgtaccttacccgtaacctacccgtaccttacccgaacccgtacccgtacccgtacccgtaaccgtcgtaacggtaacgttcgttaacggttaactaccgtttaactttaaccgtacttacgtaactaacgtcgtaactacggttaacgtccggttacccgggttccgggtaacccgggtttccggtaaccccgggacccgggtaaaacgggtaacccggttaaaggggtaaccgttaaacggtacggtaaaaccgggtacggttaaacccgggg

SEQ ID NO: 36676 - DNA, 858 bp, Homo sapiens
  misc_feature: GYAE6OF01DX19M.37.23.C01.1.454.CMB.1.raw
  modified_base (186)..(186): a, c, t, g, unknown or other
  misc_feature (186)..(186): n is a, c, g, or t
tcagtagtgtagatcacgaccggtgctcgatttagtacacgtgattagggattgggggcagaagtctctctcagtcaggacacagcatcggacagtggacgggtccctgctcagctccgtgggcctccgtgctgctcgtacgcctccgaggtaggcgggtgtgactattctagtactccgaacccncgtccctacctacctccctaccgtcgtcgtacgtactcgttacgttacggaagacgaacgtacggtaacctaccgtaacgtccggtccggtacgggtccggggaccgggtagtaaccgtacggaacgtccttaccgtccgttaagttacggttacgtacgtacggttataccgtacgaacgacggtaacggtacgaaccgggtacggtaacctttacccggtacctaacgtttacttacggtaactacgtactaggtctaacggtctacgtctttacggtacggtacggttacgggaccggttacggtaccggttactaacgtttcggttccgttacgggaacggttcggaccggtacgcgggtaccgggttacgtaccggtacccggtttaaccttaccgttaaacccgcttaaccctaaccccggtagaaccccgttacccgggacctaacccggtacccgaagtttaccgaaacgggtttactaacgtcggttttaacccaaccggttaaaacctttcgttaaacccgtaccggtaacaaccttaacgggttaactcggggttaaacccgtcgtagggtacccccggtaccggggtaacgaaccccgttcggggaaacccggtaaagaccgggtaattaaacccggagacgttaaacgggccgttacgg

SEQ ID NO: 36677 - DNA, 686 bp, Homo sapiens
  misc_feature: GYAE6OF01EPL1T.37.23.C01.1.454.CMB.1.raw
  modified_base (606)..(606): a, c, t, g, unknown or other
  misc_feature (606)..(606): n is a, c, g, or t
tcagtagtgtagatcacgaccggtgctcgatttagtacacgtgattagggattgggggcgagaagtctctctcagtcaggacacagcatggacatgagggtccctgctcagctccgtgggactcctgctgctctggctcccgaggtagcgggtgtgacattctgatcgacccagtcctccacttccctccctgtcctgcatcgtgttagacgacagagtccaccatccgtacgttcggccgggtcgacgtacaggacacgtccgtacttaagttttacgtacgtccgtggtactacgacgacgacgaacggtaccggaaggtcctaacggtttcccacgtaacttcgttgtacttctacgtagactcgcgtattccttactacgtttacggacgtaccggtcggggttactacgttacgtccgttcggtacgtaggtcggtacacgggtcggagtccgggtaccggtcccgttactttacgtacctcgtaaccgttaaccacgttacccaccggtacctcccgtacgtacgtaccgttaacgtacgtacgttcgtaacgtacgttaaactttcgttaacgtcgtaactaacgtacgtacgtaacgngttacggttccgtaccggtagggtcccgtacccgggacgacgggttaacacgggtaacgtaacgcgtaaggccgtaacgg

SEQ ID NO: 36678 - DNA, 780 bp, Homo sapiens
  misc_feature: GYAE6OF01COMJ2.37.23.C01.1.454.CMB.1.raw
  modified_base (191)..(191): a, c, t, g, unknown or other
  misc_feature (191)..(191): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggcctccgaggtagcggtgtgactattctgatgacccagtctccatccctccctgtctncatctagttagagacagacgtacacctagtcgtcgttcggccgggacgagtcgaggacactaccggacttaagttttcgtaacgtcccttaggtacttaccgaagaccgaagggacgaacccgtaaggggtactaaaccggtttcctaactaaccgttcttacgattacctagtagtatcgtactacttcgtacgttaagtttacgggacgtacccgggtaaggggttaccttacgtaacgtttcccgttcgggttaacgtaacgggttcgggaccgaaggtaccgggttaacggtcccggttaccggggtaacccgtttcctttttaccgacccgttacccttacccaaaccactttacccaaccccgtacggtacccctaccgtacgtacccgtaaggaattaacgttcgtaacgaacctttaaacgtttaatttaccggtagttaaacctacgtaacgttactacggtaaacggtacgtcccgggtttaaccggtacgggttaacccggggttccgaacccgggaacgggttaaacggtaaaccgggtaacgtaaacggtaacccgaaggttaaaccgtaaccggg

SEQ ID NO: 36679 - DNA, 924 bp, Homo sapiens
  misc_feature: GYAE6OF01DQKY0.37.23.C01.1.454.CMB.1.raw
  modified_base (906)..(906): a, c, t, g, unknown or other
  misc_feature (906)..(906): n is a, c, g, or t
  modified_base (911)..(911): a, c, t, g, unknown or other
  misc_feature (911)..(911): n is a, c, g, or t
  modified_base (913)..(913): a, c, t, g, unknown or other
  misc_feature (913)..(913): n is a, c, g, or t
  modified_base (916)..(920): a, c, t, g, unknown or other
  misc_feature (916)..(920): n is a, c, g, or t
  modified_base (922)..(923): a, c, t, g, unknown or other
  misc_feature (922)..(923): n is a, c, g, or t
tcagtagtgtagatcacgaccggtgctcgatttagtacacgtgattagggagttgggggggtccctgagactctcctgcatagactcatacttgagtatgagttcattcttcatgggctcggcccgcaggcctccgaggggaaggggctggaggtgggtcggaccaaacgagtagcggagcgagtagggaagtgaaagaagtaaaatttgttggtcggtaccttcgttgggagggaaacggggtccctaatttaccgaaccctaacgttcctaacccgaaggtaaaccgaacctaaaccctacccgaaaaggtaaccttcgaagtttggtaatttacctaaccaacgtaactaaccggaaaacccttaaaacccgtttaagggaacggttaccggaaagggtaccgtaacggggtcctttttagtttttaaacgtttaaccgttaagggtaaaacggtaaaaaccggtcccttaaaacggttaggtacgggttaacggttcccggggtacggggggaaccccgggtaaccggggtaacccccgtacccgggttacccgtaacccgttccccgttaccccgacccgtaacccggtaccccccttaaccccgggaaacccggtaaaccgggggtcccccctacgggtttccccggttacccccttttccccccggacgggtccccgtaccccggtcgtacccgtaccggaccggtaccgaccctaacccggtaccggacgaaccggaccgaccggtaccggcccgggtccggtcgggtaccgtcccgggtcgttaacgggtacccgtaaacggttaaccctttaccgttacctacgttacccgaacctttacgtaaccggtcgggaccgggccgggtacggtaccggacggtaacgggcacggttaancggancncgnnnnngnng

SEQ ID NO: 36680 - DNA, 875 bp, Homo sapiens
  misc_feature: GYAE6OF01BYKI9.37.23.C01.1.454.CMB.1.raw
  modified_base (163)..(163): a, c, t, g, unknown or other
  misc_feature (163)..(163): n is a, c, g, or t
tcagtagtgtagatcacgaccggtgctcgatttagtacacgtgattagggattgggggcagaagtctctctcagtcaggacacagcatggacatggagggtccctgctcagcctcctgggactcctgctgctctggcctccaggtagcgggtgtgactattcngatcgacccagtcctccactccctccctgtctgctattcgtgtagacgacgagactacaccagtccggtcgttacgggccgggtacgtacgtacgaacggacctacgtcccgtagttaacgttttggtaccgtccgttaggtactacgacgacgtaacggaccgaccgacgggtacctaacgtttcctacgtacttcgttagacttacgtatgtatcgtactacttcttacgttacggttaggaccggtacggtacggttctacgttacgttccggtttacggtacggtacggttacgggtaccgtacgggtacgggtacgttaccggggtaacccgggttcccgtttacctttacccgtaaccctttcccgtaacccgtaacccgttaaccttaccccgtaaaccccgttcccggtacccccgtaaccgttacccggaaccgtttaaacggtaaccggtttacgtttaacgggttaaccttaacccgttttaaacgttttaaccgttaacccgttaacgtaaccgttaaacgtttacggttaccgggttaaacgtaaaccgggtttaccggtttccccgggttaacccgggttacccgggtttaaccccgggtaacccgggtaaaaccccgggtaacgggttaaaaccccggttaaggggtaaaccggttaaaacctacggggtaaaaccggtaacccgggtttaaacggg

SEQ ID NO: 36681 - DNA, 966 bp, Homo sapiens
  misc_feature: GYAE6OF01CSYM3.37.23.C01.1.454.CMB.1.raw
  modified_base (116)..(116): a, c, t, g, unknown or other
  misc_feature (116)..(116): n is a, c, g, or t
  modified_base (133)..(133): a, c, t, g, unknown or other
  misc_feature (133)..(133): n is a, c, g, or t
  modified_base (262)..(262): a, c, t, g, unknown or other
  misc_feature (262)..(262): n is a, c, g, or t
tcagtagtgtagatcacgaccggtgctcgatttagtacacgtgattagggattgggggcagaagtctctctcagtcaggacacagcatggacatggaggtccctgctcagcctcgnggcctcctgctgctcgnggcctccgagggtacggcgggttagacgactagtttcgagacgttccgaacccgtacgttccctaccaccgtttccccttccccgttggttacctcggacctattccgtttaaggtaagacgtaaccgnggttaaccgaccctaaccgtagtcccggttacggttaccgggaccgggggtacgtacggttaacccgaaggtaaccgttaccgttacccgttacgtttaaagttttttccggaacgttacccgttaaggttacgtaccgtaacggaccgttaaacggaaccggaaccggtaccggttaaacgttaacccgtttacctaaccgtaacctttcgttacgttacgtacgttacgttaggacgtcgtaccttagttccgttacgttacggtttaacgggacgttacccggttaacggtttcctacgttacgtttccggttacggttaccggtaggtaccggaacggtaccgggttacgttaccggtttccgggtaaccccggttcccgtttaccgttcccgtaaccctttcccgaaaccccttaccgaaccttacccccgtaccgttaacccgtccccgtaaccggtacccttaacgggtacctaacggtttacgtttaccggtttaccttaaaccgtttaaccgttttaaccgttaaccggttaccttaacgaaccgttaaggttaaccctacgggttaacggtaacccggtttccggggtaaccccggttacggggtaccccggtttcccggggaaaaccgggttacgggtaaacccgttaacggggtaaacccgtagtaaacccggtagggtacccggttaacgg

SEQ ID NO: 36682 - DNA, 914 bp, Homo sapiens
  misc_feature: GYAE6OF01BFE6F.37.23.C01.1.454.CMB.1.raw
tcagtagtgtagatcacgaccggtgctcgatttagtacacgtgattagggattgggggcagaagtctctctcagtcaggacacagcatggacatggagggtccctgctcagctcctgggactcctgctgctctggctcccaggtagcgggtgtgactattcgtgactcgaccctagtcctcctactccctcccgtgtctgctactcgttgttaagacgaacgaacggtacgtaccaacctagttccggtcgttcgggcccgggacgtacgtacgtaacggactacgtaccccgtacgtttaaacgtttttcggtaaccggttcccgttagggttaactccgaacgggtaccgaaacggtaaaccgggaaacccggtaaccggggggtaaacccttaaccgggtttacccccttacctaacccgtttaccgtttagtaaccgtttacttaccgttaggttacgtaccggtacttacctttaccgttaaccgttaagtttaccggggaacgggttaccccgggtcggggtttcctaccggtaacggtttccggttcccggggttagtcgggttacgggccggtacgggccgggttaacgtcccgggttccggggtaccctttaccgttaccctacccttcgacccctaaccgtcctaacccaaccgttccccgtacccgtaccaccggtaccgttaacgaacgtttcggtaacgttacctaaacttttaaccgtttaccgttacgtaaaccttctaaaaccgttcgtaacgttacggaacggtttacccggtcccggttaacccgggtcgggttaaaccccggggtttcccgggaaaccccgggttaaacgggaacccggggtaaagttaacccgggggtaaaccaaacgggtaacccggtaacggttaacccggg

SEQ ID NO: 36683 - DNA, 660 bp, Homo sapiens
  misc_feature: GYAE6OF01AM9SB.37.23.C01.1.454.CMB.1.raw
  modified_base (187)..(187): a, c, t, g, unknown or other
  misc_feature (187)..(187): n is a, c, g, or t
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
  modified_base (647)..(647): a, c, t, g, unknown or other
  misc_feature (647)..(647): n is a, c, g, or t
  modified_base (657)..(660): a, c, t, g, unknown or other
  misc_feature (657)..(660): n is a, c, g, or t
tcagtagtgtagatcacgaccggtgctcgatttagtacacgtgattagggattggggggggtccctgagactctcctgtgcagcctctggtttcattctttagcaactacgccatgagctgggtccgccaggctcgagggaaggggctggagtgggtctcgaggtattactggtagtggtaatccgnatactacgcagactccggtgaccgggtccgttcaccgtctccaganacattccaagtaatcggtctatcgtaggaaatgaacagtcctggaagacggaccgaggaccaccggtcccctattattacnggtagcgagagtatacgaggaacgtgtaatacgacagcagcttacgtacgactaccgggtcggggaccccaacgggtaacccgtggtacctacccggttctcccgcgtaacgccccctaccgaacccggacgggtcccctaacggttccggttcccttccccgtcggcccctacccgtcctaccgaacgtccgtaccgaccgtcgggtacggggaccaccggtcggacccggtccgtgggtcctcggtcccgtacggtaccgtaacgtaccttaccgttacctacgttcctaacgtacgtacgtaggacggtccggcgtaggacgacggacgngagtcgcagnnnn

SEQ ID NO: 36684 - DNA, 718 bp, Homo sapiens
  misc_feature: GYAE6OF01CQFYI.37.23.C01.1.454.CMB.1.raw
  modified_base (128)..(128): a, c, t, g, unknown or other
  misc_feature (128)..(128): n is a, c, g, or t
  modified_base (209)..(209): a, c, t, g, unknown or other
  misc_feature (209)..(209): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (655)..(655): a, c, t, g, unknown or other
  misc_feature (655)..(655): n is a, c, g, or t
  modified_base (696)..(696): a, c, t, g, unknown or other
  misc_feature (696)..(696): n is a, c, g, or t
  modified_base (706)..(706): a, c, t, g, unknown or other
  misc_feature (706)..(706): n is a, c, g, or t
  modified_base (709)..(709): a, c, t, g, unknown or other
  misc_feature (709)..(709): n is a, c, g, or t
  modified_base (712)..(712): a, c, t, g, unknown or other
  misc_feature (712)..(712): n is a, c, g, or t
  modified_base (715)..(718): a, c, t, g, unknown or other
  misc_feature (715)..(718): n is a, c, g, or t
tcagtagtgtagatcacgaccggtgctcgatttagtacacgtgattagggagttgggggggtccctgagactctcctgcatagactcatacttgagtatgagttcattcttcagtgggctcgggcccncaggctaccggaggggaagggtctgggaggttgggcgaccaacagtaggcgagcgagtgggaagtgagaacgtaaatttgnggtacggacttcgtaggaggaacgggtcctattccacctattccacgaagacgaacctaacgacgaanaactcgaagtctaatacctacaacgtanaagaaacctaacgttaggaacgtacggaacgacgtacgtatttcgtttaatacgtagaaacggaaacgtcctaagtaggtacggacggttcggcgggggaaccggaacgggtaccctaaccgggtctacccggttcctaccgtacgacccgtaccgaacccgaaccggaaccggggttccctacgggtttcccccggtcccgttaccccggtggccccttacccgtcgacccgtacgtaccggaccgttcccgaaccgtcgaacggacgaccgaacggttcccgggaccggtccggacgggtctaccggtcggttacgaaccgagttaccctaactcaacgtccgttaanccggtacggtcgacgggtccgtcgacggctaaggccgttanaacgtgactncgntanatnnnn

SEQ ID NO: 36685 - DNA, 678 bp, Homo sapiens
  misc_feature: GYAE6OF01CZUJP.37.23.C01.1.454.CMB.1.raw
  modified_base (165)..(165): a, c, t, g, unknown or other
  misc_feature (165)..(165): n is a, c, g, or t
  modified_base (170)..(170): a, c, t, g, unknown or other
  misc_feature (170)..(170): n is a, c, g, or t
  modified_base (228)..(228): a, c, t, g, unknown or other
  misc_feature (228)..(228): n is a, c, g, or t
  modified_base (267)..(267): a, c, t, g, unknown or other
  misc_feature (267)..(267): n is a, c, g, or t
  modified_base (572)..(572): a, c, t, g, unknown or other
  misc_feature (572)..(572): n is a, c, g, or t
tcagtagtgtagatcacgaccggtgctcgatttagtacacgtgattagggagttgggggcaagaagtctctctcagtcaggacacagcatggacatggacgggtccctgctcagcctccgtgggactcctgctgctctggcctccgaggtggcgggtgtgaactntttcngactcgaccctagttcctccacttcccttcccgtgtctcgctatcgttagtagacgangtactccactacgtcgtcgttcggcggacagtcgagacncgtaccgtattagtttcgacgtcgttgtactcgacgacgacggacgaccggtaggactaccgttcctacctaactttcgtagtccttagtagtagacgtcgtaactcttacgttacgttagggtcggtaccgccggttaacggtctacgtcgtttcgttcggtacgtaggcgacgtcggtacgtcggtacggtcgtaccgtttctcctacgtcctaccaccgtacacccgacctctcccgtacgaccgtaacgtagtaacgtgttacgtaacgttactttaattacgtactactaacgtacggtntacggtacgtacgttacgtccggttaccgggacggttaccggttacgggaccggttaaaccggacggtaaacgggacgttaaaccggcggtaaacggtgtaacggg

SEQ ID NO: 36686 - DNA, 712 bp, Homo sapiens
  misc_feature: GYAE6OF01BBD67.37.23.C01.1.454.CMB.1.raw
  modified_base (162)..(162): a, c, t, g, unknown or other
  misc_feature (162)..(162): n is a, c, g, or t
  modified_base (199)..(199): a, c, t, g, unknown or other
  misc_feature (199)..(199): n is a, c, g, or t
  modified_base (698)..(698): a, c, t, g, unknown or other
  misc_feature (698)..(698): n is a, c, g, or t
  modified_base (705)..(709): a, c, t, g, unknown or other
  misc_feature (705)..(709): n is a, c, g, or t
  modified_base (711)..(712): a, c, t, g, unknown or other
  misc_feature (711)..(712): n is a, c, g, or t
tcagtagtgtagatcacgaccggtgctcgatttagtacacgtgattagggattgggggggtccctgagactctcctgcatagactcatacttgagtatgagttcattcttcatgggctgggcccgcaggctccgaggggaagggctgggagtgggtgccaanataggcgagcgaagtggaaagtgaagaagtaaattgnggtgtacttgtaggtaggaacgggcctataccactatcctacgagaacaccaaccgtaccgaaagtacctgaggttatactacacactagtacgaaacctaacgtaagacgtagaacggaccgtcgtctttatttaacgtacgaaggtaaacggaaacgtctaatggagggtagtcggggtacggggaccggtaaccggacccgtaacggtacccgtaccgtcctacccgtccgaacccggtccccgtaacccgaaacccgggtaccggtaccctaccgttccccgggtttccccttccccgggtcggccccgttcccgtcgtacccgacggtaacggcccgtacccgtacccgtacggaacgccgaccgaacggccgcccgggtccggtggtcgtccgtcggtacgtaaccggaacggttacctaccttacgtacgttacctaaccgacttaacgggcgggtacggccggtcgtaacgggacgaacggctaacgagtncgcacgnnnnngnn

SEQ ID NO: 36687 - DNA, 830 bp, Homo sapiens
  misc_feature: GYAE6OF01E0KWU.37.23.C01.1.454.CMB.1.raw
  modified_base (131)..(131): a, c, t, g, unknown or other
  misc_feature (131)..(131): n is a, c, g, or t
  modified_base (163)..(163): a, c, t, g, unknown or other
  misc_feature (163)..(163): n is a, c, g, or t
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (452)..(452): a, c, t, g, unknown or other
  misc_feature (452)..(452): n is a, c, g, or t
  modified_base (824)..(824): a, c, t, g, unknown or other
  misc_feature (824)..(824): n is a, c, g, or t
tcagtagtgtagatcacgaccggtgctcgatttagtacacgtgattaggggtagttgggggggtccctgagactctcctgcgatagactcatacgttgagtatgacgttcattcttcatgggctgggcccncaggctcgagggagggctggagtggtgccaangtgcgagcgtatggactgagagtaattntgtggatcgnggtggaaggcccattccaacctatcctaccgagacgactaacctccgaaagtaacttcgaacggtataacttacgaacctatattacggaaaccttaaccgtttaggacggttacgaacgggaccgtaacggtctttacgttttattaaccggttaggtaaacggtaaaaccggtcctaaacgtttagtcggggtaccggtttacgggtaccgggggacccgtaaaccgggtaccccgttacgggtacccncccgtttaccggtcctaaccggtaccgtaccccgttaccaaaccccgggaacgggtcccctaagtttcccccgggtacccccttttcccccggaggtccccgggtccccttacgtacccgtccgacggaccgaccgtaccccggttacccgaaggtaccgacgaaccggtacccgggtaccgggtaccccggtacgggtccgttaccggtccggttaccgggtacgtaaaccgggttacccttaaccgttacccgttaaccgttaccgttaccttaaccgttaaccgtccgggtaaaccgggtccggggacggtttaccggaaccgggttaccggtacccgtacggtaacgtagcgacgtacgaccgtgatnagtctg

SEQ ID NO: 36688 - DNA, 760 bp, Homo sapiens
  misc_feature: GYAE6OF01B6MG9.37.23.C01.1.454.CMB.1.raw
  modified_base (556)..(556): a, c, t, g, unknown or other
  misc_feature (556)..(556): n is a, c, g, or t
  modified_base (621)..(621): a, c, t, g, unknown or other
  misc_feature (621)..(621): n is a, c, g, or t
  modified_base (630)..(630): a, c, t, g, unknown or other
  misc_feature (630)..(630): n is a, c, g, or t
tcagtagtgtagatcacgaccggtgctcgatttagtacacgtgattagggattgggggcagaagtctctctcagtcaggacacagcatggacatgaggtccctgctcagcctctgggactcctgctgctcgtcggcctcccgagggtacggtcggggttcgtagacttacgtttccgttaggtacttaccggaacccctagttccctaccctaccttccccttcccgttggtcctgtccgtattccgttagttaacggaagtacgacggtctacccactacgtccgtcgttccgggaccgggacgagtaccgaggtaccacgtcctacgttaacgttttcgaacgttcttaggtacgtacgacggtacaacggacgaccggtacggtacttaccgttacctacgtaacttgtaccgtaattcgtagtcgtatcggtacctatcttaggtacgttacgacggtacggtacggtctacgtacgtcgttacggtcgtacggtacgtcggaacgtcgtacggtccgttacggttccttaccgttccacgtccgttaaccncgtaccaccgtaccgtccgtaccctcgacgtacgtaagtattacgttacggtaactaacccgttntttaaccgnttaacgtactactcggtacgtaccgtaggtaccgttccggtacgggttaacccggtcccggtaacccgggtaccgggaacgttaacgggaaaggttaccgaaacgtccggtaaaaggtcgttaaccgggg

SEQ ID NO: 36689 - DNA, 726 bp, Homo sapiens
  misc_feature: GYAE6OF01AIZLH.37.23.C01.1.454.CMB.1.raw
  modified_base (272)..(272): a, c, t, g, unknown or other
  misc_feature (272)..(272): n is a, c, g, or t
  modified_base (423)..(423): a, c, t, g, unknown or other
  misc_feature (423)..(423): n is a, c, g, or t
  modified_base (466)..(466): a, c, t, g, unknown or other
  misc_feature (466)..(466): n is a, c, g, or t
  modified_base (481)..(481): a, c, t, g, unknown or other
  misc_feature (481)..(481): n is a, c, g, or t
  modified_base (620)..(620): a, c, t, g, unknown or other
  misc_feature (620)..(620): n is a, c, g, or t
  modified_base (654)..(654): a, c, t, g, unknown or other
  misc_feature (654)..(654): n is a, c, g, or t
  modified_base (718)..(718): a, c, t, g, unknown or other
  misc_feature (718)..(718): n is a, c, g, or t
tcagtagtgtagatcacgaccggtgctcgatttagtacacgtgattagggagttgggggcagaagtctctctcagtcaggacacagcatggacatgacgggtccctgctcagtcctccgtggactcctggctgtcctcgtcggtcctcccggaggtacggtcgggtgtacgacttgttcctagacgtccgacccgtcgtccctaccctcttccccgttcccgtggtctacgtctacgttcgttacggtagaacgaccgtaggtactcaaccnttcccggtcggtccggcgggactagtcgaaggtacctacgtcccgtaagtttacgtttacggacgtccgttaagacgtacgacgaccggaacgtacggaaccggtacggtaacttaccgttaccaacgttcttacgttagtaactcgttanaggttcacggtattcgtacctaacggttggtacgggtacccgngggttaccggttacnggttaacccgttacggttaccggtaccggtaaggtcggtaatccgggtaacgtccgttaccggtcggtaccttccttacgacccctgtaacccaccttacggccctccgaacggtccctacggcgtacctagtaacctntccggttacaatttcgtactacgataaccgtaangttacgacgtcgtaccggtgtacccggtaggtcccgtcgacggtaacggtacagacgcgtaacngtcgtacg

SEQ ID NO: 36690 - DNA, 495 bp, Homo sapiens
  misc_feature: GYAE6OF02F1YZV.37.23.C01.1.454.CMB.1.raw
  modified_base (488)..(489): a, c, t, g, unknown or other
  misc_feature (488)..(489): n is a, c, g, or t
  modified_base (491)..(495): a, c, t, g, unknown or other
  misc_feature (491)..(495): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtctggggccgagggaccacggtcaccgtctcctcagcctccaccaagggcccatcgtcttccccctggcgccctgctccaggacgcacctccgagagcacagcggccctgggctgcctggtcaaggctacttccatctacactactgagcgggctggcaaggcgcatagnngnnnnn

SEQ ID NO: 36691 - DNA, 493 bp, Homo sapiens
  misc_feature: GYAE6OF02IF37B.37.23.C01.1.454.CMB.1.raw
  modified_base (486)..(493): a, c, t, g, unknown or other
  misc_feature (486)..(493): n is a, c, g, or t
tcagtagtgtagatcacgaccggtgctcgatttagtacacgtgattagggattgggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtctggggccgagggaccacggtcaccggtctcctcagcctccaccaagggcccatcggtcttcccctggcgccctgctcccaggagcacctccgagagcacagcggccctgggctgcctggtcaggctacttccatctacactactgagcggctggcaaggcgcatagnnnnnnnn

SEQ ID NO: 36692 - DNA, 497 bp, Homo sapiens
  misc_feature: GYAE6OF02I3Y28.37.23.C01.1.454.CMB.1.raw
  modified_base (493)..(497): a, c, t, g, unknown or other
  misc_feature (493)..(497): n is a, c, g, or t
tcagtagtgtagatcacgaccggtgctcgatttagtacacgtgattagggattgggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtctggggccgagggaccacggtcaccgtctcctcagcctccaccaagggcccatcggtcttccccctggccgccctgctcccaggagcacctccgagacgcacagcggccctgggcctgccctggtcaaggactacttccatctacactactgagcgggctggcaaggcgcatagnnnnn

SEQ ID NO: 36693 - DNA, 494 bp, Homo sapiens
  misc_feature: GYAE6OF02I05DO.37.23.C01.1.454.CMB.1.raw
  modified_base (487)..(494): a, c, t, g, unknown or other
  misc_feature (487)..(494): n is a, c, g, or t
tcagtagtgtagatcacgaccggtgctcgatttagtacacgtgattagggattgggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaggccactatggagtctggggccgaggggaccacggtcaccgtctcctcagcctccaccaagggcccatcggtcttccccctggcgccctgcctccaggagcacctccgagagcacagcggccctgggctgcctggtcaaggactacttccatctacactactgagcggctggcaggcgcatagnnnnnnnn

SEQ ID NO: 36694 - DNA, 499 bp, Homo sapiens
  misc_feature: GYAE6OF02IXYYQ.37.23.C01.1.454.CMB.1.raw
  modified_base (487)..(487): a, c, t, g, unknown or other
  misc_feature (487)..(487): n is a, c, g, or t
  modified_base (492)..(499): a, c, t, g, unknown or other
  misc_feature (492)..(499): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtctggggccgagggaccacggtcaccgtctcctcagcctccaccaagggcccatcgtcttcccctggccgccctgcctcccaggacgcaccctccgagagcacagccggccctgggctgcctggcaaggctacttccatcctacactactgagcgggctggcaggcgnatagnnnnnnnn

SEQ ID NO: 36695 - DNA, 489 bp, Homo sapiens
  misc_feature: GYAE6OF02HBYG1.37.23.C01.1.454.CMB.1.raw
  modified_base (359)..(359): a, c, t, g, unknown or other
  misc_feature (359)..(359): n is a, c, g, or t
tcagtagtgtagatcacgaccggtgctcgatttagtacacgtgattagggattgggggcagaagtctctctcagtcaggacacagcatggacatgaggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaattttgtagcctggtatcagcagagacccagggcaagttcctcaactcttgatctatgatgcatctcatttggagccaggggtctcatctcgttcagtggcagcggatctgggaccnctttcactctcaccatccacagcctccagcctagaagatgttgctaaacttattactgtacaacagtatcagtatcgtcccgtggtacgttcggacccagggacccaaggtcggaaatcgagacgtaacg

SEQ ID NO: 36696 - DNA, 491 bp, Homo sapiens
  misc_feature: GYAE6OF02G5XMO.37.23.C01.1.454.CMB.1.raw
  modified_base (398)..(398): a, c, t, g, unknown or other
  misc_feature (398)..(398): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagatacagagtcaccatcgcttgccgggcgagtcaggacatccgcaattttgtagcctggtatcagcagagaccagggcaagttcctcaactcttgatctatgatgcatctcatttggagccaggggtctcatctcgttcagtggcagcggatcgtgggaccgtctttcactctcaccatcaccagcctccagcctgaagntgttgactaacttattactgtacaactagtatcgaggtatggtcccgtggacgttccggcccgagggaccgaaggtgaaatcgagacgtaacg

SEQ ID NO: 36697 - DNA, 489 bp, Homo sapiens
  misc_feature: GYAE6OF02H4HTK.37.23.C01.1.454.CMB.1.raw
  modified_base (483)..(489): a, c, t, g, unknown or other
  misc_feature (483)..(489): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccagggaagggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgttattactgtagaaaagccactatggagtctggggccgagggaccacggtcaccgtctcctcagcctccaccaagggcccatcgtctccccctggcgccctgctcccaggagcacctccgagacgcacagcgcccgtgggctgcctggcaaggctacttccatctacactactgagcggctggcaaggcgcatagnnnnnnn

SEQ ID NO: 36698 - DNA, 493 bp, Homo sapiens
  misc_feature: GYAE6OF02F3SBH.37.23.C01.1.454.CMB.1.raw
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctcctgtctgcatctgttagagacagagtcaccatcgcttgccgggcgagtcaggacatccgcaattttgtagcctggtatcagcagagaccagggcaagttcctcaactcttgatctatgatgcatctcattggagccaggggtctcatctcgttcagtggcagcggatcgtgggaccgctttcactctcaccatcaccngcctccacgcctgaacgntgttgctaacttattactgtacaactagtatcaggatcgtcccggttaggaccgtttccggcccgagggaccgaaggtggaaatcgagacgtaacg

SEQ ID NO: 36699 - DNA, 533 bp, Homo sapiens
  misc_feature: GYAE6OF02JZO69.37.23.C01.1.454.CMB.1.raw
  modified_base (284)..(284): a, c, t, g, unknown or other
  misc_feature (284)..(284): n is a, c, g, or t
  modified_base (349)..(349): a, c, t, g, unknown or other
  misc_feature (349)..(349): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaattttgtagcctggtatcagcagagaccagggcaagttccncaactcttgatctatgatgcatctctatttggagccgaggggtctcacttctcgttcagtggacngcgatcgtcgggcctctttcactctacacctactaccaccgacgtccctaccgacgtcctagaacgtattgttcgaccttaactttacttacttcgtactaaactagtatacgaggtactcggtccggtcggtacgttccggaccgacgggacgtacgggtagaacgtcgaggtaccgtaacgg

SEQ ID NO: 36700 - DNA, 600 bp, Homo sapiens
  misc_feature: GYAE6OF02HNO2T.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctcctgtctgcatctgttagagacagagtcaccatcgcttgccgggcgagtcaggacatccgcaattttgtagcctggtatcagcagagaccagggcaagttcctcaactctgatctatgatgcatctctattggagccgaggggtctcatctcggttcaggtggcaggcggatcgtgggaccgtctttcactcgtaccacctatccaaccacgtccctacccgacgccctaggaaacgtattacggtttacgaccttaaacttttaactttaaccttacgttaacctaaactaaggttaacttaccgaaggtaacgttccgggttccccggttacgggtacccggttcccgggaccccgtaacgggggtaacccgaaacggggttaacggaaacgttaccgaacggaaccggttaaaccgg

SEQ ID NO: 36701 - DNA, 491 bp, Homo sapiens
  misc_feature: GYAE6OF02IWOPI.37.23.C01.1.454.CMB.1.raw
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
  modified_base (485)..(491): a, c, t, g, unknown or other
  misc_feature (485)..(491): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaaagaactcagtgtatctacacatgaacaaccttagagtcgaggacacggctgtttattactgtagaaaaggccactatggagtctggggccgagggaccacggtcaccgtctcctcagcctccaccaagggcccatcgcttccccnggccnccctgctccaggngcacctccgagagcacagcggccctgggctgcctggcaaggctacttccatctacactactgagcggctgcaaggcgcatagnnnnnnn

SEQ ID NO: 36702 - DNA, 497 bp, Homo sapiens
  misc_feature: GYAE6OF02JJH3F.37.23.C01.1.454.CMB.1.raw
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaattttgtagcctggtatcagcagagaccagggcaagttcctcaactcttgatctatgatgcatctcagttggagccaggggtctcatctcggttcagtggcagcggatcgtcgggacctctttcactctcaccactcaccagcccttcagccctgaagtactgttcgactaatttatacgttntacaaacngtatcagtatcggtcccgtggacgttcgaccgaggaccgaaggtggaaatcgaacgagtaacg

SEQ ID NO: 36703 - DNA, 530 bp, Homo sapiens
  misc_feature: GYAE6OF02GN71S.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaattttgtagcctggtatcagcagagaccagggcaagttcctcaactcttgatctatgatgcatctctattggagccgaggggtctcatctcgttcagtggcagcggatcgtgggacctctttcactctcacctatccaccacgcccttacacgtcctagaacgtgttgttacgaccttaaactttacttaacgttcgtacaaactagtactcgaggtatcgtctcggtacggtccgttccggaccgacgggtaccgtaagggtacggtaaactacgaaacggtaacg

SEQ ID NO: 36704 - DNA, 523 bp, Homo sapiens
  misc_feature: GYAE6OF02GLAL2.37.23.C01.1.454.CMB.1.raw
  modified_base (281)..(281): a, c, t, g, unknown or other
  misc_feature (281)..(281): n is a, c, g, or t
tcagtagtgtagatcacgaccggtgctcgatttagtacacgtgattagggattgggggcagaagtctctctcagtcaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaactatttaaattggtatcagcaagaaaccagggaaacncccccaagctcctggtctacgctgcatccaatttggaaacaggacgtcccatcaaggttcagtgaagtgatcgtgggacagtattttacttcaccttcagcagcctgcagtctagaagacattcgactaactattcttattacgtacaacctacctaatcgaccggtcccgtagggaaccctaaggtcggaactaagtaaccaaacggaacttagtggactgaccacctattccgtagttcc

SEQ ID NO: 36705 - DNA, 498 bp, Homo sapiens
  misc_feature: GYAE6OF02G5XGA.37.23.C01.1.454.CMB.1.raw
  modified_base (490)..(492): a, c, t, g, unknown or other
  misc_feature (490)..(492): n is a, c, g, or t
  modified_base (494)..(498): a, c, t, g, unknown or other
  misc_feature (494)..(498): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccattcaccatctccagagacaactccaagaactcagtgtatctacacatgaacaaccttagagtcgaggacacggctgtttattactgtagaaaaggccactatggagtctggggccgagggaccacggtcaccgtctcctcagcctcaccaacgggcccatccggtcttccccctggccgccctgctccaggacgcacctccgagcgcacacgcggccctgggctgcctgtcaaggactacttccatcacactactgagcggctggcaagggcgcatagnnnannnnn

SEQ ID NO: 36706 - DNA, 497 bp, Homo sapiens
  misc_feature: GYAE6OF02F0KL3.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaattttgtagcctggtatcagcagagaccagggcaagttcctcaactcttgatctatgatgcatctcatttggagccaggggtctcatctcggttcagtggcagcggatctgggccgctttcactctcaccatccaccagccctccacgccctgttaagatgttgctaactttattactgttacaactagtatcagatgtcccggtggacgttccggcccgagggaccgtaaggtaggaagtcgacgacgtaacg

SEQ ID NO: 36707 - DNA, 527 bp, Homo sapiens
  misc_feature: GYAE6OF02JH5IY.37.23.C01.1.454.CMB.1.raw
  modified_base (408)..(408): a, c, t, g, unknown or other
  misc_feature (408)..(408): n is a, c, g, or t
  modified_base (466)..(466): a, c, t, g, unknown or other
  misc_feature (466)..(466): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccttccaccctgtctgcatctgtaggagacagagtcaccatcacttgccgggcagtcggactattagtacctggtgcctggtatcaacagaaaccaggaagcccctaaggtcctgatctatgatgcctccactttggaagcgggtaccatcaagttcagcgcagtgtatcgtggacagaattcacgtctacacatcagtagcctgctagctgatgatttgactaacttattactntcagctaactattaagtgggaagtagttccgggaccgtaaggggtaccaggggtttanacggtacgtacgaaacgtacgtggtacgacgttacgacacccgtattacctgttaccttcg

SEQ ID NO: 36708 - DNA, 561 bp, Homo sapiens
  misc_feature: GYAE6OF02IOQ3E.37.23.C01.1.454.CMB.1.raw
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaacgccaaaaactcactgtatctgcaaatggacggcctgagatccgaggacacggctgtgtattattgtgcgagagatttagactaacaaagtttcgagtgactggtatgatgcttatgataccgtggggaccaagggaccagtggtcaccgtctcttcacgcctccaccgaacgggcccagtccggtccttccccgtcggccgccctgcctccgaggacgccacccgtccgagacgacacgacgccggcccgtgggcctcgccgttcgggtccaacgggtaccttaccttacccattcctaactacctaccgtcggacggccgggtcgg

SEQ ID NO: 36709 - DNA, 521 bp, Homo sapiens
  misc_feature: GYAE6OF02HRW2I.37.23.C01.1.454.CMB.1.raw
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaaattttgtagcctggtatcagcagagaccaagggcaagttcctcaactcttgatctatgatgcatctcatttggagccgaggggtctcatctcgttcagtggcagcgatcgtgggaccgtctttcactctcaacctatcaccacgccctacagcctagaagnttgttnactaacttattactgttacaaatagtatacgagtactaggtcccgtggtaccggttccggacccgtaacgggaccgtaacgggtacggtaaactacgacggacgtaacgg

SEQ ID NO: 36710 - DNA, 494 bp, Homo sapiens
  misc_feature: GYAE6OF02FPV1T.37.23.C01.1.454.CMB.1.raw
  modified_base (410)..(410): a, c, t, g, unknown or other
  misc_feature (410)..(410): n is a, c, g, or t
  modified_base (467)..(467): a, c, t, g, unknown or other
  misc_feature (467)..(467): n is a, c, g, or t
  modified_base (485)..(494): a, c, t, g, unknown or other
  misc_feature (485)..(494): n is a, c, g, or t
tcagtagtgtagatcacgaccggtgctcgatttagtacacgtgattagggattgggggggtccctgagactctcctgcatagactcatacttgagtatgagttcattattcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtctggggccgagggaccacggtcaccgtctcctcagcctcaccaagggccatcgcttcccctggcgccctgctccaggagcacctccgagngcacacgcggccctgggctgcctggcaaggctacttccatctacactactgagcggntggcaaggcgacagtagnnnnnnnnnn

SEQ ID NO: 36711 - DNA, 548 bp, Homo sapiens
  misc_feature: GYAE6OF02IEHVW.37.23.C01.1.454.CMB.1.raw
  modified_base (387)..(387): a, c, t, g, unknown or other
  misc_feature (387)..(387): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgctaattttgtagcctggtatcagcagagacccaggggctaagttcctcaactcttgattctatgatgctatctctagtttggagccgagggtctcattcgttcggttcaggtggcaggcggtatcgtcgggacctctttcacttcncaccactccaccacgccctcacgcctagaactgttcgttagacctaactttattacctgttaccaaactagttaatcgaggtacttcggtcccggtaggtaccggttcccggacccgtaagggaacccgtaagggtacggaaactacgacggacgtaacgg

SEQ ID NO: 36712 - DNA, 547 bp, Homo sapiens
  misc_feature: GYAE6OF02GW3VJ.37.23.C01.1.454.CMB.1.raw
  modified_base (204)..(204): a, c, t, g, unknown or other
  misc_feature (204)..(204): n is a, c, g, or t
  modified_base (381)..(381): a, c, t, g, unknown or other
  misc_feature (381)..(381): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
  modified_base (532)..(532): a, c, t, g, unknown or other
  misc_feature (532)..(532): n is a, c, g, or t
  modified_base (538)..(547): a, c, t, g, unknown or other
  misc_feature (538)..(547): n is a, c, g, or t
tcagtagtgtagatcacgaccggtgctcgatttagtacacgtgattagggagttgggggggtccctgagactctcctgccataggacctcagtaaccttgagtatgagttcattcttcatgggctgggcccgccacggctccagggaaggggcctgggagtagggtggccaacatagcgagcgatggaagtgagtagaaattanggtaggacttcctagtgaacgggccattcaccatctccaagagacaactccaagactcagtgtatctacacatgaacaaccttagagtcgaaggaccacggcttcgtttatactgtaagaaaaggccacgtactggaggtcctgggggccgagggacccacggtcaccgtctcctcncgccctacgaccgaacggcccagtccggtccttccccnggccnccctgcctccgaggcncacccgtcggagacgcacncgccggcctgggctgcctggtacaaggcctacttccatcctacactcgtgacgtcggcgtaggacaaggcganagtagnnnnnnnnnn

SEQ ID NO: 36713 - DNA, 526 bp, Homo sapiens
  misc_feature: GYAE6OF02IMH6M.37.23.C01.1.454.CMB.1.raw
  modified_base (414)..(414): a, c, t, g, unknown or other
  misc_feature (414)..(414): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcagtcaggacatccgcaattttgtagcctggtatcagcagagaccagggcaagttcctcaactcttgatctatgatgcatctctagttggagccgaggggtctcgattcgtcggttcaggtggcaggcggtatcgtcggggaccgtctttcaccttctacacctactcaccagccctccacgcctgaantgttcgactaacttattactgtacaactagtatcgaggatcggtcccggtacggtacgttccggacccgtaagggaaccgtaagggtacggtaaagtcgtacgacgtaacgg

SEQ ID NO: 36714 - DNA, 534 bp, Homo sapiens
  misc_feature: GYAE6OF02IXX5Q.37.23.C01.1.454.CMB.1.raw
  modified_base (225)..(225): a, c, t, g, unknown or other
  misc_feature (225)..(225): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctcctgtctgcatctgttagagacagagtcaccatcgcttgccgggnagtcaggacatccgctaattttgagcctggtatcagcagacgaccgaggctaagtcctacaactctgatctatgatgacatctctagttggacgtcgagggtctatacgtctcggttacagtcggacagcggatcgtgggaccgtcttcgacttctcactatcactacgcctacgacgtcctagaacgtattcgtacgactaaacgttacttacgtactacaaactaagtactacgaggtacttcggtacccggtaggtaccgttcgaccgtaacgggactaacggtagaacgtactacggacgtaacg

SEQ ID NO: 36715 - DNA, 587 bp, Homo sapiens
  misc_feature: GYAE6OF02IQD2J.37.23.C01.1.454.CMB.1.raw
  modified_base (280)..(280): a, c, t, g, unknown or other
  misc_feature (280)..(280): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggagccaaatgtgacatccagatgacccagtctccttccaccctgtctgcatctgtaggagacagagtcaccatcacttcgccgggccagtcggactattagtacctggttggcctggtatcaacagaaaccagggaacncccctaaggtcctagatctatgatcgcctccacgtttgggaaacgcggggttacccatcgaaggttcagcggcagtgtatcgtagggacagtaattcactctacacctatcagtacgcctgcagcctgatgtattttgactaacttattactgttctaactagtaactttactaaactttaccctacgttaccgtttccggaaccgtaacggggaccctaagggtacggaacgttaccgtaaaacgtaacgttggtacggtaccgtacggaccctaacccgtagttccgtttacgttcctttaaccg

SEQ ID NO: 36716 - DNA, 606 bp, Homo sapiens
  misc_feature: GYAE6OF02HPPI7.37.23.C01.1.454.CMB.1.raw
  modified_base (227)..(227): a, c, t, g, unknown or other
  misc_feature (227)..(227): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctcctgtctgcatctgttagagacagacgtcaccatcgcttggccgggnagtcaggacatccgctaattttgtagcctggtatcagcagagaccagggctaacgttcctacaacttcttgatctatgatgcatctactagttggacgcgagggtctctatcgttcgttcaggtcggcgaggtcgtacttcggtacgggtacccgttctttaccgaccttccttaccgaccctactacccaaccgtaccgtacccctcctacgtacccgtagaaacgtagttcgttacgtaacctaacgtttactttaacgtcgttaaccgtaaactagttactacgaggttacgttccggtaccggtacgggtaccgttacccggacccgtaacgggaccgtaacgggtacggtaaagtaccgtacggtacgtaacgg

SEQ ID NO: 36717 - DNA, 503 bp, Homo sapiens
  misc_feature: GYAE6OF02HPU5U.37.23.C01.1.454.CMB.1.raw
  modified_base (470)..(470): a, c, t, g, unknown or other
  misc_feature (470)..(470): n is a, c, g, or t
  modified_base (495)..(503): a, c, t, g, unknown or other
  misc_feature (495)..(503): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggatgtttattactgtagaaaaggccactatggagtctggggccgagggaccacggtcaccgtctcctcagcctccaccaagggcccatcgtcttcccctggccgccctgctcccaggacgcacctccgagagcacagccggccctgggctcgccgtggtcaaggactacttccatctacacctacngagcgggctggcaacggcgcatagnnnnnnnnn

SEQ ID NO: 36718 - DNA, 504 bp, Homo sapiens
  misc_feature: GYAE6OF02JT9IV.37.23.C01.1.454.CMB.1.raw
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(504): a, c, t, g, unknown or other
  misc_feature (500)..(504): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaaagaactcagtgtatctacacatgaacaaccttagagtcgaggacacggctgtttatactgtagaaaaggccactatggagtcgtggggccgagggaccacggtcaccgtactcctcagccctacaccaagggcccagtccgtctcccctggcnccctgctccagacgcacctccgagcncacagccggccctgggctcgcctggtccaaggactactccatctacactctgagcggctggcaacggcgcatagcagnangnnnnn

SEQ ID NO: 36719 - DNA, 572 bp, Homo sapiens
  misc_feature: GYAE6OF02HBWIL.37.23.C01.1.454.CMB.1.raw
  modified_base (564)..(572): a, c, t, g, unknown or other
  misc_feature (564)..(572): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccattcaccatctccagagacaactccaagaactcagtgtatctacacatgaacaaccttagagtcgagacacggctgtttattactgtagaaaagccactatggagtcgtggggccgagggaccacggtccaccgtctcctcacgcctccacccacgggcccatccggtccttcccccgtggcccgccctcgtcctccgacggcgccacccgtccgacgacgccaccgacggccggcccgtcggggcctcggcccgttgggtaccaacgggtacccttaccttcccgacttaccttaaccaccttaacgtggacgccggggtcctacgggacgaacgggtccgactagtagcgnnnnnnnnn

SEQ ID NO: 36720 - DNA, 503 bp, Homo sapiens
  misc_feature: GYAE6OF02HICGW.37.23.C01.1.454.CMB.1.raw
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (496)..(503): a, c, t, g, unknown or other
  misc_feature (496)..(503): n is a, c, g, or t
tcagtagtgtagatcacgaccggtgctcgatttagtacacgtgattagggattgggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccattcaccatctcagagacaactccaaagactcagtgtatctacacatgaacaaccttagagtcgagacacggctgttatactgtaagaaaaggccactatggagtcgtggggccgagggaccacggtcaccgtctcctcagcctccaccaaggcccatccggtccttccccgnggccncccgtgcctccgaggcgccacctcccgagacgcacagccggccctcgggctgccgtggcaaggcctactcatctacactactgacgcggactggacaaggcgcatacgnnnnnnnn

SEQ ID NO: 36721 - DNA, 529 bp, Homo sapiens
  misc_feature: GYAE6OF02IA2UD.37.23.C01.1.454.CMB.1.raw
  modified_base (226)..(226): a, c, t, g, unknown or other
  misc_feature (226)..(226): n is a, c, g, or t
  modified_base (413)..(413): a, c, t, g, unknown or other
  misc_feature (413)..(413): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggngagtcaggacatccgcaattttgtagcctggtatcagcagagccaggacaagttcctcaactctgatctatgatgcatctactatttggagccagggggtctcattcgtcgttcaggtggcaggcggtatcgtcgggaccgtctttcacttctcaccactacaccacgtcctccacgcctagaagtnttacgttacgactaactttacttacttacgtactaactaagtatcgagtactcggtccgtaggtaccggtccggacccgagggtaccgaaggtacggaaatcgacggacgtaacgg

SEQ ID NO: 36722 - DNA, 509 bp, Homo sapiens
  misc_feature: GYAE6OF02G37VM.37.23.C01.1.454.CMB.1.raw
  modified_base (394)..(394): a, c, t, g, unknown or other
  misc_feature (394)..(394): n is a, c, g, or t
  modified_base (500)..(509): a, c, t, g, unknown or other
  misc_feature (500)..(509): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccaggggaaggggctgggagtggggtggccaacatagcgagcgatggaagtgagagaaattatgtggactctgtgaagggccattcaccatctccagagacaactccaagaactcagtgtatctacacatgaacaaccttagagtcgaggacacggctgtttatactgtagaaaaggccactatggagtctggggccgagggaccacggtcaccgtctcctcagcctccaccaacgggcccatcggtccttccccctggccnccctgcctcccgaggacgccacctccgagacgcacgacgccggccctgggctgcctggcaaggctactccatctacactactgagcgggctggcaaggcgcagtgnnnnnnnnnn

SEQ ID NO: 36723 - DNA, 562 bp, Homo sapiens
  misc_feature: GYAE6OF02FIAI2.37.23.C01.1.454.CMB.1.raw
  modified_base (530)..(530): a, c, t, g, unknown or other
  misc_feature (530)..(530): n is a, c, g, or t
  modified_base (553)..(562): a, c, t, g, unknown or other
  misc_feature (553)..(562): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccaggggaaggggctgggagtgggtggccaacatagcgagcgatgggaagtgagaagtaaattagtggtggactcgtggtaggaacgggccgtattccacctatcctccagagaaccaactccaaagaacctcgagttgtattctaacacatgaacaaccttagagtcgaggacacggctgtttatactgtaagaaagccactatggagtcgtggggccgagggaccacggtcaccgtctcctcacgccctccaccgaacgggcccagtccgtcccttcccccgtggccgtccctgcctccgaggacgccacccgtccgagacgcacgacgccggcccgtgggctcgccgtcggtacgaaggaccttacttccattcctacctactactgaggccgggntcgggacaacggcacgtagtagnnnnnnnnnn

SEQ ID NO: 36724 - DNA, 558 bp, Homo sapiens
  misc_feature: GYAE6OF02HMETP.37.23.C01.1.454.CMB.1.raw
  modified_base (549)..(558): a, c, t, g, unknown or other
  misc_feature (549)..(558): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccaggggaaggggctggagtgggtggccaacatagcgagcgatggaagtgagagaaattatgtggactctgtgaagggccgattcaccatctccagagacaactccaagaactcagtgtatctacacatagaacaacttagagtcgagacacggctgtttatactgtagaaaggccatatggagtcgtggggccgagggaccacggtcaccgtctcctcacgcctccaccgaacgggcccagtccggtcccttcccccgtggcccgtccctgcctccgaggacgccaccctccggagacgcacgacgccggcccgtgggctcggccgtcgggtacaacggtaccttaccttccaacttccgtactaaccttacgtcggaacgggcgggtcctcgggacgaacgggccgacgagtagnnnnnnnnnn

SEQ ID NO: 36725 - DNA, 514 bp, Homo sapiens
  misc_feature: GYAE6OF02FJMQ1.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaattttgtagcctggtatcagcagagaccagggcaagttcctcaactcttgatctatgatgcatctctatttgagccgaggggtctcatcgtcgttcgagtggcagcggatcgtgggaccgctttctactcctcaccactccaccacgccctccacgcctgaagatgtgactaacttattacttgtacaacagtatacagatcgtccgtacggtaccggttccggacccgacgggaccgaacggtttttacggaactacgacggacgtaacg

SEQ ID NO: 36726 - DNA, 724 bp, Homo sapiens
  misc_feature: GYAE6OF02JZ91G.37.23.C01.1.454.CMB.1.raw
  modified_base (149)..(149): a, c, t, g, unknown or other
  misc_feature (149)..(149): n is a, c, g, or t
  modified_base (158)..(158): a, c, t, g, unknown or other
  misc_feature (158)..(158): n is a, c, g, or t
tcagtagtgtagatcacgaccggtgctcgatttagtacacgtgattaggattggggcgagaagtctctctcagtcaggacacagcatggacatgagggtccctgctcagctcctgggactcctgctgctctggctccaggtagcgggtntgacattcngatgacccagtcctccatccctcctgtctgcatctgttagagacagacgtcacatcgcttggccgggtcagtcaaggacacgttccgctaattttggacgtccgttaggtactaccgaggtaccaaggtaacgaccgaggggcctaaacggttcctacgtaaccttcgttcgacttctaagtcgtaattcggactagttcctactagttttacgggaacgtcccgtaaggggttccctcgtaacgttccgtttcggttactacgggtcggtacacgggttccgggtaacttcggtaccggggtaacctttccgtttccgacgttacctaccgaaccgtactccgaaccgtacggtaccccttccgacggtcttaacggaacgtacgttcggttacgtaccttaaactttacgttaaccttgtaacccaaacgttagtttaacgacccgttaggtacgtttacccggtaccccgggttaggttaaccccggtttccggggaacccgtaaggggttaacccgtaaggggttacccggaaagttacccggttaaggacccgttaacggg

SEQ ID NO: 36727 - DNA, 528 bp, Homo sapiens
  misc_feature: GYAE6OF02H0N8R.37.23.C01.1.454.CMB.1.raw
  modified_base (157)..(157): a, c, t, g, unknown or other
  misc_feature (157)..(157): n is a, c, g, or t
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (291)..(291): a, c, t, g, unknown or other
  misc_feature (291)..(291): n is a, c, g, or t
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (521)..(528): a, c, t, g, unknown or other
  misc_feature (521)..(528): n is a, c, g, or t
tcagtagtgtagatcacgaccggtgctcgatttagtacacgtgattagggagttgggggggtccctggagactctcctgcatagactcatacttgagtatgagttcattcttcatgggctgggcccgccaggctccaggggaagggctggagtgggnggccaacatagcgagcgatggaagtgagagaaattangtggactctgtgaaggggccattcaccatcnccagagacaaacttccaaagaactcagtgtanctaaccagatnaaacaacctagagtcgaaggacncggactgttatactgtaagaaaagccaatanggatctggggccagggaccaggtcaccgtnccctanagcctcaacccgaggacccatcggtccttccccctggccaccctcctcgaacgcgccactcgtggggcacgagtccgacctgggctcgcgtacgtagacggtacctacttcccgatcctaacgacctactacgacgtcggactcggacagggtcgcaatacgnnnnnnnn

SEQ ID NO: 36728 - DNA, 615 bp, Homo sapiens
  misc_feature: GYAE6OF02HS27M.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgctaattttgtagccttggtatcagcagagaccagggcaagttcctacaacttcttgatctatgatgcatctctagttggagccgagggtctcgatcgttcggttcaggtggcaggcggtatccgtggggacccttcgtttaccacttcctccaacctactacccaaccgtacgcccctaccgaccgtaccctagaaagtcttggtttacgacctaaacttttaatttaaccttagttaacccaaacgtaaagttaactacgtaagggtacgtttccgggtaccccggtttacgggtacccggtttacccgggacccgaacggggtaacccggtaagggttaacggtaaacgtacgtaacggtaaccgtaacggg

SEQ ID NO: 36729 - DNA, 590 bp, Homo sapiens
  misc_feature: GYAE6OF02GF8MT.37.23.C01.1.454.CMB.1.raw
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (585)..(590): a, c, t, g, unknown or other
  misc_feature (585)..(590): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccaggggaaggggctggagtgggtggccaacatagcgagcgatggaagtgagagaaattatgtggactctgtgaagggccattcaccatctccagagacaactccaagaactcagtgtatctacacatgaacaaccttagagtcgaggacacggctgtttattactgtagaaaaggccactatggagtcgtggggccgagggaccacggtcaccgtctcctcacgccctccaccgaacgggcccatccggtccttcccccgtggcccgccctgcctcccgagggacgccacccgtccgacgacgccaacgacggcccggcccgtcggggccctcggcccgttcgggtaccgaacgggtaacccttaccgtttacccaactttccctaacctaccttaccgtaggacggccggggtcgtcgggacgaacgggccgacgtaagtaggnancncgnnnnnn

SEQ ID NO: 36730 - DNA, 666 bp, Homo sapiens
  misc_feature: GYAE6OF02JYNFG.37.23.C01.1.454.CMB.1.raw
  modified_base (246)..(246): a, c, t, g, unknown or other
  misc_feature (246)..(246): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatcgacccagtctccatcctccctgtctgcatctgttagagacagacgtcaccatcgcttggccgggcgagtcgaggacatccgntaattttgagcctggtatcagcagacgaccgagggactaacgtcctacaactcttagactactatcgatcgactatctctagttcggacgtccggtagggtctacagttccgttcgggttactaaggtcggacgtaggtccgggtattccggtagggtaacccttcgtttaccgacctttcaccgtaacctacgtccaaacccgtcgtacccttaccgacgtcccgtagtaaacgtattcggttacgaaccttaaacgtttacttaccgttagtaacctaaacgtacgttaactccggtaaggtactttccgggtacccgggttaacggttaccggttacccgggtaacccggtaaacggggtaacccgttaaaggggtaaccgtaaaccggtaccggtaacgggtaaccgttaaccggg

SEQ ID NO: 36731 - DNA, 498 bp, Homo sapiens
  misc_feature: GYAE6OF02GJI41.37.23.C01.1.454.CMB.1.raw
  modified_base (465)..(465): a, c, t, g, unknown or other
  misc_feature (465)..(465): n is a, c, g, or t
  modified_base (489)..(490): a, c, t, g, unknown or other
  misc_feature (489)..(490): n is a, c, g, or t
  modified_base (492)..(498): a, c, t, g, unknown or other
  misc_feature (492)..(498): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtctggggccgagggaccacggtcaccgtctcctcagcctccaccaagggcccatcgtcttccccctggccgccctgcctccaggagcacctccgagacgcacagcggccctgggctgcctggtcaaggctactcatctacactacngagcgggctggcaaggcgcatagnngnnnnnnn

SEQ ID NO: 36732 - DNA, 529 bp, Homo sapiens
  misc_feature: GYAE6OF02GJDCA.37.23.C01.1.454.CMB.1.raw
  modified_base (340)..(340): a, c, t, g, unknown or other
  misc_feature (340)..(340): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttggccgggcgagtcaggacatccgcaattttgtagcctggtatcagcagagaccagggcaagttcctcaactcttgatctatgatgcatctcatttggagccgaggggtctcatctcggttnagtggcagcggatcgtgggacctctttcactctccacctatccaccacgccctccacgcctgaacgtagttgtacgacctaactttagttacctgtaccaaacagtatacgaggtatacggtcccggttagggaccgttccgggacccgtagggacctaagggtacggaaactcgaacggacgtaacgg

SEQ ID NO: 36733 - DNA, 595 bp, Homo sapiens
  misc_feature: GYAE6OF02HNBA2.37.23.C01.1.454.CMB.1.raw
  modified_base (241)..(241): a, c, t, g, unknown or other
  misc_feature (241)..(241): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccattcaccatctccagagacaactccaaagngctctctgtttctgcatatggacagcctgagagccgacgacgcggctctatattactgtgcgagatgggacggcggtggctgggtgacgtcgggtcgacttcttacgacttactatcgcttcagttcggacgtcgtggggacgaaacgggaccgacggtcgaccgtcctccctcccgtccctcccgaacccgaacgggcccacgtccggttcccttccccgtcggccctacccctccctaccaacgacgcctacccgtccgtcggggaccaaccgacgcccggcccgtcgggccgtcggcccgtggaccgaacggtacctaccttaccgacttacctaacctacctacgtacgg

SEQ ID NO: 36734 - DNA, 654 bp, Homo sapiens
  misc_feature: GYAE6OF02H4NQS.37.23.C01.1.454.CMB.1.raw
  modified_base (160)..(160): a, c, t, g, unknown or other
  misc_feature (160)..(160): n is a, c, g, or t
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattcngatgacccagtctccatcctcctgtctgcatctgtagagacngatcaccatcgcttgccggnagtcaggacatccgctaattttgtagcctggtatcagcagagacccgagggactaacgttccacaacttcttagacttctatgtatgcacttctcgtagtttggacgtccgaggggttactctattccgttacggttccgaaggttggccgaagggtcggtaacgttccggtcggggtacccgtttcgtttcccgaacttcctacctaccacttaccgaaccctacgtccccttaccgaccgtccgtagtaacggtaagttcggttagtaaccctttaaactttaacgtttaccgttagtacctaaacgttaagttacgtacgtaggtacctttccgggtcccggttacgggttacccggttaccgggaccccggtaacgggtaaccggtaagggtaaccggtaacgtaccggaacggtaacggttaaccgg

SEQ ID NO: 36735 - DNA, 515 bp, Homo sapiens
  misc_feature: GYAE6OF02GQDEE.37.23.C01.1.454.CMB.1.raw
  modified_base (506)..(515): a, c, t, g, unknown or other
  misc_feature (506)..(515): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttatactgtagaaaaggccactatggagtcgtggggccgagggaccacggtcaccgtctcctcagccctccaccaacgggcccagtccggtcttccccctggccgccctcgctcccaggacgccaccgtccgagacgcacagcgcccgtgggctgcctggtcaaggtctacttccatcctacactactgacggcggcgtggcgaaggcgcagtagnnnnnnnnnn

SEQ ID NO: 36736 - DNA, 810 bp, Homo sapiens
  misc_feature: GYAE6OF02J240O.37.23.C01.1.454.CMB.1.raw
  modified_base (151)..(151): a, c, t, g, unknown or other
  misc_feature (151)..(151): n is a, c, g, or t
  modified_base (160)..(160): a, c, t, g, unknown or other
  misc_feature (160)..(160): n is a, c, g, or t
tcagtagtgtagatcacgaccggtgctcgatttagtacacgtgattagggagttgggggcagaagtctctctcagtcaggacacagcagtggacatgagggtccctgctcagctcctggactcctgctgctctggctccaggtagcgggtntgacattcngatgacccagtcctccatcctcctgtctagcatctgtagagacagagtccaccatcgcttcggccgggtacgtagtcaaggacctaacgttccggacctaaagtttttgtaaggtcccgttagggttaactaccaagggtaccaacggaacggtaacccgacggggtaactaacgggtttacccgtactaaaaccgttccgtttcgggtaaacttcccgttaagtacgggtaacttcggtacctaacggtttaccttacggtaaagttttccggggtaaaccggtcccggttaaacggggggtttccttaacgggtaacttccggtttaacgggtttccgtacggttacgggcccgtacggtacgggtaacttccgggtacgggggttacccttaccggtttaccctaccgttacccggtaccctaacccgtactaccgtaacccgtccgtacccgttaccgaccgtcccgtaaacggtacgttaaacgttccggttacgtaccctttaaaccgtttacgtaaccgttacgtaccgtaaaccgagttaccgtagtacgggtacttaacccgggtcggtttaccgggacgttacccgggaccggtaacggaacgtaacgggacgttaacgtacgtacggtaccgtaacggg

SEQ ID NO: 36737 - DNA, 524 bp, Homo sapiens
  misc_feature: GYAE6OF02G72US.37.23.C01.1.454.CMB.1.raw
  modified_base (361)..(361): a, c, t, g, unknown or other
  misc_feature (361)..(361): n is a, c, g, or t
  modified_base (486)..(486): a, c, t, g, unknown or other
  misc_feature (486)..(486): n is a, c, g, or t
  modified_base (517)..(524): a, c, t, g, unknown or other
  misc_feature (517)..(524): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccattcaccatctccagagacaactccaagaactcagtgtatctacacatgaacaaccttagagtcgaggacacggcttgtttaattactgtaagaaaaggcctaactatggagtcgtggggccgagggaccgacggtcgaccgtctcctcngcctaccaccagggcccatccggtccttcccccgtggccgccctgccctcccgacggcgccacctccgagacgcacgacgccggcccgtgggctgcctggcaacggactactcatctacactacngacgcggcgtacgcgaacggcgacatacgannnnnnnn

SEQ ID NO: 36738 - DNA, 677 bp, Homo sapiens
  misc_feature: GYAE6OF02HET0Q.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttggccgggcgagtcaggacagtccgactaattttgtagcctggtatcagcagacgaccgagggactaacgttcctacaacgttcttgacttactatgatgactatctctagttggacgtccgtaaggggttctcgtaacgttccgttacggttacgtacgggttcggacgtacgggtccgggtaagttccggttaccgggggtaacccgttccgtttttaccggaacctttcgtaccctaaccgttactaccgtaaccctaacggtcccctaccgtaccgtcccgtaggaaacgtacgttcggttacgtaccttaaacgttttacttaaccgttcgttaacctaaacgttacgtaacgtacgtacggtaacgtttccggttacccggtacggttacccggttaccggacccgtaagggtaccgtaagggtacggtaaacgtacgacggtaacgtaacgg

SEQ ID NO: 36739 - DNA, 531 bp, Homo sapiens
  misc_feature: GYAE6OF02GVHUZ.37.23.C01.1.454.CMB.1.raw
  modified_base (311)..(311): a, c, t, g, unknown or other
  misc_feature (311)..(311): n is a, c, g, or t
  modified_base (394)..(394): a, c, t, g, unknown or other
  misc_feature (394)..(394): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatccctccctgtctgcatctgttagagacagagtcaccatcgcttgccgggcgagtcaggacatccgcaattttgtagtcctggtatcagcagagaccagggcaagttcctcaactcttgatctatgatgcatctntatttggagccgaggggtctctatcttcggttcagtggcagcgagtcgtgggaccgtctttcactctcaccactccaccgacnccctaccacgcctagaagtatgttgactaacttattacttgtactaactagtactcgagtactcggtcccggtaggtaccggttcggacccggtaacgggaccgtaacgggtaggtaaactacgaggtacgtaacgg

SEQ ID NO: 36740 - DNA, 708 bp, Homo sapiens
  misc_feature: GYAE6OF02FO1E3.37.23.C01.1.454.CMB.1.raw
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcacatcgcttggccgggngagtcaggacatccgntaacttttgtagtcctggtatcagcagagaccgagggacaagttcctacaactcttgatctatgatgcatctctagtttcggacgtccgtagggggttctacgtacgttaccgttccgggtttcgtaacgggttcgggtacgacggtaccgggtaacgttccggtacggggtacccgttccgttttaccgtaacccgttccttaccctaaccctaactacccgtaacccgtaaccgtccccgttaccctaaccggtacccgtacggtaaacgtacgttagttacggtaccgttaaaccgtttagtttacccttacgttaacctaaacgttaacgttaactacgtacgggtacgttacggtaccccgggttacggttacccgggttacccggggtaccccgtaacggggtaaccggttaaacggggttaacgggtaaaacgtaccggtaaccggtaacgtaaccggg

SEQ ID NO: 36741 - DNA, 792 bp, Homo sapiens
  misc_feature: GYAE6OF02IQT66.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctcatcctcctgtctgcatctgtagagacagagtcaccatcgcttgccgggctagcaggacatccgactaatttgtagcctggtatcagcagaacgacacggggactaacgttcctaccaacgtccgttaggactactattgaacttcgacaacttctaaccgtagttttcggaacgtaccgtaacgggggttcctctaacgtttcttccgggttcaacgggttcggctaacgggtcggtaacgttccggtacggggtaccgttcgtttaccgaaccgtttccgttacgaacccctattaacccgaaccgttaaccgccccgtttaccgaacgtacccgttacggtaaacggtacgttggttttaaccggactttaaacccgttttaacgttaccgtttagttaaacccggttaaaaccgtaacgggttacctttaaacggttacccggggtaagtttaaccccggtttcccccgggtacggggtttttaaaccccgggtaccccccgggtttaacccggggaacccgggggttttaaacccggggaaccggggttaaaccgggggttttaaaaacccaacgggggttaacccgggtaaaaaccccggttttaaaccgggg

SEQ ID NO: 36742 - DNA, 802 bp, Homo sapiens
  misc_feature: GYAE6OF02IXN08.37.23.C01.1.454.CMB.1.raw
  modified_base (250)..(250): a, c, t, g, unknown or other
  misc_feature (250)..(250): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctccaggtaggcgggtgtgacattctgatgacccagtctccatcctccctgtctgctatctgttagagtacagacgtcacctatcgtcttcggccgggcgagtcaggacactccgntaattttgacgtcctggtatcagcgaagtacgaccgagggctaacgttccgtacaacttcgttaggtacttacttagtgtatcgtactattccttacgtacgtttcggggaacgtccggttaacgggggttcctacgttacgttaccgtttacggggtaccgtaaggggttacggaccggtacggtaccggggtaaccggtttcccggttaccgggggtaccctttcccggtttacctaacccggttcctaccctaacccgtaacctaccccggaaacctaccgttccccgtacccgtaccggtaacccgtttaggaaacgttaccggttaggtttaccggttaacttttaaccgtttaaacttttaaccgttaacggttaaccttaaaaccggttaagttaccggttaaccgttagggttaacccgtttccgggttaacccgggttaccgggtttacccgggttaaccggtacccccgggtaaaggggtaaacccgtaaagggggttaacccggtaaaccggttaacggtacccggtaaagggttacccgg

SEQ ID NO: 36743 - DNA, 829 bp, Homo sapiens
  misc_feature: GYAE6OF02HRV23.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctccaggtagcgggtgtgacattctgatgacccagtctccatccctccctgtctgcatctgttagagacagacgtcaccatccgcgttcggcccgggcgtacgtcgaaggaccacgtccgacttaagttttcggtaacgtcccttagggttaactccgagtacgaacggacgacccgaaggggtacctaaacggtttccctactaaccgtttccgttaggtaacttaccgttaagttggtaaccgtttggacccttaactttacccgttacgtttaacggttttacggggaaaccggtcccgggtaacgggggtttcccttaacgtaccgttccggttttaccgggttacgtaacgggttcgggactaacgggtaccgggtacgttacccgggtcggggttaaccccttacgtttacccgtaccgttaccttacctaacccgtactaaccccgaaccgtaccgtaccccttaccgtaaccgtcccgtaaggaacgttaacgtttacggttaccgtaacttaaacgttttaaccttacgttaaccgttaacctaaagtacgttaacgtagtacgggttaccgtttaccgggttcccggttaacgggttacccgggtacccggtaacccggtaacggggtaacccggtaaaggggttaaccggaaacggttaccggtacggtaaccggttaaccggg

SEQ ID NO: 36744 - DNA, 554 bp, Homo sapiens
  misc_feature: GYAE6OF02GLSJ2.37.23.C01.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (429)..(429): a, c, t, g, unknown or other
  misc_feature (429)..(429): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaaccatccgcttgccgggngagtcaggacatccgctaattttgagtccgtggtatcagcagagacgagggctaagtcctacactcttgatctangatgactactctatagttggacgtccgagggttctcgtatcgtcgttcaggtcgcgagcgtatcggtcggaccgtctttcaccttcgtacacctatccaccaacgcctcacgctagactatcgtanacgtacttattctagtactaactagtacacgtagtacgtcggttaccggtacggtccggttacccggaccggtaaccgggtaacggtaacgggtaccgtaaacgtacgaccgtaagggtaaccgg

SEQ ID NO: 36745 - DNA, 830 bp, Homo sapiens
  misc_feature: GYAE6OF02JS2IX.37.23.C01.1.454.CMB.1.raw
  modified_base (186)..(186): a, c, t, g, unknown or other
  misc_feature (186)..(186): n is a, c, g, or t
tcagtagtgtagatcacgaccggtgctcgatttagtacacgtgattagggattggggcgagaagtctctctcagtcaggacacagcatggacatgacgggtccctgctcagctcctgggactcctgctgctctggcctcccaggtacgcgggtgtcggactagttctcggatcggacccagttccnccacttccctccttgtacctggacacgttcctaggtttagaacgacctacggtactaccacccgaagtttccgcctttcgggccccggggacgtacggttccgaaacggaccgtacgttacccgtaccgtaacgttttacgtacgttcccgttacggttacgttccgtaacggaccaaggaccgtaaccgggaacgggtaccgttaaccggttacccgttaaccgtaacccgtttacgttacgtaacgttaccgtttaacgtacgtacgttacgtacgtacttaccgtttacgtacgttacggttacggtaccgtacggggtttaccctacggttaacttccggttaccgtttcgtacggttaccggtacgtacggtaccggttacgtaccggtccggtaccccggttaccgtttcccgtacgttaccgtccgtaacccgtcgtacccgtacctaccgtacccgtctaccgtcgtagaccgttactccgttaactccgtaacgtttcttaccgtacttaccgtaacgtacgttacgtaacgtacggtacctcgggtttacccgggttacggttacgtaccccggttacgggtacccggttaacgtacgggttaaccgtaacggtacgtacggacggttaaccgg

SEQ ID NO: 36746 - DNA, 680 bp, Homo sapiens
  misc_feature: GYAE6OF02HRTVC.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctcctgtctgcatctgttagagacagagtcaccatcgcttgccgggcgagtcaaggacatccgactaattttgagtcctggtatcagacagagaccgagggactaacgttccactaactcttagatctatgatcgcatctactagtttggacgtccgtaggggtctacgacgttccgttacggtacgtaaggtcggacgtacggtccggtaagttccggtacggggtaaccccgttcgttttaccaccgtttccgtacctaccctaactaccgaaccctacggaccccttacccacgtaccgtaaggaaacgttgttacgttacggtaaccctaaacgttttacgttaaccgttacgttaaccgtaaactaacggttaactaacgggtaggttaacgttccgggttacccggtacgggttacccggttacccgggacccggtaacggggaaccgtaaacggggttaggaaacccgttaaccggacggtaaaccgttaacggg

SEQ ID NO: 36747 - DNA, 806 bp, Homo sapiens
  misc_feature: GYAE6OF02I8RR0.37.23.C01.1.454.CMB.1.raw
  modified_base (213)..(213): a, c, t, g, unknown or other
  misc_feature (213)..(213): n is a, c, g, or t
tcagtagtgtagatcacgaccggtgctcgatttagtacacgtgattagggagttgggggcagaaacgtctctctcagtcaggaccacagcatggacatgagggtccctgctcagctcctgggactcctgctgctcgtggcctcccaggttagcgggtgtggaactattctgatcgaccagtctccatcctcctgtctgcatctagtagagacngtacgtcactaagtccgtcgttcggccggggtaccgacgtccgaacggacctactacccggtattaagttttcggtacgtacccgttaggttaacgtccgaacgccgaagtaaccggaaccccggaagggtacctaacggttcctaaccgtaaccttacggtttgtaacttacgttaaggtcgtaacgtcgtcctaacttccgtacttaacgttacggaccggtccggtaacggggttcttacgacgtttccgttaccgggtttaacgtacggttcggacgtagggtacggttacgttccgggtaaccgggtacccgtttaccttccggtaacttcccctaactacccgtaccttaaccggaaccctaccggtccctaaccggaacgcccttaaagggtaaggttacgttacggttaaaccgtaacctttaaacgtttaacggttccctaaacgttaaaccctaaacgtaacgttacgtaacgtacggttacctttcccgggtacccggttaccgggtaacccggttacccgggacccgtaaagggaacccggtacggtaacggtaacgtaaccggtacggtaacggtaccgg

SEQ ID NO: 36748 - DNA, 609 bp, Homo sapiens
  misc_feature: GYAE6OF02GZHEJ.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacatttctgatgacccagtctccatcctccctgtctgctatctgttagagacagagtcaccatcgcttggccgggcgagtcaggacactcccgactaattttgacgccttggtatcagcagacgaccgagggctaacgttcctactaacttcttgacttctatgtatcgactatctacgtagtttggacgtcgacgggttactcgtacttcgtcggttcaggtcggcgaggtcggacgttccggtacgggtacccgttcgtttaccacttcctacctacctactaccacccgtacgtacccctccgacgtccgtacggtaatcgttagttcgtactaactttactactacgtaacgaatacgtacacgtagtactccggttccggtacggtaccggttcccggaccgtaacggggaaccgtacgggtaacggtaacgtacgtaacggtacgtacgg

SEQ ID NO: 36749 - DNA, 624 bp, Homo sapiens
  misc_feature: GYAE6OF02HYA3I.37.23.C01.1.454.CMB.1.raw
  modified_base (124)..(124): a, c, t, g, unknown or other
  misc_feature (124)..(124): n is a, c, g, or t
  modified_base (166)..(166): a, c, t, g, unknown or other
  misc_feature (166)..(166): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (323)..(323): a, c, t, g, unknown or other
  misc_feature (323)..(323): n is a, c, g, or t
  modified_base (491)..(491): a, c, t, g, unknown or other
  misc_feature (491)..(491): n is a, c, g, or t
  modified_base (612)..(612): a, c, t, g, unknown or other
  misc_feature (612)..(612): n is a, c, g, or t
  modified_base (617)..(617): a, c, t, g, unknown or other
  misc_feature (617)..(617): n is a, c, g, or t
  modified_base (620)..(623): a, c, t, g, unknown or other
  misc_feature (620)..(623): n is a, c, g, or t
tcagtagtgtagatcacgaccggtgctcgatttagtacacgtgattagggattgggggtccctggagactctcctgcatagactcatacttgagtatgattcattcttcagtgggctgggcccnccaggctccaggggaagggctgggagtggggtcggccaaacntagccggaagcgatgggaagtgagaagaaattanggtcgactctgngaagggccattccgacatcctcaagnactaanccgaaagacctnagttcgtatctanacaatnaactaactagagtcgaggaccgtagctagtttatacttagtagaaaancgaactatagagtcgtagggacgtaaggtaccgacggtacctacggtaccgtcctacgtaccaccgttcccaaccgaaccgggacccgaccgttaaccggtcccttaccccgttcgggcctaccccgttgccgttacccgacggacgacgtcccgttaccgcggaccncgacgacgacccggcggtaccgggcctccgggctccggtccgaaggtacctaacgtcctacgtacctacctaacgaacctcggaagccgggtacgtcggacgtaggccgtacactaggacngtcgnagnnnnc

SEQ ID NO: 36750 - DNA, 594 bp, Homo sapiens
  misc_feature: GYAE6OF02JEJ9B.37.23.C01.1.454.CMB.1.raw
  modified_base (229)..(229): a, c, t, g, unknown or other
  misc_feature (229)..(229): n is a, c, g, or t
  modified_base (405)..(405): a, c, t, g, unknown or other
  misc_feature (405)..(405): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (590)..(594): a, c, t, g, unknown or other
  misc_feature (590)..(594): n is a, c, g, or t
tcagtagtgtagatcacgaccggtgctcgatttagtacacgtgattagggattggggggggtccctgagactctcctgcatagactcatacttgagtatgagttcattcttcatgggctgggcccgccaggctccaggggaaggggctggagtgggtggccaacatagcgagcgatggaagtgagagaaattatgtggactctgtgaagggccgattcaccatctccanagacaactccaagaactcagtgtatctacacatgaacaaccttagagtcgaggacacggctgtttatactgtaagaaaggccaactatggagtcgtggggccggagggaccacggtcaccggtctccctcacgccctaccaccgaaacggccccagttccggtccctttcccccgnggtcccgtccctcgccgttccgaggacgccacccgtccgagacgcaccgacgcccggccgtcgggcctcggtccgttacggccgtaacgggaccttaccgttacccgtagttacctaacctacttacgtacggaacgccggggtcttcgggacgaaccgggtcgacctaacgtacgncgancgannnnn

SEQ ID NO: 36751 - DNA, 625 bp, Homo sapiens
  misc_feature: GYAE6OF02GLD0S.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggtctcccaggtagcgggtgtgacattctgatgacccagtctccatcctcctgtctgcatctgttagagacagagtcaccatcgcttgccgggcagtcaggacatccgctaatttgtagcctggtatcagcagagaccgaggcaagttcctcaactcttgatctatgatgctatctctatttggacgtccgaaggggtctacgattcgtcggttcaaggtcggacacggcggtattcggtcgggtaccgtcttttccaccttccgtaccacctactaccaccacgtccctccgaacgtcccgtagtaacgtattacggttacgacgttaacgttttacgttaacgtttcgtaacctaaacgtagttaacgtacgtacggttacgtccggttacccgggtacgggttacccggtttaccgggaccccggtaacggggtaaccgtaacggggttaacggtaaaccggttaccggtaacggtaacccgtaaccggg

SEQ ID NO: 36752 - DNA, 573 bp, Homo sapiens
  misc_feature: GYAE6OF02F2OK8.37.23.C01.1.454.CMB.1.raw
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (565)..(565): a, c, t, g, unknown or other
  misc_feature (565)..(565): n is a, c, g, or t
  modified_base (569)..(569): a, c, t, g, unknown or other
  misc_feature (569)..(569): n is a, c, g, or t
  modified_base (571)..(573): a, c, t, g, unknown or other
  misc_feature (571)..(573): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccagggaaggggctggagtgggtggccaacatagcgagcgatgggaagtgagagaaattatgtggactctgtgaagggccattcaccatctcagagacaactccaagaactcagtgtatctacacatgaacaaccttagagtcgagacacggctgtttattactgtagaaaaggccatatggagtcgtggggccgagggaccacggtcaccgtctcctcacgcctccaccaacgggcccacgtcggtccttcccccgtggcccgtccccgtgcctccacggcgccaccgtccgagacgccacgacggccggcccgtgggcctggtcccgtaggtccgaaacgggtaccttaccgttccacttcctaacctaccgttacgtacgacgggccgggtccgtagggaccgaacgggccgctaacggtacgngncgancgancnnn

SEQ ID NO: 36753 - DNA, 615 bp, Homo sapiens
  misc_feature: GYAE6OF02IE8WF.37.23.C01.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (385)..(385): a, c, t, g, unknown or other
  misc_feature (385)..(385): n is a, c, g, or t
  modified_base (429)..(429): a, c, t, g, unknown or other
  misc_feature (429)..(429): n is a, c, g, or t
  modified_base (480)..(480): a, c, t, g, unknown or other
  misc_feature (480)..(480): n is a, c, g, or t
  modified_base (604)..(604): a, c, t, g, unknown or other
  misc_feature (604)..(604): n is a, c, g, or t
  modified_base (609)..(609): a, c, t, g, unknown or other
  misc_feature (609)..(609): n is a, c, g, or t
  modified_base (611)..(615): a, c, t, g, unknown or other
  misc_feature (611)..(615): n is a, c, g, or t
tcagtagtgtagatcacgaccggtgctcgatttagtacacgtgattagggattggggggggtccctgagactatcctgcatagactcatacttgagtatgagttcattcttcatgggctgggcccgcaggctccgaggggaagggctggagtgggtggccaacatagcgagcgatggaagtgaagagtaaaattgngtggactctggngaagggcctatcacatcncaganactaacgccaaagaactcagtgtaactcaacacatagaacaaaccgttagaacgtcgaaggaccaaggcttagtttaattactagttaaggaaaaagccaagttatggtaagtcgtaggtgaccggagggaccaacggtccaacgtctaccctnagccctacaaccgaaagggccccaatcgggtccctttcccccgngggcccgtccgtcggtactaccggagtaaccgcggaacctaccggacgaanaccgacgtacgacggccccgtggccgacgccgttacggacgaaacgggtaactaacccttacctaacgtactaaccaacctacgtaacaggcggtacgcggacgaacggacgacttacgaacgntaganannnnn

SEQ ID NO: 36754 - DNA, 628 bp, Homo sapiens
  misc_feature: GYAE6OF02GJMMY.37.23.C01.1.454.CMB.1.raw
  modified_base (612)..(612): a, c, t, g, unknown or other
  misc_feature (612)..(612): n is a, c, g, or t
  modified_base (616)..(616): a, c, t, g, unknown or other
  misc_feature (616)..(616): n is a, c, g, or t
  modified_base (622)..(622): a, c, t, g, unknown or other
  misc_feature (622)..(622): n is a, c, g, or t
  modified_base (626)..(628): a, c, t, g, unknown or other
  misc_feature (626)..(628): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccaggggaaggggctgggagtgggtggccaacatagcgagcgatggaagtgagagaaattatgtggactctgtgaagggccgattcaccatcctccagagacaactccaagaactcagtgtatctacacatgaacaaccttagagtcggaggacacggcttgtttattactgtaagaaaaggccaactatggagtcgtggggccgagggaccacgggtcaccgtctccctcgacgccctaccaaccgaacgggccctaagtccggttcccttcccccgtgggccccgtccccgtcgcccgttaccgacgggaacgccgaacccgtcccggaagtaccgaccaaccgacgggcccggcccgtaggggcctccgggtaccgtcgggtaaccggaacggtaccttaaccgtttcccaataccgtaacctacctaacgtgtacggccgggtaccgtgggaaccgagggccgacaacgtgaccgnacgntaccgntcgnnn

SEQ ID NO: 36755 - DNA, 739 bp, Homo sapiens
  misc_feature: GYAE6OF02JJDF4.37.23.C01.1.454.CMB.1.raw
  modified_base (245)..(245): a, c, t, g, unknown or other
  misc_feature (245)..(245): n is a, c, g, or t
  modified_base (543)..(543): a, c, t, g, unknown or other
  misc_feature (543)..(543): n is a, c, g, or t
  modified_base (729)..(729): a, c, t, g, unknown or other
  misc_feature (729)..(729): n is a, c, g, or t
  modified_base (732)..(734): a, c, t, g, unknown or other
  misc_feature (732)..(734): n is a, c, g, or t
  modified_base (736)..(739): a, c, t, g, unknown or other
  misc_feature (736)..(739): n is a, c, g, or t
tcagtagtgtagatcacgaccggtgctcgatttagtacacgtgattagggattggggggggtccctgagactctcctgcatagactcatacttgagtatgagttcattcttcatgggcgtcgggcccgccaggctccgaggggaaggggctggagtgggtggccaacagtagcgaggcgagtgggaagtgaagaagaaattatggtcggacttcgtggtaggaaggggcctattccaccattccnccgaagacgtaaccaactacccaaagacctcgagtcgtaatcctaacactatacgaaacctaaccttaggacgtccggaaggccgaacggtccgtttagttttaacgttaccgttgtaaaacggaaaaggtaccctaacgttagtacggggtaacttcgggttaccggggggaaccgaacggggtacccccgtacgggttaccctacccggttacccttaccgtaccggaaccgcccccttaaccccgaaacgaacccgggggccctaacggtcccgtttcccccgttaccccccggngggcccctccccgtagtcccgtaccggtaccggacgtaccccgaccgtaccggaccgtacgaacccaccggaacggcccggtcccgtggccgtcggtaccgtcggaccgtaacggcctaccgttacccactaccgtacctaccttacgaggcggtccgggcgtcgacgacggccgagacgtagccngcnnngnnnn

SEQ ID NO: 36756 - DNA, 720 bp, Homo sapiens
  misc_feature: GYAE6OF02JVMA3.37.23.C01.1.454.CMB.1.raw
  modified_base (164)..(164): a, c, t, g, unknown or other
  misc_feature (164)..(164): n is a, c, g, or t
  modified_base (190)..(190): a, c, t, g, unknown or other
  misc_feature (190)..(190): n is a, c, g, or t
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (562)..(562): a, c, t, g, unknown or other
  misc_feature (562)..(562): n is a, c, g, or t
tcagtagtgtagatcacgaccggtgctcgatttagtacacgtgattagggagttgggggcagaagtctctctcagtcaggacacagcatggacatgagggtccctgctcagctcctgggactcctgctgctctggctcccagggtagcgggtgtagacatttcngatcgaccctgtctccatccctcccngttctgactatcgttggtanacgacagngtccaaccngtccgngttcggcccggggtagaagtccaaacgggactacgtcccgattaagttttcggtaacgtccgttgggtactccgtaagccgtaaggacgaacccggtagggtacctaacggtttacccacgtaacctttcgttacgactttacctagtagtacgtcgaccttacttactaccgttagtttacgggaccgtccggtagggtactacctagttacggttcgtcgaacgggttcggaaccgtgtacggtcgtacgtcgggttaaccgtctttcccggtactaccgtacctaccaccttaccgacctccgtacccgttcaccggtaccgttanaaccggtgttacgttacgtactttaacgttacttaaccgttactcgtaaactagtacgtaaccggtcgttacgtcccggttacggaacgggtttccgtaacccgggaccggttaaccgggacgtagggtaacgtaaccggacgtacggtacgtaacgg

SEQ ID NO: 36757 - DNA, 593 bp, Homo sapiens
  misc_feature: GYAE6OF02HOXPR.37.23.C01.1.454.CMB.1.raw
  modified_base (575)..(575): a, c, t, g, unknown or other
  misc_feature (575)..(575): n is a, c, g, or t
  modified_base (585)..(585): a, c, t, g, unknown or other
  misc_feature (585)..(585): n is a, c, g, or t
tcagtagtgtagatcacgaccggtgctcgatttagtacacgtgattagggattggggggtccctgagactctcctgcatagactcatacttgagtatgagttcattcttcatgggctgggcccgcaggctccagggaagggctggagtggtggccaacatagcgagcgatggaagtgagagaaattatgtgactctgtgaagggccattcacatctcagacgacaactcaagactcagtgtatctacacatcgaaacaaccttagacgtacgaggacacggtcttagttttaattactgtaagaaaacggccaactagtggaagttcgcgggggaccgacgggaccacggtcctaccgtcctccctacacgtccctaccgaacccgaacggggcccctagtcccgttacccttcccccgtcggcccgtcccgtcgtcctccgacggacgaccaccctccggacgacgcaacgacgccggcccgtcggctcgccgtcgtacgacggtacctacgtccactcctactactacgtacgacgccgggtctacgggacgaacgggccgacgtacgtagcngtcacgctancgtcatcg

SEQ ID NO: 36758 - DNA, 664 bp, Homo sapiens
  misc_feature: GYAE6OF02HK2MN.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtccaccatcgcgttgccgggcgagtcgaggacatccgctaattttggtagccttggtatctagcagacgaaccgagggctaacggttcctacgtaaactctttgacttacgtatcgtatgctatctcattttggacgtccgaggggttctcaacgttcgtacggtttcgtaggttcggacacggcggtacgttcgtcggggtacccgttctttacccgtacgttcctacctaaccctactacctaacccgacgtcccctacccgtaccggccttacggaacgttacgtcggtttaacgtacctaaaccgtttaactttaccttacgtaacctaaacgtacgttaataccgtagttacgttccggttacccggttgggttacccgggttaccgtaccccgggtaacggtaacccggtaaacgggtaacggtaaacgtacgaacggtaccggtaaccgg

SEQ ID NO: 36759 - DNA, 740 bp, Homo sapiens
  misc_feature: GYAE6OF02JXVOK.37.23.C01.1.454.CMB.1.raw
  modified_base (255)..(255): a, c, t, g, unknown or other
  misc_feature (255)..(255): n is a, c, g, or t
  modified_base (371)..(371): a, c, t, g, unknown or other
  misc_feature (371)..(371): n is a, c, g, or t
  modified_base (731)..(731): a, c, t, g, unknown or other
  misc_feature (731)..(731): n is a, c, g, or t
  modified_base (734)..(734): a, c, t, g, unknown or other
  misc_feature (734)..(734): n is a, c, g, or t
  modified_base (737)..(737): a, c, t, g, unknown or other
  misc_feature (737)..(737): n is a, c, g, or t
  modified_base (739)..(739): a, c, t, g, unknown or other
  misc_feature (739)..(739): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccgaggggaaggggctgggaggtgggtggccaacatagcgagcgatggaagtgagagaaattatgtggactcgtgtgaagggccattcacatctccagagacaactccaagaactcagtgtanctacacatcgaactaaccttagagtcgaggacacggctgtttatactagtaagaaacgctactagtggactcgtacggggccgacgggtaccacggtccgaccgtcctcctaccgngtcccctaccgaccgaaccggggtcccaacgttcccgggttaccccgtttaccccccggtggtaccccggtcccctacggtcccgtacccggtaacgggtacccgacccgtaaccccggtcccggaaaccggtacccgaaccggaccccgtaaccgggccccgggtaaccccgggttccggggttacccggtcccgggtcccggttaccgggttaaccggtaaacgggacccgtttaacccttacccggtaaccttaaccgtttaccccgtaaacgtttacccgtacggtaacgggtacccgggtaccgttaaccgggaccggtaacggggccggaaccgtaggttacggactaggcacncgngcnanc

SEQ ID NO: 36760 - DNA, 598 bp, Homo sapiens
  misc_feature: GYAE6OF02HO2OF.37.23.C01.1.454.CMB.1.raw
  modified_base (378)..(378): a, c, t, g, unknown or other
  misc_feature (378)..(378): n is a, c, g, or t
  modified_base (587)..(587): a, c, t, g, unknown or other
  misc_feature (587)..(587): n is a, c, g, or t
  modified_base (592)..(592): a, c, t, g, unknown or other
  misc_feature (592)..(592): n is a, c, g, or t
  modified_base (594)..(598): a, c, t, g, unknown or other
  misc_feature (594)..(598): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccaggggaaggggctggagtgggtggccaacatagcgagcgatggaagtgagagaaattatgtggactctgtgaagggccgattccaccatcctccagagacaactccaagactcagtgtatctacacatacgaactaaccttagacgtacgaggacacggcttagtttacttacgtagtaagaaaacggccaactagtggacgtcgtcggggccggacgggaccgacggtcaccggtctccctcncgccctccgaacccgaacgggcccctagttccggtcccttcccccgtgggccgtcccctgccctccgacggacgccctaccgtccggagacgaccacgacggccggtcccgtgggcctcgccgtacggtacgaacggtacctaccttccactcctaactaccgtacgtcggaggtccggtcgtacgggacgaacgggccgacagtagantacgncnnnnn

SEQ ID NO: 36761 - DNA, 749 bp, Homo sapiens
  misc_feature: GYAE6OF02IVHUU.37.23.C01.1.454.CMB.1.raw
  modified_base (150)..(150): a, c, t, g, unknown or other
  misc_feature (150)..(150): n is a, c, g, or t
  modified_base (236)..(236): a, c, t, g, unknown or other
  misc_feature (236)..(236): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtgcgggtntgacattctgatcgacccagtctccactcctcctgtctgctatcgtgttacgagacagtagtccacctatcgcgttggcccgggtnacgttcgaggtacacgtccgacttaagttttgacgtaccgttggttaactcgaggtacgaacggacgaaccgaggggtactaacgttccctaccgtaaacttcgtagtacttacgtagtacgtattcgactacttcgtacttaaggttcggacggtaccgtaggggttcctacgtacgtttccggtcggttacgaggttcgacggtcggtacggtacgttacggtaccgggtaccgttacctttaccgtacgttccctaccgtaacctacgtaccctaacccggtctaccccgtacccgtacgtcccgtaaggtaaccgttacggttacgtttaacggaacctttaaaccgtttaacctttaccgttaccgttaacctaaacgtaagttaacctcggtacgtacgtttccggtaacccgggttaccgttaccggggtaaccccggtaacccggaacggtaaccgggtaacgggttaaaccgtaacggtaaccgtaaccgggtagttaacccgg

SEQ ID NO: 36762 - DNA, 672 bp, Homo sapiens
  misc_feature: GYAE6OF02I0L7F.37.23.C01.1.454.CMB.1.raw
  modified_base (425)..(425): a, c, t, g, unknown or other
  misc_feature (425)..(425): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggcctcccgaggtaggcgggtgtgacattctagatcgaccctagtcctccactcctcctgtctgcatctgttagagacagacgtcacatcgtcgttggccgggacgacgtacgaggacactaccgtctaattttgtacgtctaggtactcagcagacgaccgacggtactaacgttacctactactcttcgacttctatgactcgacacttctactagttacggcgacggtaggtactctacttcgttcggtacgcgtggcgcgacggtacgtggtaccggtacttccttacnccgttcctacgtaaccacttacccaaccgtacctcccgacctacgtaccgtaagacgttacgttacgttacgaaacctttaacgtttacgttacgttaccttaaacgactttaagtaacgttcggtaacgttcggtttacccggtaccgggttaccggttaacccgggtaccggacccgggtaaagggttaacccggtaagggggtaaacctaaccggtaacggtaacccggttccgttaaacgggg

SEQ ID NO: 36763 - DNA, 570 bp, Homo sapiens
  misc_feature: GYAE6OF02JKLH0.37.23.C01.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (468)..(468): a, c, t, g, unknown or other
  misc_feature (468)..(468): n is a, c, g, or t
tcagtagtgtagatcacgaccggtgctcgatttagtacacgtgattagggattgggggggggtccctgagactctcctgcatagactcatacttgagtatgagttcattcttcatgggctgggcccgcaggctccagggagggctggagtgggtgccaacatagcgagcgagtggaagtgagagaattatggtggactctggtaggaagggccattcaccatcctacaganactataccaagacacctgtactangcaatgacaacctagacgggaagaccgagggaccaacggaccctagtaattactagtacgaaaataggctacggatatagactactattggactaggattcgatcgtctgggcgtggcaccgtcgtacactagtctactcagacctaccaccgaacggacccgtactacgtcgttcccctaggcgacctcgcgtaccacggacgcacctacgnacgcacagcgccgtcggacgtcgaccgtcggtacaacggtaccgtctaccacgtaaccttacgacctacgtacggacggacgggaccgtacggacgaacggg

SEQ ID NO: 36764 - DNA, 573 bp, Homo sapiens
  misc_feature: GYAE6OF02FQMQU.37.23.C01.1.454.CMB.1.raw
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (276)..(276): a, c, t, g, unknown or other
  misc_feature (276)..(276): n is a, c, g, or t
  modified_base (359)..(359): a, c, t, g, unknown or other
  misc_feature (359)..(359): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (563)..(563): a, c, t, g, unknown or other
  misc_feature (563)..(563): n is a, c, g, or t
  modified_base (566)..(573): a, c, t, g, unknown or other
  misc_feature (566)..(573): n is a, c, g, or t
tcagtagtgtagatcacgaccggtgctcgatttagtacacgtgattagggattgggggggtccctgagactctcctgcatagactcatacttgagtatgagttcattcttcatgggctgggcccgccaggctccgaggggaaggggctggagtgggtgccaacatagcgagcgatggaagtgagagaaatttanggtggactctgtgaagggccattcaccatctccagagaccaactccaagaactcagtntatctacacatcgaacaaccttanagtcgagacacggctgtttatactgaagaaaggccaatagtggcgtcgtaggggccgagggaccacggtcaccgtctacctcntccctccgacgaacggccctactccggtcccttcccccgnggcccgccctgccnccgacgganccgaccctcgacgcgccacgcggcccggccgtcggggctcggcccgtggtacgaacgggttacctaccttccgtacttccgtaacacccgttactacggaccggtcgggccgtgggaccgaacgggccgacgaaggtgacncgnnnnnnnn

SEQ ID NO: 36765 - DNA, 724 bp, Homo sapiens
  misc_feature: GYAE6OF02I1J2U.37.23.C01.1.454.CMB.1.raw
  modified_base (161)..(161): a, c, t, g, unknown or other
  misc_feature (161)..(161): n is a, c, g, or t
  modified_base (347)..(347): a, c, t, g, unknown or other
  misc_feature (347)..(347): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggcctcccaggtagcgggtgtgacattcngatgacccagtctccagtccctcctgtctgcatcgtgtagacactagacgtcacctatcgtcgttcggccgggacgtagtccgaggacctagtccgactaagttttggacgtccttggtaatcagcgtaagacgtacgacgggtactaacgttacctactaacttcgtagtacttacgtataggtntacgactatctactagttcgacgtcgtagggtcctacgacgttacgtcggtcgtacggtacgacggtagtccggttacgtaccggttacgggtaccgttacctttcgaaccgttaccgtccctaaccgaaccttccctaaccgtaccgtccccttaccgtacgtcccggttaacgacttacggttccgtttaaggaacctttaaacccgttttcgtaacgttaccgtaagttaaaccttaacggtaacttacgtacgggtttaccttacccgggtttaccgggtaccgttaaccgggttcccggtaacccggtaacgggttaacccggtaacgggtaaccggttaaaccgtacggtaaccggtaacgttaacccggg

SEQ ID NO: 36766 - DNA, 710 bp, Homo sapiens
  misc_feature: GYAE6OF02GOGYB.37.23.C01.1.454.CMB.1.raw
tcagtagtgtagatcacgaccggtgctcgatttagtacacgtgattagggattggggggcagaagtctctctcagtcaggacacagcatggacatgagggtccctgctcagctcctgggactcctgctgctctggctcccaggtagcgggtgtgacattctgatcgacccagtcctccatcctcctgtctgcatctggttagagacagacgtcaccatcgcttcggccgggcgagtcgaggacatccgctaattttgtagcctggtatcgagcaagacgaccgagggactaacgttcctactaacttcttagtactccttagtcgtatcgtctatcgtactagtttggaacgtccgtacggggtactacgtagtccgttcggtctagggtggacgtcggaggacgttcggtcgggacccgttacttccgtactccctaccaaccgtacctacccaacccgtacgtacccctaccggacccgtaccgtaaccgggtaacgttacgttacggtacctaacgtttaaaccgttttaacgttaaccgttaacggtaaacctaaacgttagtaaccgttaccggtacgttaccggttccccgggttaccgggttaccggttacccgggttacccgggaacccgggtaaccgggaaccgggttaacgggttaaccggtaaaaccgtaaaccggttaaccggtaacgtttaaccggg

SEQ ID NO: 36767 - DNA, 654 bp, Homo sapiens
  misc_feature: GYAE6OF02FL7ZI.37.23.C01.1.454.CMB.1.raw
tcagtagtgtagatcacgaccggtgctcgatttagtacacgtgattagggattggggggcagaagtctctctcagtcaggacacagcatggacatgagggtccctgctcagctcctgggactcctgctgctctggctcccaggtaggcgggtgtgactattctgatcggacccagtcctccactccctcccgtgtctgcattcgttgttagagacagacgtccaccatcgcttcgggccggcgtagtcgaggacactccgacttaagttttggtacgtccgtggtaactcgagcgagacgacgaggactaacgtcctacaacttcttagactcttatgtagtcgtctactccttacgttagttacgggacggtccggtaggggttctacgtcttacgttcgggttctaggtcggtcgacggcggtcgtacggtcgggtaccgttcttaccgaccttccactaccctacgtcccaccgtccgtccctacgaccgttacgtaagtaggtacttcggtaacgttacctaaacgttttaacgtaccttgttaaccaaagttacgtagtacgttaaggtccgtccggttaaccggtcgggtacccgttccgggacccgtaacgggtacgaacgggtaacgtacgacgtaccgaggtacg

SEQ ID NO: 36768 - DNA, 855 bp, Homo sapiens
  misc_feature: GYAE6OF02HEQZD.37.23.C01.1.454.CMB.1.raw
  modified_base (151)..(151): a, c, t, g, unknown or other
  misc_feature (151)..(151): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggatcccaggtagcgggtntgacattctgatgacccagtcctccatcctcctgtctgcatctgttagagacagtacgtccaacctatccggcgttcgggcccggggtacgaaggttccgaacgggaacctaacgttccccggtaccgttaaaacgttttttcggttaacggtccccgttaggggttaactaccgtaacggaccgtaacgggaaaccggtaaccccggaagggggtaccgtaaaacgggttttaccctttaaccgtaaaacccgtttcgtttaacggtaactttaccgttaattacggaacgttacggtactaacgttaccttacgttaagtttacggggtaacggtacccgttaacggggggttccttacccgtacgtttaccggttcgggttaccgtacgggttcggacgtacgggcggtaacgtcggtacggggtaccggttcctttacccgtacttaccgttacctacctaccgttaccaaccgtaccgtccccgtacccgacgtacccgtaagaacggttacttccggttactacccgttaaactttaccttaaccgttcgttaaacctaaaccgttaagttaacgtaccgtacgggttaacgttcccggtaccgggttacggttaacccggttccgggtaacccggtaacgggaaccggtaacgggtaaccggttaaacgtaccggtaaacggaccggttaaaccggg

SEQ ID NO: 36769 - DNA, 770 bp, Homo sapiens
  misc_feature: GYAE6OF02HD9HS.37.23.C01.1.454.CMB.1.raw
  modified_base (227)..(227): a, c, t, g, unknown or other
  misc_feature (227)..(227): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctattagagacagagtcaccatcgcttggccgggngagtcgaggacactccgactaattttgtacgtccgtggtatcgagcaagacgacgagggctaacgttccactaactcgttagatctatgtaatcgactactctacgtaggtttacggacggtccggtacgggggttaccttacgtacgttccggttaccgggtttacgtaggggttccgggacgacggggtaccgggtacgttccgggtaccggggtaccccgttccgttttaccctacccgttcctaccccgtaacctaaccgtaccctaaacccgtaccgttacccctacccgaccggtaccgttaacggaaacgttcgttacggtttaccgtaaacccgttttaaacgtttaaccgttttaaccgttacgttaaaccgtaaaaccggttacgtttaacgtacggttaccgggttaacgtttacccgggggtaccccgggttacggggttacccggttaacccgggaccccgggtaaacggggtaacccggttaacgggtaaccgggtaaacgtaccggaaccgggtaacggttaaccggg

SEQ ID NO: 36770 - DNA, 720 bp, Homo sapiens
  misc_feature: GYAE6OF02HCTHU.37.23.C01.1.454.CMB.1.raw
  modified_base (162)..(162): a, c, t, g, unknown or other
  misc_feature (162)..(162): n is a, c, g, or t
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (705)..(705): a, c, t, g, unknown or other
  misc_feature (705)..(705): n is a, c, g, or t
  modified_base (708)..(708): a, c, t, g, unknown or other
  misc_feature (708)..(708): n is a, c, g, or t
  modified_base (717)..(717): a, c, t, g, unknown or other
  misc_feature (717)..(717): n is a, c, g, or t
  modified_base (719)..(719): a, c, t, g, unknown or other
  misc_feature (719)..(719): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccgaggggaagggctggagtgggtggccaanatagcgagcgatggaagtgagagaattntgtgactctgagaggccatcacatcncaganacactcaagactcagtgtatctacacatacgaactaaccgttagagtacgaacggacacggtcttagtttacttacgtaggtaacgaaacgcctaacgtagtggtaacgttcggtacgggggccggaacggggacccgtacggtacctaccggtcctcccgtactaccgccctacccgaaccgaaccggggtaccctacggttcccggttccccgtttccccggacgggccccgtcccgttacggtcccgtacccggaacggtaccgtacccgtaccccgtaccggaacggtaccgaccgtaaccggaccgggtcccgggtaccccggtcgggtacccgttcgggtacccgtacggggtaaccgtaaaccggttaccgttaacccttaccctacgttacccgttaaccctaccgttaccggacggtaaccgggccgggtaacggtcgggaacggtaccgggccggtaacctacggtaacgtcgngcncgacatcgngnc

SEQ ID NO: 36771 - DNA, 633 bp, Homo sapiens
  misc_feature: GYAE6OF02HBH2J.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtcctccatcctccctgtctgcatctgttagagacagagtaccaccatcgcgttcggcccggggcgagtccgaggacactccgactaattttggtacgccttaggtatcagacagacgaccgagggactaacgttcctactaactcttagtactctatgatgctatctactagttcggacgtccggtaggggtctcgtattccgttcggttcgtaggtcggacgacggtacggtagtccggtcgggtacccttcgtttccgtactcctacgaaccctactcccacctacgtccctaccgacgtaccgtaagagtacgttacggttacgaaccttaacgtttaacttacgttaaccttacgtaaactaagtactacgaggttacgtccggttccggtacgggttaccggtaccggaccgtaaccgggaacgtaacggtacgtaacgtacgaacggtacgtaacgg

SEQ ID NO: 36772 - DNA, 667 bp, Homo sapiens
  misc_feature: GYAE6OF02GW9OS.37.23.C01.1.454.CMB.1.raw
  modified_base (201)..(201): a, c, t, g, unknown or other
  misc_feature (201)..(201): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggcctcccaggtagcgggtgtgacattctgatgacccagtctccatcctcctgtctgcatctattaganacagagtcaccagtcgcgttgccgggcgagtccaggacactccgctaattttgtagtcctggtaatcagcagacgaccgagggacaacggttcctactaaccgttcttgattctatcgatgcatctctattggacgccgaggggtctcgtactcgtcggttcgacgtaggcgtaggcggtacgtcggtcgggtaacccgttcgttttaccacgttccgtactaacccgtactacccgtacccacggtcccctaaccgaccgtcctaggaaacgtacttcggtttacggtaactttaaacccgttttactttaaccgttacgttacctaaacgtacgttaacgttaccgtaggttaacgttaccggtccgggttaccgggttacccgggtttacccggaccccggtaacggggttaaccgtaacgggttaaccggtaaacttaacggaaccgttaacgtaaaccggg

SEQ ID NO: 36773 - DNA, 1062 bp, Homo sapiens
  misc_feature: GYAE6OF02HLTYC.37.23.C01.1.454.CMB.1.raw
  modified_base (161)..(161): a, c, t, g, unknown or other
  misc_feature (161)..(161): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgcttcgtgcctacgtaggcggtcggtgtcgactnttcgagtataccgaccgtacgtcctacctaccttccccttccttcgttccgtcgacttacttcggttaacggtaagacgaacgtacggtacctacccgaacctacggttccggttccggttacccggggcccgggtacggtaccggtaccgggaacggtaaccttacccgttaccgttaaccgtttttaaggttttaccggtaccgttacgggtttaccggtactaaccggtaacgacggtaaccgggaaccggaacccggggtacggtaaaccgtttaccccgtttaaccctaaaccgttaccgttttccgttagtaccgtttacttacggtagtacgtacccgttacgtaccgtttacccgttaaggtttaccggggttacggaaccccgggttacggggttaccggtttaccctacgttttaccggttacccgggtttacggtttaccggtagggtacccgggtaacgtaccggggtaccgggtttacgtttacccgggggttaacccgggtttcccctttttaaccccggtacccctttaacccgttacccgttaaaccctccccgttaaaccttcccccgaacccgggtttccccgaaccccgtttacccggaccgttacccggttaaagtaaccgtttcggtttaacccggtttaaactaaacccgttttttaacgtttaacccgtttaacgggttaacccgttaaacccgttaaaggttaaccgtttaccggtaacggttccgggttttaaccggtttccccgggggttacccgggtttaaacccggggttccccggggtaaacccggggtaaccccgggtaaaacgggtttacccggggtaagttaaacccgggtaaaccgtaaccgggttaacccgggttacccgtacgggg

SEQ ID NO: 36774 - DNA, 605 bp, Homo sapiens
  misc_feature: GYAE6OF02HFXE8.37.23.C01.1.454.CMB.1.raw
  modified_base (248)..(248): a, c, t, g, unknown or other
  misc_feature (248)..(248): n is a, c, g, or t
  modified_base (595)..(597): a, c, t, g, unknown or other
  misc_feature (595)..(597): n is a, c, g, or t
  modified_base (600)..(605): a, c, t, g, unknown or other
  misc_feature (600)..(605): n is a, c, g, or t
tcagtagtgtagatcacgaccggtgctcgatttagtacacgtgattagggattggggggtccctgagactctcctgcatagactcatacttgagtatgagttcattcttcatgggctgggcccgccaggctccagggaaggggctggagtgggtggccaacatagcgagcgatggaagtgagagaaattatgtggactctgtgaagggccattcaccatcctccagagacaactccaagaactcagtntatactacacatagaacaacttagagtcgaggacacggtcttgtttaattacgtagtaagaaacgccgtactagtaggacgtcggtggggaccgacgggaccacgggtccaccggtcctcctcacgtccctacgaaccgaacgggccctaacgttcccgggtccctttcccccggtagggcccgtcccctacggtccctcccgacggacgcccgtacccgtacccgagacgacgacgacgccggcccgtcgggctcgtcccgtggaccaacggtacttaccgttacctacgtacctaaccgacttaccgtaggacggtcgggacgtcggacgacgggcacgtagagnnncgnnnnnn

SEQ ID NO: 36775 - DNA, 708 bp, Homo sapiens
  misc_feature: GYAE6OF02F0VYQ.37.23.C01.1.454.CMB.1.raw
  modified_base (213)..(213): a, c, t, g, unknown or other
  misc_feature (213)..(213): n is a, c, g, or t
tcagtagtgtagatcacgaccggtgctcgatttagtacacgtgattagggattgggggcagaagtctctctcagtcaggacacagcataggacatgagggtccctgctcagctcctgggactcctgactgctactggctccaggttagcgggtgtgactattctgatcgaccctagtctccatccctcctgtctgctatctgtagagtacagngtaccactatcgtcttacggccgggtacagtccgaaggactatccgataatttcgacgtccgtggtatccagtcaggtacgaccgtaagggtctaacggttcctacgtaacttcgttagactactagtagtacgtgactatctacgtagtcgacgtcgtagggtctacgtacgtcgtacggtcaacggtcggacgtacggacggtactacggacgggtaccttcgttaccgtaccgttacgtaccaactaacgtcccgaacgtacgtcccttaacgaaccggtactaaacggtaacgttacgttacggttaacctaacgttaaaccgttttacgttaaccgtaacgttaacctaaacggttaaccgttaacgtacgttaacgggttaccgttaaccggttccggggtaacggttacccggttaacccgggtaaccgaaccgggttaaacggtaacgggttaacgtaaaccgtaccgtaacgggtaacgtaaccgg

SEQ ID NO: 36776 - DNA, 707 bp, Homo sapiens
  misc_feature: GYAE6OF02FKXL5.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttggccgggcgagtcaggacatccgctaattttgtacgtcctggtactacaaactagaaaccagggaaacgccccgtaaaggtcctagtactactatacgtatcgccttacctacgtttacgggaaacggtccggggtaccctagtacgtaacggtttcaacggtccgggacgtaggttgtaacgttcgtacggggaacagttaaacgtttacctaccgtccttacaaccctacgttaacgtaacggttaaccacccgttcgaccgtaccggtacccgtaggtacttaggtttacttttaccgacctttaaaccgttttattaacccgttacgtaccgtaataccgtaactttaacgttaaacgttcgggtaaagtaccggttaccgggaacccgggtacgggaaccggtacggggtttacgaacggttaacgtaacgaaaccggttaaggtcgttacgggtaccgttagacccgtaactgtttaacccg

SEQ ID NO: 36777 - DNA, 781 bp, Homo sapiens
  misc_feature: GYAE6OF02FMG62.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagctcctgggactcctgctgctctggctccaggtagcgggtgtgacattctgatcggacccagtcctccatccttccctgtctgcattcgtgttagacgtacagacgtccaccacttccggtcttacgggcccggggtgtaacggtaccgaacggaccatacccggtactaaactttttgtaacgtccgttaggtactacgacgtacgaacggacggaaccgacggggaaccttaacggttaccccttactaaaccggttcgtttacgtagtaaccgttagttacggtagtacgtactaacgttccttacgttaacgtttacgggacggtaccggtaggggttcctacggtccgttcgttacggttacgtacgggttacgcgtaacggtacggtaccggtttacgtaccggggtaaccgttcgttccctaacgttccgtaccctaacccgtacgtaccctaacccgtaccgtccccttacgaccgttacgtaacggtaaccggtacgtttaggtaaccgtacttaaccgtttaacgttaacctcgtaacttaacgtagtaaccttacggacggttaccgtacggttcccggtaagggtcccggtacccgggtaacccgacggaacccgggtaaggttaaaccggaggtaaaccggacggtaccggtaaccggg

SEQ ID NO: 36778 - DNA, 545 bp, Homo sapiens
  misc_feature: GYAE6OF02FSACS.37.23.C01.1.454.CMB.1.raw
  modified_base (264)..(264): a, c, t, g, unknown or other
  misc_feature (264)..(264): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctcccaggtagcgggtgtgacattctgatgacccagtctccatcctccctgtctgcatctgttagagacagagtcaccatcgcttgccgggcgagtcaggacatccgcaattttgtagcctggtatcagnagagaccagggcaagtcctcaactcttgatctatgatgcaatctctattggagccgaggggtctcgtatctcggttctaggtggcagcggatcgtcgggtacgcgtttcaccttctccgaccatcctaaccgacgcctccagtccctagaacgattgtacgtctaactttaattacttcgtacaactagtatcgaggtatccggttcccggtacggtaccggtttccggacccgacgggtaaccgtaaagggtacggtaaactcgaacgtacggtaaccgg

SEQ ID NO: 36779 - DNA, 779 bp, Homo sapiens
  misc_feature: GYAE6OF02IFUN8.37.23.C01.1.454.CMB.1.raw
  modified_base (214)..(214): a, c, t, g, unknown or other
  misc_feature (214)..(214): n is a, c, g, or t
  modified_base (555)..(555): a, c, t, g, unknown or other
  misc_feature (555)..(555): n is a, c, g, or t
  modified_base (764)..(764): a, c, t, g, unknown or other
  misc_feature (764)..(764): n is a, c, g, or t
  modified_base (771)..(771): a, c, t, g, unknown or other
  misc_feature (771)..(771): n is a, c, g, or t
  modified_base (775)..(775): a, c, t, g, unknown or other
  misc_feature (775)..(775): n is a, c, g, or t
tcagtagtgtagatcacgaccggtgctcgatttagtacacgtgattagggattggggggggtccctgagactctcctgcatagactcatacttgatatgagttcattcttcatgggctcgggcccgaccaggctccgaggggaagggctggaggtggggtcgccaacatagcgagcgagtaggaagtcgagagtaaatttagtgtcggaccttntggtaggaacggggcctagttccaacctatttccgtacccgaagacgaaccaaacccttccgaaaagtacctacgaaggttacgtacttacctaacaactagtcggtaaaaaccctaaccgttaggtaacggttaccggaacggtaaccggacggttccgttttaaggtttttaacttaccgttaagggttaaaacggtaaaaaccggtcccgtaaacgtttgtacggggtacgtttccggggtacggggacccgggtaacggaccggtaccggtaccgtacccgtcttaccgccgtacgcccctaaccgaccgacggccctgttcccgtcccttccccgnggcccgtccctgtcccgtacccgaggaccgacccgtaccgtaccggaacgacgtacctacggacccgtcccgggtcccggtaccgggtcccgtaccggtcccgttaccggtacgaacgtaccgttacccttctaccgttctacccacgttactacggacgtccggtcggacggtacggacggtccgaccttaggacgtacgtcagtacngacggtntcgntacg

SEQ ID NO: 36780 - DNA, 713 bp, Homo sapiens
  misc_feature: GYAE6OF02JKPQM.37.23.C01.1.454.CMB.1.raw
  modified_base (161)..(161): a, c, t, g, unknown or other
  misc_feature (161)..(161): n is a, c, g, or t
  modified_base (186)..(186): a, c, t, g, unknown or other
  misc_feature (186)..(186): n is a, c, g, or t
  modified_base (189)..(190): a, c, t, g, unknown or other
  misc_feature (189)..(190): n is a, c, g, or t
  modified_base (200)..(200): a, c, t, g, unknown or other
  misc_feature (200)..(200): n is a, c, g, or t
tcagtagtgtagatcacgaccggtgctcgatttagtacacgtgattagggattgggggcgagaagtctctctcagtcaggacacagcatggacatgagggtccctgctcagctcctgggactcctgctgctctggctcccaggtagcgggtgtgacattcngatcgacccagtcctcatcctcctntcnncatctgttanagacagtacgtccaccatccgcttcggaccgggctacgtcgacggactacgtccgtactaagttttgtacgccgttggtaattaccgagactaaggagaccgagggtaccaacgtttaccgaccgtaaaccttcgtttacgacttaaccgttatacggcttcgacgtaattcctacgtaagtttccggataccggtacgggttcacgtacgtcgttacgtccaggtcgtacgtagcggtacttacgccggtacttccgtttaactcctcgtacctacgccttaccgaccttacgaaccccttcgaacccggttactacgtaaacgtcgtttacggttacctaaccgtaccttttaacggttaccttaacgtttacccggaaaacgttccgttaaacgtcgtaaccgggttaggttacccgtcccgggttaaggttcccgggttaccggtacccgaaccgggttaacggtttaacgggaaccggtttaaatccgggaacgacccggttaaacgg

SEQ ID NO: 36781 - DNA, 739 bp, Homo sapiens
  misc_feature: GYAE6OF02G5KXA.37.23.C01.1.454.CMB.1.raw
  modified_base (164)..(164): a, c, t, g, unknown or other
  misc_feature (164)..(164): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctccgaggtagcgggtgtagactatttcgngtacgtcggaaccctagttcctacccagttccctcccgtgtcctcgctacttcgttggtagacgacgagtacgtccacctagtcgtcttcggccgggtcgtagtacgaggtaccacgtcccgtactaattttgacgtccgttaggtatccgagtccgaagacgaaccggacggtaaccgtacggttaccctataaaccgttcgttaggtaccttagtaacgtgtaagtcggtacctacgttcgttaacttacggtttacggaaccggttcggtaacggggttctacgtactttccggtacgttcgaacggttcgacgcgggtacgtgtcggtacggtacgtcttaccgtctcgtacctacctacgtacccaacgtcccgtacctccgtaccgtacgttaggaacttcggttacgttacctaacgttaactttaaccgttaatccgttaacgtaaacgtcgttaacgtaccgtaggttaaccgttcggttcccgggtaccgggttacccggttccggaaccgggtaaccggtaacggttaggggtaaacctactaacgggtaacgtacgtaccggg

SEQ ID NO: 36782 - DNA, 803 bp, Homo sapiens
  misc_feature: GYAE6OF02G4A5W.37.23.C01.1.454.CMB.1.raw
  modified_base (150)..(150): a, c, t, g, unknown or other
  misc_feature (150)..(150): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggctccaggtagcgggtntgactattctgatcgacccagttcctccattccctcctgtctagcattcgtagttagagaccagacgtccaccattccgcgttcgggcccgggacgacgttccgaaggacctacgtcccgtacttaaagttttcgtaacgtccgttcggtacttccgaaggacaacgggtacgaacccggtaacgggggaccttaaccggtttacccctaccgttaacccgtttacgtttacggtaacttccttaaacgtgtaacgttcgtaccttaactttcccgttagtttaacggttttacggaacggttcccgggttaacggggtttcctaccgtacggtttccgttaaccgggtttcgtacgggtcggaccgtacgggtacgggtacgttacccgggtaccggggttaacccgtttccgtttaccctaccttaccgtccctaaccgtaccgttacccgaaccgttaccgtaccccgtccgtaccgtaccgttacgaaacgtttccggttaggtaccgtaaccgtttaactttaaccttacgttacttacgaacttacgtactacggacgttcgtacccgggtcggtaccgggtaccgtacccggtaccggtaacggacccggttaaggtacctaaacggctaaaccggtcgtaacggg

SEQ ID NO: 36783 - DNA, 792 bp, Homo sapiens
  misc_feature: GYAE6OF02GADCA.37.23.C01.1.454.CMB.1.raw
  modified_base (150)..(150): a, c, t, g, unknown or other
  misc_feature (150)..(150): n is a, c, g, or t
  modified_base (160)..(160): a, c, t, g, unknown or other
  misc_feature (160)..(160): n is a, c, g, or t
  modified_base (405)..(405): a, c, t, g, unknown or other
  misc_feature (405)..(405): n is a, c, g, or t
tcagtagtgtagatcacgaccggtgctcgatttagtacacgtgattagggagttgggggcagaagtctctctcagtcaggacacagcatggacatgaggtccctgctcagctcgtggactcctgctgctctggctccgaggtagcgggtntgactattcngactcgaccctagtcctacacttcccgtcctagtcctcgcgtattcgttaggttaacgaggtaacgaggtaacgtaccacctacgttccggtacgttaccgggacccggggacgtaacgtaccggaacggaccgtaaccgttcccgtaacttaaagtttttccggtaacggtacgttacggtactacgaggaaccggagaacggaccggtaacgggtacctaaccgttaccgtacgtaaccgttnttacgtacgttacctagtacgtagtagtctagtccttagttacggttcggacggttaccgggtacggttcctacgtaccgtttaccgtcggttacgcgggttacgggcctacgggacggtacgttaccgggcggttacccgttcgttccgttacctacgtacccgtaacttccgtacccgtaaactcccggtaccctaccgtacgacggtactaaggttacgttaccgtaactacgtttaccttaacgtcgttaacgaaccgtaaagtaccgtagttcgagtaccggtttcggtaaccgggtttaccggacggttaaccccgggaccggttaaacgggtaccgtaacgggttaaacgacgggtttaacaacccgggttaactacggg

SEQ ID NO: 36784 - DNA, 764 bp, Homo sapiens
  misc_feature: GYAE6OF02ICLXX.37.23.C01.1.454.CMB.1.raw
  modified_base (567)..(567): a, c, t, g, unknown or other
  misc_feature (567)..(567): n is a, c, g, or t
tcagtagtgtagatcacgaccggtgctcgatttagtacacgtgattagggattgggggcagaagtctctctcagtcaggacacagcatggacatgagggtccctgctcagctcctgggactcctgctgctctggcctcccaggtaggcgggtgtgacattctgatcgacccagtctccatcctccctgtctgctatctgttagagacagatacacactcgctggccgggcagtcgaacgacgatccgctaatttgtagcctggatcagcagaacgaccgaggcgtaacgttcctacctaactctacgataccgtatgtatcgctatactactagttagacgtaccgtacggggtcttccgtattaccggttcgtttcgcggtacggaccgtacggtcgggtagttccggtacgggtaccccggttcgtttacctacccgtacttccccgtaactacccgttaccaacccgtaccggtcccccgttacccgtaaccgttcccgtaaagggtaaacctaggttaccgtttcgggttaaccgtaaaaccgttttcttttaaacccggttntttaaaaccgaaccgtttaaacccgttaagttaaccgaaggggtttacccggttaacccgggttaccccgggtttaacccggggttaacccggggttaccccgggttaaccccgggtaacccgggggttaaacccgtaaaagggggtttacccgggttaaataccccggggtaacggttaaaccccgggttaacggg

SEQ ID NO: 36785 - DNA, 753 bp, Homo sapiens
  misc_feature: GYAE6OF02HC1Y9.37.23.C01.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (736)..(737): a, c, t, g, unknown or other
  misc_feature (736)..(737): n is a, c, g, or t
tcagtagtgtagatcacgaccggtgctcgatttagtacacgtgattagggattggggggtccctgagactctcctgcatagactcatacttgagtatgagttcattcttcatggctgggcccgcaggctccagggaagggctggagtgggtgccaacatagcgagcgatggaagtgagagaaattatgtggacctcgtgtgaacggggccgtattcgaccatcctccaganaccaactccaagactcagtntanctacacatcgaactaaccttagagtacgaggacacggtcttgtttattactggtaagaaaacggcccacttaagtcggtaacgtcgtagggggcccggacggggtaacccgtaccgggtaccacccgttcccgtacccttaccgaaccgtccccttaccccgaacccgaaaccgggtcccctaacgtttaccccgggttccccgttttccccccccgttggggacccccgttccccgtacggtccccgtaccccggtacggggaaccgtaccccgtaccccgttacccggaacggtaccggaccgaacccgtaccggcccgggtccccggttacggggtcccttaccggtcccgttccgggtaaccggaaaccggttaaccgttaccccggttttacccaacgtttccctaaccgttaaccgttaccgttacggacggtcccgggccgtttggaccggaacgggtccgacggtactaacggnngtgtacgcagtcatgc

SEQ ID NO: 36786 - DNA, 712 bp, Homo sapiens
  misc_feature: GYAE6OF02F87K1.37.23.C01.1.454.CMB.1.raw
  modified_base (153)..(153): a, c, t, g, unknown or other
  misc_feature (153)..(153): n is a, c, g, or t
tcagtagtgtagatcacgaccggtgctcgatttagtacacgtgatttagggattgggggcagaagtctctctcagtcaggacacagcatggacatgagggtccctgctcagctccgtgggactcctgctgctctgctcccgaggtagcgggtntcgactattctggattcgaaccctagttcctacctactccctccgtgtctcgctactcgttagttacgaagtacagtacgccaactactactacgttccggccgggtaccaggtccggtattagttacgtacgttgggtacggtccgttaggtactacaaacgaacggtaaaaccgaacgggtaaccgtacccggtaacggttcctaggacttacgtagtagacgtcgtccctacgttacggttacggtaacggccgggttaccacgttacgacggttcgacggcgtacgtaggttgtacgtcggtacggactaacgtactactacctctaccgactactcgacggacgtcgtacctcggaccgtacgtacgtaaggttacttacgttacgtaaccgtttaaatttaccgttataccgttacgtaacgtaagttaccttaaccgttaccttaccgtaccgttacgtaccgtacgaacgggtaacgtagggtacgtaaacgtaccggtaaacgtcgttggaacgtcgttacaacccgtatcgttactcgttacttacccg

SEQ ID NO: 36787 - DNA, 681 bp, Homo sapiens
  misc_feature: GYAE6OF02HRT4X.37.23.C01.1.454.CMB.1.raw
  modified_base (216)..(216): a, c, t, g, unknown or other
  misc_feature (216)..(216): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
tcagtagtgtagatcacgaccggtgctcgatttagtacacgtgattagggattgggggcagaagtctctctcagtcaggacacagcatggacatgacgggtccctgctcagctccgtgggactcctgctgctctcggcctccgaggtagcgggtgtgactattctagtactcgaccctagtcctaccactccctcctgtactgcattctgttaganacacgacgtcaccatcgcgttcggccgggatacgtcgagacacgtcgtacttaagtttagtacgcgttaggtntacngcagacgacgaggactacgtccactacctgtacgattactatgacgtcgtactacgtaccttacgtacgttacggacgtaccgggtacgggtacttacggtacgtttccgttaccgttcggtagggtcgtacggacgggtccgttaagtccgggtacgggtccctttacttacgaccttcctacccgacctacgtaccaaccgtcctaccccgactacccgtacgaacgtagttacgttagtaacccttactaacgtttactacgtacttaccgaatagtaactacgtacgtcgtaccgtccggtaccgggttacccggtacccggtacggtaaacccggtacggttaaagggaccgtaaacggtaacgtaccggtaaaggtaccggg

SEQ ID NO: 36788 - DNA, 655 bp, Homo sapiens
  misc_feature: GYAE6OF02GP5BD.37.23.C01.1.454.CMB.1.raw
  modified_base (205)..(205): a, c, t, g, unknown or other
  misc_feature (205)..(205): n is a, c, g, or t
  modified_base (500)..(500): a, c, t, g, unknown or other
  misc_feature (500)..(500): n is a, c, g, or t
  modified_base (507)..(507): a, c, t, g, unknown or other
  misc_feature (507)..(507): n is a, c, g, or t
  modified_base (526)..(526): a, c, t, g, unknown or other
  misc_feature (526)..(526): n is a, c, g, or t
  modified_base (553)..(553): a, c, t, g, unknown or other
  misc_feature (553)..(553): n is a, c, g, or t
tcagtagtgtagatcacgaccggtgctcgatttagtacacgtgattagggattgggggcagaagtctctctcagtcaggacacagcatggacatgagggtccctgctcagctccgtgggactcctgctgctctggcctccagggtagcgggtgtcgactattctagactcgaccctagtcctcctactcctccgtgtcctgactntcgtagtagacgacaggactcacctagttcgcgttcgggaccggcgacgtaccgaggacctacgttccgacgttaattttcggaacgtccgttaggtactacgacgtacgacggaacgaaccggtacggaccgttaacgttccgtaactaccgttacttgtaacgttctaagtacggtagttcacgttactccgttacttacgttacgtacggacggttacgggtactcgtacttcggtacgttacggacggtcgcagggtcgtacgtcgtacgggcttcgtctcgtcacgtacncgctacnctcctcgacgtactacgtntacgttcacgtactaacttacggtacncgttaacacgtactagtacgtagttactaccgggttccgtagggtacccgtccgggaccgtacgggagtaacggtaagttacggaccgtacggacgtacggg

SEQ ID NO: 36789 - DNA, 758 bp, Homo sapiens
  misc_feature: GYAE6OF02IFX0R.37.23.C01.1.454.CMB.1.raw
tcagtagtgtagatcacgaccggtgctcgatttagtacacgtgattagggattgggggcagaagtctctctcagtcaggacacagcatggacatgacgggtcctgctcagctcctgggactcctgctgcttctggcctacccgaggtaggcgggtgtagactattctgatcgaccctagtcctccatccctccctgtctgactagtccgttagttaaggacgacgtagtacgtccacctactcgcgttcgggcggcgacgtcagactacgtaccgattacttttggacgtccttaggtatcgacgtcaacggacgaccggaggtaccgtaaccgttccgtactaaccttcttacgtactctaacgtgtactcgtactacttccgtaagttcgggttacgacgggttaccggtaacgggttcctacgttacttcgtttacggttcgtagggtacgggttacgacggtccgggtttacttaccgggtaccccggttaccggttcccttttacgtaaccgttcctaacccgtaacccttcctaacccgtaccttacccgtaacccgttcccgacgttcccgtaaaaggttccttacgtaaccgttaccgtttaaccttaccgtttaacttaccgtaacgttacctaaacgtaacgtattacccggagttaccggttaccggtccggttaccgggaaccggtccggtacccggaaccggtaaccggtacgggttaacaacggtttaacgacggacgttacgg

SEQ ID NO: 36790 - DNA, 675 bp, Homo sapiens
  misc_feature: GYAE6OF02JHS85.37.23.C01.1.454.CMB.1.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (575)..(575): a, c, t, g, unknown or other
  misc_feature (575)..(575): n is a, c, g, or t
  modified_base (594)..(594): a, c, t, g, unknown or other
  misc_feature (594)..(594): n is a, c, g, or t
  modified_base (636)..(636): a, c, t, g, unknown or other
  misc_feature (636)..(636): n is a, c, g, or t
  modified_base (663)..(663): a, c, t, g, unknown or other
  misc_feature (663)..(663): n is a, c, g, or t
  modified_base (668)..(668): a, c, t, g, unknown or other
  misc_feature (668)..(668): n is a, c, g, or t
tcagtagtgtagatcacgaccggtgctcgatttagtacacgtgattagggattggggggggtccctgagactctcctgcatagactcatacttgagtatgagttcattcgttcatgggctggcccgcaggctccgagggagggctggagtgggtgaccaacagtagcgagcgatggaacgtgacgagtaattatggtgactcgngtagaagggtcctatcaccgattcgccgagacgaaccaataccaaagtaaccttcgagttgtactacgtaaccaatacgacgaaacttaaccttagacgtcggaacgaccgacggtctttagtttacttacctaggttaacgaaaacggcctataaggtgggactacggtcggggtaacgacggaaccgcggtaccnccgtcgtacccnggtacnccgtaccaaccggacggcctacgtccgttacccttcccgcggcctcccttggcccttacgacgaccggtcacccgtaccgtaggacgtccaacgggtacggccggtccgtacggtccgtgacccgttggtaacgacggtaaccctttcgaccctancgttaacccgtacttacgnggtaaccggccgggtaatcggggaacttacggggaccgtaanaacggtacggacgtggacacgtaccgngtacncgtgtac

SEQ ID NO: 36791 - DNA, 781 bp, Homo sapiens
  misc_feature: GYAE6OF02HJ9LM.37.23.C01.1.454.CMB.1.raw
tcagtagtgtagatcacgaccggtgctcgatttagtacacgtgattagggattgggggcagaagtctctctcagtcaggacacagcatggacatgagggtccctgctcagcctccgtgggactcctgctgctctcggcctccaggtggcgggtgtgactattctagactcgaccctagtcctaccacttccctcccgtgttcctcgctactcgtagttagaacgacgtacgtacgtaccacctagttccgtcggttaccggccggggaccgtaggtaccgaacggacctaccgtaccgtactttaagttttacggtacgttaccgtaggtttacaccgtacggactacggaaccggaccggtaacgggtaccgttaaccggtttacctaccctttaacgtttcctaggttacttacggtttacctaggttacgttcgtaacgtacttacgtacgtttaggtacggaccgtacgggtcgttactcgtacgttcggttacggttcgtacgggtacgacgggtacgtaccggtacgtccgggtaccggtttccgttacccgtccgttcctacgttccacccttacaccctacgtccctaccgtacgtacccgtagtacgtacggttacgttacgtaacgtttaccgtttaacgttcgttacggttaacctaccgttaaatgtaacgtggttaccgttcgttaccggttaccggtaccgggttaccgacccgggtaccgtaacgggttacgtaacggaaggttaccgaacggacgtaggtaccgg

SEQ ID NO: 36792 - DNA, 173 bp, Homo sapiens
  misc_feature: GYAE6OF01D2QV4.14.38.D05.1.454.CMB.1.raw
  modified_base (171)..(173): a, c, t, g, unknown or other
  misc_feature (171)..(173): n is a, c, g, or t
tcagcgtctagtaccacgaccggtgctcgatttagtatctgatagttgggtttggggaagaggaagactgacggtccccaggagttcaggtgctgggcacagcggccctgggctgcctggtcaaggactacttccgtactagacgctgagcgggctggcaaggcgcatagnnn

SEQ ID NO: 36793 - DNA, 175 bp, Homo sapiens
  misc_feature: GYAE6OF01CO8EG.14.38.D05.1.454.CMB.1.raw
  modified_base (173)..(175): a, c, t, g, unknown or other
  misc_feature (173)..(175): n is a, c, g, or t
tcagcgtctagtaccacgaccggtgctcgatttagtatctgatagttgggtttgggggaaaaggaagactgacggtcccccaggagttcaggtgctgggcacagcggccctgggctgcctggtcaaggactacttccgtactagacgctgagcgggctggcaaggcgcatagnnn

SEQ ID NO: 36794 - DNA, 173 bp, Homo sapiens
  misc_feature: GYAE6OF01EYWVF.14.38.D05.1.454.CMB.1.raw
  modified_base (172)..(173): a, c, t, g, unknown or other
  misc_feature (172)..(173): n is a, c, g, or t
tcagcgtctagtaccacgaccggtgctcgatttagtatctgatagttgggtttggggaagaggaagactgacggtcccccaggagttcaggtgctgggcacagcggccctgggctgcctggtcaaggactacttccgtactagacgctgagcgggctggcaaggcgcatagnn

SEQ ID NO: 36795 - DNA, 176 bp, Homo sapiens
  misc_feature: GYAE6OF02GWOYO.14.38.D05.1.454.CMB.1.raw
  modified_base (174)..(176): a, c, t, g, unknown or other
  misc_feature (174)..(176): n is a, c, g, or t
tcagcgtctagtaccacgaccggtgctcgatttagtatctgatagttgggtttgggggaagaggaagactgacggtccccccaggagttcaggtgctgggcacagcggccctgggctgcctggtcaaggactacttccgtactagacgctgagcgggctggcaaggcgcatagnnn

SEQ ID NO: 36796 - DNA, 528 bp, Homo sapiens
  misc_feature: GYAE6OF01BVUOM.10.49.E05.1.454.CMB.1.raw
  modified_base (205)..(205): a, c, t, g, unknown or other
  misc_feature (205)..(205): n is a, c, g, or t
  modified_base (401)..(401): a, c, t, g, unknown or other
  misc_feature (401)..(401): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagatgccaccggagcagttgtattgacacagtctccagccaccctgtctttgtctccaggggaaangccaccctctcctgcagggccagtcagagcgttagcaactacttagcctggtaccaacagaaacctggccaggctcccaggctcctcatctatgatgtatccagccgggccacgtcggcgtcccagcccaggttcagtggcaggtgggtctgggacagacttcactctcaccatcagcagcctagagcctgaagtnttttgcgtttatctgtcagcagcgtcgcctacgtcggtcctgtccgtttcccgttcggcccgtgggaacctaaggtcggaatacgtacaaacggtactggtcggctcgaccaccgtcttcgtgttcc

SEQ ID NO: 36797 - DNA, 813 bp, Homo sapiens
  misc_feature: GYAE6OF01CG1I5.10.49.E05.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagatcgccaccggagcagttgtattgacacagtctccagccacctgtctttgctccgaagggaancgccacctctcngcagggccagtcaggagtcgttagactaactacgttagccgtaggtaacccaacgaacgaaaaccgtcgggacccaacgggcccttacccgacggtcccttacctactaactccttaatgattacgtactccgaacggcccgggcctacggtcggccgtacccgacggacccgtaggtttacacgggttcgggaccgtagggttcggggtaccgtggggaacctaagggtaccctttccgtaaccgttcctaccgaacccgtagttacccgaaggtacccaacgtaccccgttaacggaacggtcccgtttaagggtaaacggttttaggttttttaccgggtaacgggtttttttaacttaaccggtttacggtaccgtaaacgggttccgaaacggggtcccggttacggaccccggttacggtcccggggttcccgtttccggggttccccgttttacccccggtttccggggaccccgttaagggggtaacccctaaaagggttcggtaaacgttaacgtaacccgaaaacggttacgttcgggtacgggtaccgtacgtacccgtaaacccgtgtttcccgttggtttaccc

SEQ ID NO: 36798 - DNA, 652 bp, Homo sapiens
  misc_feature: GYAE6OF01BRLKB.10.49.E05.1.454.CMB.1.raw
  modified_base (205)..(205): a, c, t, g, unknown or other
  misc_feature (205)..(205): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagatgccaccggagcagttgtattgacacagtctccagccacctgtctttgtctccgaggggaaancgccaccctctcctgcgagggccagtcagagtcgttagctaactactagcctaggtaaccaaacacgaaacctggacccaggcctacccgacggcctcctcactctatgtatgtactccgacggcccggcctacgtcggccgtcccgagtcccgaaggttcaggtcgggcgtagggttcgggtacgtaggggaacaggtaccttccaccgttcctaccaacctatccgagccacgtacctaggacgtccgttaaggtaacgttgttttacggtacggttttaattaccgtgtacgagtcgaggtcgtcggacctacgtcggtccgttcgttcccggtttccccgtttcgggccccgttacgggaacctaaggtacggtaacgttaacgtaaccgtaaacggtacgttcggtacggtaccgtacgacctacctcttccgttgttaccc

SEQ ID NO: 36799 - DNA, 528 bp, Homo sapiens
  misc_feature: GYAE6OF01D06H1.10.49.E05.1.454.CMB.1.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagatgccaccggagcagttgtattgacacagtctccagccaccctgtctttgctccaggggaaangccaccctctcctgcagggccagtcagagcgttagcaactacttagcctggtaccaacagaaacctggccaggctcccaggcctcctcatctatgatgtatccagccggccactcggccgtcccagccaggttcagtggcaggtgggtctgggacagtacttcactctcaccatcagcagcctagacgctagaagtnttttgacgttttatacgtgtcagcaggcgtgccacgtggtcctgtccgtttcccttcggcccgtagggaccaaaggtcggaatactaccgaaacgtactggtcgcttcgacctacctatcgtgttcc

SEQ ID NO: 36800 - DNA, 662 bp, Homo sapiens
  misc_feature: GYAE6OF01ENVTM.10.49.E05.1.454.CMB.1.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
tcagcatagtagtgcacgaccggtgctcgatttagagcgactagcaacacacaaagggggaggaactgctcagttaggacccagagggaaccatggaagccccagctcagcttctcttcctctgctactctggctcccagatcgccaccggagctagttgtattgacacagtctcacgcccaccttgttctttgtctaccgaggggaaancgcctaccctctcgngcgaggccagtcagngcgttagactaactacttagcctacggtaaccaacgaagaaaccgtggacccaggccctacccgaggtcctcccgtacactctaatgtatgtaacctccgacgggcccggccacgtcgggtaccctcccgagtccgtaggttcgaggtcggcgtagggtcgggtccgtagggactagtactcgactcgtccacgtatacgagccgtacgcctaagacgtaccgtaggtaagttacgtttttcgggtacgttttactacggttgtacgtaggacgtaggccggttacgccctacggtcggttcccgttcggttccccgtttaccccggttcgggcccgtaagggtaacccgtaaagggtgtaacgttacccgaataaacccggtacgttggtacggtcctacgaccacttcgttgtcgttacc

SEQ ID NO: 36801 - DNA, 566 bp, Homo sapiens
  misc_feature: GYAE6OF01EY0WZ.10.49.E05.1.454.CMB.1.raw
  modified_base (212)..(212): a, c, t, g, unknown or other
  misc_feature (212)..(212): n is a, c, g, or t
  modified_base (301)..(301): a, c, t, g, unknown or other
  misc_feature (301)..(301): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (453)..(453): a, c, t, g, unknown or other
  misc_feature (453)..(453): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagagtgttggccgcctacgtagcctggtaccaacagaaacctggccaggctcccaggcccctnatctagtggtgcatcccaacgacgggccacgtcggacactcccagccaggttcagtggcaggtgggtctgggacagcttcactctcacatcatcagcctggacnctgaagnttgttgtctagtttattactgtacaactagtccgtaccggngtcggtccgtcccggggtacctacgttccggcccgttacggggaaccctaaacggtggtaacttacgaaccgtaaacgtacgttggtacggtctacgaccactactcgttacg

SEQ ID NO: 36802 - DNA, 786 bp, Homo sapiens
  misc_feature: GYAE6OF01DI1L4.10.49.E05.1.454.CMB.1.raw
  modified_base (210)..(210): a, c, t, g, unknown or other
  misc_feature (210)..(210): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagatgccaccggagcagttgtattgacacagtctccagccacccttgttctttcgtctccgaaggggaaanacgcccacccttctcctgcgacgggccagtcagacgcgttagactaaactacttacgcctacggtaacccaaacaacggaaaacccgtgggacccaaggggtcccttacccccgaagggtccttccccgttacacttcttacgttaggtactcggttaactcccggaacgggtccccggggcctaacgttccgggacccgttaccccgaaggtcccgtaagggtttcgaacggtgggtacccgtagggttgggggtaccttacggggaactaacgggttaccttccgtaccttacctaaacccggaaccctaagttaccgtaacggccctaaacggtcccgttaaacggtaaccggacccgtttagggtaaaaggtttaccgttttttacggggtttacggtttttaacgttacccgttaggttaccgaacggttacgacgttcgggtacccggtaccgtaacggtccgggtccgttccggtccgttttcccccgtacggcccgttaacgggaccctaaaagggtcgtaactaacgtaacgaaacgttgacgttgactcgactacatctcgttacc

SEQ ID NO: 36803 - DNA, 737 bp, Homo sapiens
  misc_feature: GYAE6OF01CTZQR.10.49.E05.1.454.CMB.1.raw
  modified_base (208)..(208): a, c, t, g, unknown or other
  misc_feature (208)..(208): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagatgccaccggagcagttgtattgacacagtctccagcccaccctgttctttgtctccgaaggggaanacgcccaccctctcctgcagggccagtcagagtcgttagctaactactagcctggtaaccaacagaaacctggccaggcctccgagcctccnatctatgatcgtacnccgacggcccgggacctacgtcgggcccgtacccaggccctagggttccaaggtcgggctagggttcggggtccgtaggggaacctaggtacctttccgaaccttcgtacccaaccgtaagtccaacggtccaacgtccgtaacggacgtacccgtaaggtaaacggttacgttttttcggaaccgggttttttaacttaaccgttcgttacgtaacggtcggtaacggtccggttacgggtccctaaccgggttccgggtcccgtttacgggttccccggttttccccggtttccggggaccccgttaacgggggtaaaccctaaaagggttcggtaacgttaacgtaaccggtaaaacggtacggttacggttaccgggtacgttccgtaaccaacccgttacttcgttacgtttacccg

SEQ ID NO: 36804 - DNA, 696 bp, Homo sapiens
  misc_feature: GYAE6OF01EW1MH.10.49.E05.1.454.CMB.1.raw
  modified_base (213)..(213): a, c, t, g, unknown or other
  misc_feature (213)..(213): n is a, c, g, or t
tcagcatagtagtgcacgaccggtgctcgatttagagcgactagcaacacacaaaggggggaggaactgctccagttaggacccagagggaaccatggaagccccagctcagcttctcttcctcctgctactctggcctcccagatgccaccggagcagttgtattgacacagtctccagcccaccctgtctttgtctccgaagggggaaagngcccaccctctcctgcagggccagtcagagcgttagcaactacttagcctaggtaaccaacagaaacctggccaggcctccgaggcctcctcatctatgatgtactccgacggccgggaccacgtcggcccgtccccgaggtcccgtagggttccagggtcgggcgtagggttggggtcgtggggaacctaggtaccttcaccttctaccaaccatccgacgccaacgccgttaacggacgtacctaggtaaagtttacgttttcgggtaccggtttttaattaccgttcggttaccacgtaccgtaggccggttcggccctacgtcgggtacccttcggttccccgttttccccggtttaccgggccccggttaacggggtaacccttaaaaggggtcgttaaccgtaacttaaccggaaaaaccggttacggttcggtaccggacttaccggaccctaaccttacttcgttcggtttaccc

SEQ ID NO: 36805 - DNA, 679 bp, Homo sapiens
  misc_feature: GYAE6OF01BUR8M.10.49.E05.1.454.CMB.1.raw
  modified_base (155)..(155): a, c, t, g, unknown or other
  misc_feature (155)..(155): n is a, c, g, or t
  modified_base (206)..(206): a, c, t, g, unknown or other
  misc_feature (206)..(206): n is a, c, g, or t
  modified_base (440)..(440): a, c, t, g, unknown or other
  misc_feature (440)..(440): n is a, c, g, or t
tcagcatagtagtgcacgaccggtgctcgatttagagcgactagcgaacacacaaagggggaggaactgctcagttaggacccagagggaaccatggaacgcccagctcagcttctcttcctcctgctactcgtggctcccagatgccaccggancagttgtattgacacagtctccagcccacctgtctttgtctccgagggganagacgcccaccctctccgtgcgagggccgtacgaacgtaatacgttggacctaacctaacgttacgccgttacggtaactaaccaaacgaaaaaccggtccgttacggacctacggtaccctacccgacgtaacccttccgtactacttcccgtcgtgggtacgctaagtccgtcggacggcctacgtcggtacgtccgaacgtccgtacgttcgaggtcggctaggtcggtancggtaacagtcgttacacgtctcactgtcgagccgtacgtgactaggtctaagtaagtcgtttacgaccgttaagttttacagttcgtacgtagtacgtaagtttataacgttgtaacgttttggtttttaccctacgttaccgttaccggtaccggttaacggaaccgttaaaggttcgggtaactttaggaacggtcgtaaccgtgtacggtctacgtactaccttgtccgtttacg

SEQ ID NO: 36806 - DNA, 770 bp, Homo sapiens
  misc_feature: GYAE6OF01CU7S9.10.49.E05.1.454.CMB.1.raw
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagcatagtagtgcacgaccggtgctcgatttagagcgactagcaacacacaaagggggaggaactgctcagttaggacccagagggaaccatggaagccccagctcagcttctccttcctcctgctactcgtggcctcccagatcgcccaccggagcagttgattgacacagtcctccagccctaccctgttcttgcctacgaggggaacncgcccacctctcctgcgaggccngtcagngtcttagcaactctacgcctacggtaaccaacgacgtaaacctggccacggcctcccgaggtcctaccctcactaccttatacgtacgtacgtaccgttacccggaggccccgggtaccctaacgttccgggccccgtaccccgacgaccggttaccggttcggaaggttcggacggtacgggttacggggtccgtacgggaacgtaacggtcctttaccgaccttctaccgaacctctaccgaacgtcctaccggtaccgttaacggaccgttaccgtaaggttaaaccgtttagtttttacggggtaccgtttttaacgtttacggtacggtccgtaaggaccgtaggtaccgggttcgacccgtacggttcgggacccgtttcggttccccggttttcccggttccgggcccggttaacgggtaaccggttaacgggtacggtacgtaaaccgtaaccggtaaaccggtaacggttacgggtccgacgtacccggtaccaccgtaacttcccgtacgtttacccc

SEQ ID NO: 36807 - DNA, 791 bp, Homo sapiens
  misc_feature: GYAE6OF01B2EBH.10.49.E05.1.454.CMB.1.raw
  modified_base (178)..(178): a, c, t, g, unknown or other
  misc_feature (178)..(178): n is a, c, g, or t
  modified_base (218)..(218): a, c, t, g, unknown or other
  misc_feature (218)..(218): n is a, c, g, or t
  modified_base (419)..(419): a, c, t, g, unknown or other
  misc_feature (419)..(419): n is a, c, g, or t
tcagcatagtagtgcacgaccggtgctcgatttagagcgactagcaacacaacaaagggggaggaactgctcagttaggacccagagggaaccatggaagccccagctcagcttctcttcctctgctactctcggcctcccagatcgccgacggagctagttgtattgacactagtcnccacgccctaccttgttcttcgtctaccggaaggggaacncgacccaccttctccgtacggcgacggccagtacaggtacgtacgttacgacctaacgttacgtacgtaccgtacggtaaccaaacacgtaaccgtcggaccacggtcctaccgtgcctcgtctaatcttagtagtacgttcgtacgtcccgacggtcccggactaccggccggttcccgaaccgtcggtccgttaggtcncgggttacggcggtaacgggtccggtacggtacggaacgtacgtaccctactaaccgtccaaccgtaacctagtacctaacggaccgtacgtaaccgtacgacccgttaggtaaacgtttacgtttaacgttttcgggttaacgttttaacgtccgtacggtacgtcgtacggtccgtacggttaccggtaccgtacggttccgttccgttacccggttttccgtttacccccggttaccggtaccggttaaacccgggtaaacgtaagggttaccgtaaacgttaccgtaaaaacggtaccggttacgtcgggtaccttaccgggtaacctaccccgtaaccgtttacctttacgtttcccgttaaccccg

SEQ ID NO: 36808 - DNA, 894 bp, Homo sapiens
  misc_feature: GYAE6OF01BLB86.10.49.E05.1.454.CMB.1.raw
tcagcatagtagtgcacgaccggtgctcgatttagagcgactagcaacacacaaagggggaggaactgctcagttaggacccagagggaaccatggaagcccccagcctcagcttctcttcctcctgctactctggctcccagacaccaccggagaattgtgttgacacgagtcctccagccacgctgttctttagcctaccgaaggggtaaacgagaacctacccctctccctgccgagggcctaggtcagtagtgttcgactacgttcggttaggggtgtacgtacctaacctaagtaaaccgtccggaccgtacgggtccgtaccccgtacggcccttcccgttactaactttcgttttacggacgtttccggttacccttttaacgaacccgtacccggggggtacccccttaggggacccccgttacccccgggtaagggtaccccggttagggtttaccccggaaggggttaccgggaccggttaaagggggtttccgggggtttaccgacggggggtaacctaacgggttaacccctttaacgttaacccgttaccctttaaccccgaaaacccgttaacgttccgaaacggtaccccgtaacggtaccccgttaacggtaccgggacccctttaaagggttaaacggttttaacgggttttaacgtaacgttttaaagttttaccgttttaacgtagggttacctacggtacgtaacggtcggtaccgtacccgttaacgggtttcgggcgggtaacgttccgttacccgggtacgttaccggggaacgggtaacggaaacgtaaaggttaacgaccggtaaacgaaaccggtgtaacgggtcgacgtaccgacgtaacgtacttagtccgttacgtccgtacccg

SEQ ID NO: 36809 - DNA, 558 bp, Homo sapiens
  misc_feature: GYAE6OF02FM3SS.10.49.E05.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (385)..(385): a, c, t, g, unknown or other
  misc_feature (385)..(385): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagatgccaccggagcagttgtattgacacagtctccagccaccctgtctttgtctccaggggaaanagccaccctctcctgcagggccagtcagagcgttagcaactacttagcctggtaccaacagaaacctggccaggctcccaggctccncatcttgatgctttcaacagggcccctggctcccgagcgtagtcagtgcagtgggtctgggacagacttcactctacacatcagcagcctagngcctagaagtatttgctagtttattactgtcagcagtcgtcgcctacgtttcggacgggtaggtcggacccgttacgtttcgggacggtaacgggaaccgtaaagtacggtaggtaccgaaacggtaacgttacgtagggtactcggaccaccgtatcgttcgtaccttaccg

SEQ ID NO: 36810 - DNA, 794 bp, Homo sapiens
  misc_feature: GYAE6OF02JDXVT.10.49.E05.1.454.CMB.1.raw
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
tcagcatagtagtgcacgaccggtgctcgatttagagcgactagcaacacacaaaggggaggaactgctcagttaggacccagagggaaccatggaagcccagctcagcttctcttcctctgctactctgctcccagatgccaccggtagcagttgtattgacactagtcctaccagcccacccttgtcttttgctccgaaggggtaancgccaccctctctcgcacgggcaggtccagngtcgttagctaactactacgctacgtaccaacacgaaacctgaccacggcctcccgaggacctccgttcaacgtctactcgtatcgtacttaccaccggccggacctaacgttcgccggtaccctacggtcccgtacggttacgtaggtcgccgtaaggttcgggttacggtacgggaccgtaacgtacctttaccggtaccgttccctaccgtaaccctacgttaccgaacgtaccgtaaccggttaccctaacggtaacggtacccgttaagtaaaccgggtttacgttttaccggtacggtttttacgttaaccgtttacgttaccgtaacggttccgtaacgggttaccggtacccggtccgtaaaccggttccggtaccggttcccgttaacccggttttcccggttacccggtaccccggttaggggttaaaccccgtacgggtttacgtaaccggtttaaaccgtaaccgtaaacggttaaccccgttaggttaacggacctttccggaaacctacccgttaaccgtttccggttcctttaacccgg

SEQ ID NO: 36811 - DNA, 753 bp, Homo sapiens
  misc_feature: GYAE6OF02IFZM1.10.49.E05.1.454.CMB.1.raw
  modified_base (153)..(153): a, c, t, g, unknown or other
  misc_feature (153)..(153): n is a, c, g, or t
  modified_base (207)..(207): a, c, t, g, unknown or other
  misc_feature (207)..(207): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagatgccaccggancagttgtattgacacagtctccagccacccttgtctttgctccgaaggggaaancgccacctctctgcgagggccagtcagacgcgttagcaacttacttacgcctaggtaaccaacaagaaacctggaccacggcctcccgagtcctcctctacttctcgtggtcgctacgttccgttcggacggtcctaacggtcgggtacctacccgacggtccgtaggttccgaggttacgggcgtaggggtcgttacgtacggaaacgtggttaacttcaaccgttcctaccgtaaccgtagtccgacgggtcccggtccgtacgaccgttaagggttccgtaaacgggttaacgtttacgtttttacggacgttttaacgtttttaacgtttaccgtcgttaacgtacgtacgtttaaacgtaagttaaagtcggtttaaaccgggtttttggtttttaacctttaccggtttaccggttttccccggaccggtttaacgggaaccgtttaagggttccggtttaacgttacggaaacggttaaccggtaacggttcgttacgggtctacggtaacccgtacgttacggttccttaggttaccc

SEQ ID NO: 36812 - DNA, 627 bp, Homo sapiens
  misc_feature: GYAE6OF02IDP6L.10.49.E05.1.454.CMB.1.raw
  modified_base (206)..(206): a, c, t, g, unknown or other
  misc_feature (206)..(206): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagatgccaccggagcagttgtattgacacagtctccagccaccctgtctttgtctccgaggggaaancgccaccctctcctgcagggccagtcagagcgttagcaactacttagcctggtaccaacacgaacctggaccaggcctcccaggctacatcattctatgatgtactccgagcccgggcacgtcggccgtcccagcccgtaggttcaggtcgggctagggtggtcgaggggacagtcttccgacttcctaccactanccgagccaagcctaggacnccgttaggaagtttagttttcggtacggtttttattacgtgttacacgtcgtacggtcggtacggcccttacggtcggtccttccggtcccgtttccccgttccggcccgttagggaccctaaaggttcggtaacttaacgtaaccgtaaaacccgttacgtcgggttaccggtacgttaccggaccctaccgtattccgttaccg

SEQ ID NO: 36813 - DNA, 661 bp, Homo sapiens
  misc_feature: GYAE6OF02IIOF7.10.49.E05.1.454.CMB.1.raw
  modified_base (207)..(207): a, c, t, g, unknown or other
  misc_feature (207)..(207): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactctggctcccagatcgccaccggagcagttgtattgacacagtctccagccaccctgtctttgcctccgaggggaaancgcccaccctctcctgcacgggccagtcagagcgttagcaactacttagcctaggaccaacagaacctggccaggcctcccgaggctcctcactctactggatcgtactccaggcccggacctacgtggcctcccagccgtaggtcaggtacgcgaggtcgggtctagggacagtaccttcacgttcctacgacctatcgacgcgacgtccgtacgacgtaccgtagtaagttacgttttacgaccgtttaaggtttacttaactcgttacgtacgtaccgtagtccgttacggtacctccgtttccgggacgggttacggtccgtacccgttaccggttcgggtacccgggaacggtaacccgtaaaggtaacccgggtaacggttaaccgaaacccggttaacgtacggtacggtaccgtccggaaccgttacctaccggttccgttaccgg

SEQ ID NO: 36814 - DNA, 841 bp, Homo sapiens
  misc_feature: GYAE6OF02HTMXK.10.49.E05.1.454.CMB.1.raw
  modified_base (230)..(230): a, c, t, g, unknown or other
  misc_feature (230)..(230): n is a, c, g, or t
tcagcatagtagtgcacgaccggtgctcgatttagagcgactagcaacacacaaagggggaggaactgctcagttaggacccagagggaaccatggaagccccagctcagcttctcttcctcctgctactcgtggctcccaggatgacccaccggagcagttcgtattgacacagtcctccagcccacctggtctttgtcctccgaagggaaagcgtccacccttctccngccacgggcctagtcgaacgagtcgttaacgactaactacgttacgcctacggtaacccaacaacgaaacccgtcgggacccaacgggtccctaccccgacggtcccttacccctactacttccgtaagtggtaacgttacgttacgtacccggaccgggtcccgggtaccccacggttccgggtaccctaccccggacgtcccggttaaggtttaccgacggttcgggtaccggtagggttccggggtacgtagggacctacggttaccttacctaaccgtaccctaccgaacccggtataccgtacggtaccgtacggtaaccctaacgggtaccgtacccggttaacggttaacggtttacggtttttacggtttaccggttttaacgttttacgttacgttacggtaacgttacgtacgggtacggttacgggttacccgtacggtaccggttccgttcccggtttccgtttaccccggtttcccgggtaccgggttaacccgggaaccggttaacggtcggttaaccgtaacgtaaccggtaaaccgtaacgttacggacggttaccgtaccgtaaccgtaccctacggttccggttacttaaccg

SEQ ID NO: 36815 - DNA, 707 bp, Homo sapiens
  misc_feature: GYAE6OF01CIH98.21.13.B02.1.454.CMB.1.raw
tcagtcgtcgctcgcacgaccggtgctcgatttagtctagcgactttagggtttacgggggaagaggtaacgacctgaacggtcctcgcgtgctgaccatcccttcatcgggtcttggccccaggactcgaccgtttcgaaggtagtcgtgggtcccacggctggtgaaacccacgagacgaccctccacggctgacctgcaccttctctgggtttcactcagtaccactacgtcgacgtgggtgtcggtctggactccgtcacgcccccggaaaggccccggagtggctgcactcatttactaggaagtgatcgactaacccacgtacagccctatctcgtgacggaccgaggcctaccacccctcgtacggacggaccaacccgaccaaaaacccgacggtacggtaccctaaaccgaccgttaccggaacccaaacgaacgttaccgggaacccctaacgtacggaaccaaccgaccgacccaacgactaactacgtcgtcgaccacgacgggtagtcggtcgttgggttagtacgggacctacggtcggggaccgacgggtacgtccgtggtccgaccggtcctaccgtaccgaccgtcccgtaccacccgaacgggccctaggttccgtaccgttccccgtggcccgtcccgtggccgtccgaagggccgaccgtaccgtccggagaccgccgacgacccgg

SEQ ID NO: 36816 - DNA, 643 bp, Homo sapiens
  misc_feature: GYAE6OF01AQQFD.21.13.B02.1.454.CMB.1.raw
tcagtcgtcgctcgcacgaccggtgctcgatttagtctagcgactttggatttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacacgcccatctctgacggaccaggcctcaccctcgacgaacggaccaacccgacccaaaaaccgaggtacggtaccctaaacactacgaacccaacgatccggaccccagtcgaaccacacgaccacactactactgtcgaccacgacggggagtcggcgtggggtggtcgggacgtcggtcgggaccgagggtacgtccgtacggtccgtaaccggtctacccgtcgaccgtccctacccgaccgaccggccctacgttcccggtaccccgttccccggtcggccccgtcccgtccggtccctacccggacggaccgccctacccgaccgacggtaccgccgtaacccgg

SEQ ID NO: 36817 - DNA, 815 bp, Homo sapiens
  misc_feature: GYAE6OF02HPNG3.21.13.B02.1.454.CMB.1.raw
tcagtcgtcgctcgcacgaccggtgctcgatttagtctagcgactttgggtttaggggggaaaggaggaagactgacgggtcctggctcgctcgaccgattccccttcattgggtctttggtcccagatcacctttgaaaggagtctggtcccacgcctgggtgaaaccctacgagagaccctcacgtctgacctgctaaccttctctgggttttcactcagtaccactgcgaggtgggtgtggggctggtatccgtcgacggcccccgggaaacggccccggagtggcttcgcactcatttacttggaatgtatgtaataacctactacacgaccctatccttcgtcgacggaccgacggcctaccggacccgtcgaacggaacggacgacccgaccaaaaaaccgaggtaggtaccgtaaagacgtagaacccaaacacgtacggaacccctatacggaaccacacgacccaacgaactaacttacttcgtcgtacccaacgtaacggggaacgttcgggtacgttacggggtacggtacgggtaaccgttaacggttacggggacccgaagggggtaccgttaccggttcgggttacccgaacccgttacctacccgttacgaacgggtcccctaacccgaaacccggtaaacggggtacccccgtaaatttacccggggtttccccttttacccccggtttacggggtaaccccggtccccggtttacggtacccggttcccgaacggggtaaccacccggtaaccccgttacccgggggaaccggaacgggttcccgaaccgtacccggg

SEQ ID NO: 36818 - DNA, 155 bp, Homo sapiens
  misc_feature: GYAE6OF01DY5AU.29.24.C02.1.454.CMB.1.raw
  modified_base (154)..(155): a, c, t, g, unknown or other
  misc_feature (154)..(155): n is a, c, g, or t
tcagatagagtactcacgaccggtgctcgatttagtacagatcgttagggaaagggaccaaggtggaaatcaaacgaactgtggctgcaccatctgtcttcatcttcccgccatctgaagtactctatctgagcgggctggcaaggcgcatagnn

SEQ ID NO: 36819 - DNA, 154 bp, Homo sapiens
  misc_feature: GYAE6OF01A7YM8.29.24.C02.1.454.CMB.1.raw
  modified_base (154)..(154): a, c, t, g, unknown or other
  misc_feature (154)..(154): n is a, c, g, or t
tcagatagagtactcacgaccggtgctcgatttagtacagatcgttagggaaagggaccaaggtggaaatcaaacgaactgtggctgcaccatctgtcttcatcttcccgccatctgaagtactctatctgagcgggctggcaaggcgcatagn

SEQ ID NO: 36820 - DNA, 186 bp, Homo sapiens
  misc_feature: GYAE6OF01B8UAH.29.24.C02.1.454.CMB.1.raw
  modified_base (155)..(186): a, c, t, g, unknown or other
  misc_feature (155)..(186): n is a, c, g, or t
tcagatagagtactcacgaccggtgctcgatttagtacagatcgttaggcaagggaccaaggtagggagatcaacgactgtggctgaaccatctgtacttccatcttcccgccatctgaatagcgtactctgagcgggctggcaaggcgcatagnnnnnnnnnnnnnnnnnnnnnnnnnnnnnnnn

SEQ ID NO: 36821 - DNA, 154 bp, Homo sapiens; identical to SEQ ID NO: 36819
  misc_feature: GYAE6OF01BMIBS.29.24.C02.1.454.CMB.1.raw
  modified_base (154)..(154): a, c, t, g, unknown or other
  misc_feature (154)..(154): n is a, c, g, or t

SEQ ID NO: 36822 - DNA, 154 bp, Homo sapiens; identical to SEQ ID NO: 36819
  misc_feature: GYAE6OF01CUZHO.29.24.C02.1.454.CMB.1.raw
  modified_base (154)..(154): a, c, t, g, unknown or other
  misc_feature (154)..(154): n is a, c, g, or t

SEQ ID NO: 36823 - DNA, 157 bp, Homo sapiens
  misc_feature: GYAE6OF01EL595.29.24.C02.1.454.CMB.1.raw
  modified_base (153)..(157): a, c, t, g, unknown or other
  misc_feature (153)..(157): n is a, c, g, or t
tcagatagagtactcacgaccggtgctcgatttagtacagatcgttagggaagggaccaaggtggaaatcaaacgaactgtggctgcaccatctgtcttcatcttcccgccatctgaagtactctatctgagcgggctggcaaggcgcatagnnnnn

SEQ ID NO: 36824 - DNA, 156 bp, Homo sapiens
  misc_feature: GYAE6OF01EHVKJ.29.24.C02.1.454.CMB.1.raw
  modified_base (155)..(156): a, c, t, g, unknown or other
  misc_feature (155)..(156): n is a, c, g, or t
tcagatagagtactcacgaccggtgctcgatttagtacagatcgttagggaaagggaccgaaggtggaaatcaaacgaactgtggctgcaccatctgtcttcatcttcccgccatctgaagtactctatctgagcgggctggcaaggcgcatagnn

SEQ ID NO: 36825 - DNA, 153 bp, Homo sapiens
  misc_feature: GYAE6OF01BNK95.29.24.C02.1.454.CMB.1.raw
  modified_base (153)..(153): a, c, t, g, unknown or other
  misc_feature (153)..(153): n is a, c, g, or t
tcagatagagtactcacgaccggtgctcgatttagtacagatcgttagggaagggaccaaggtggaaatcaaacgaactgtggctgcaccatctgtcttcatcttcccgccatctgaagtactctatctgagcgggctggcaaggcgcatagn

SEQ ID NO: 36826 - DNA, 155 bp, Homo sapiens; identical to SEQ ID NO: 36818
  misc_feature: GYAE6OF01C164N.29.24.C02.1.454.CMB.1.raw
  modified_base (154)..(155): a, c, t, g, unknown or other
  misc_feature (154)..(155): n is a, c, g, or t

SEQ ID NO: 36827 - DNA, 155 bp, Homo sapiens; identical to SEQ ID NO: 36818
  misc_feature: GYAE6OF01DSM2F.29.24.C02.1.454.CMB.1.raw
  modified_base (154)..(155): a, c, t, g, unknown or other
  misc_feature (154)..(155): n is a, c, g, or t

SEQ ID NO: 36828 - DNA, 165 bp, Homo sapiens
  misc_feature: GYAE6OF01BJDCO.29.24.C02.1.454.CMB.1.raw
  modified_base (155)..(165): a, c, t, g, unknown or other
  misc_feature (155)..(165): n is a, c, g, or t
tcagatagagtactcacgaccggtgctcgatttagtacagatcgttagggaaagggaccaaggtggaaagtcaaacgaactgtggctgcaccatctgtcttcatcttcccgccatctgaagtactctatctgagcgggctggcaaggcgcatagnnnnnnnnnnn

SEQ ID NO: 36829 - DNA, 154 bp, Homo sapiens; identical to SEQ ID NO: 36819
  misc_feature: GYAE6OF01BZ2H4.29.24.C02.1.454.CMB.1.raw
  modified_base (154)..(154): a, c, t, g, unknown or other
  misc_feature (154)..(154): n is a, c, g, or t

SEQ ID NO: 36830 - DNA, 162 bp, Homo sapiens
  misc_feature: GYAE6OF01B3CB3.29.24.C02.1.454.CMB.1.raw
  modified_base (154)..(162): a, c, t, g, unknown or other
  misc_feature (154)..(162): n is a, c, g, or t
tcagatagagtactcacgaccggtgctcgatttagtacagatcgttagggaaagggaccaaggtggaaatcaaacgaactgtggctgcaccatctgtcttcatcttcccgccatctgaagtactctatctgagcgggctggcaaggcgcatagnnnnnnnnn

SEQ ID NO: 36831 - DNA, 154 bp, Homo sapiens; identical to SEQ ID NO: 36819
  misc_feature: GYAE6OF01CRE67.29.24.C02.1.454.CMB.1.raw
  modified_base (154)..(154): a, c, t, g, unknown or other
  misc_feature (154)..(154): n is a, c, g, or t

SEQ ID NO: 36832 - DNA, 154 bp, Homo sapiens
  misc_feature: GYAE6OF01BKE9Y.29.24.C02.1.454.CMB.1.raw
  modified_base (154)..(154): a, c, t, g, unknown or other
  misc_feature (154)..(154): n is a, c, g, or t
tcagatagagtactcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagn

SEQ ID NO: 36833 - DNA, 186 bp, Homo sapiens
  misc_feature: GYAE6OF01DN6EN.29.24.C02.1.454.CMB.1.raw
  modified_base (155)..(186): a, c, t, g, unknown or other
  misc_feature (155)..(186): n is a, c, g, or t
tcagatagagtactcacgaccggtgctcgatttagtacagatcgttagggaaagggaccaaggtggaatcaaacgaactgtggctgcaccagtctgtcttcatcttcccgccatctgaagtactctatctgagcgggctggcaaggccgcatagnnnnnnnnnnnnnnnnnnnnnnnnnnnnnnnn

SEQ ID NO: 36834 - DNA, 157 bp, Homo sapiens
  misc_feature: GYAE6OF01DVI01.29.24.C02.1.454.CMB.1.raw
  modified_base (154)..(157): a, c, t, g, unknown or other
  misc_feature (154)..(157): n is a, c, g, or t
tcagatagagtactcacgaccggtgctcgatttagtacagatcgttagggaaagggaccaaggtggaaatcaaacgaactgtggctgcaccatctgtcttcatcttcccgccatctgaagtactctatctgagcgggctggcaaggcgcatagnnnn

SEQ ID NO: 36835 - DNA, 169 bp, Homo sapiens
  misc_feature: GYAE6OF01BESC4.29.24.C02.1.454.CMB.1.raw
  modified_base (155)..(169): a, c, t, g, unknown or other
  misc_feature (155)..(169): n is a, c, g, or t
tcagatagagtactcacgaccggtgctcgatttagtacagatcgttagggaaaggggaccaaggtggaaatcaaacgaactgtggctgcaccatctgtcttcatcttcccgccatctgaagtactctatctgagcgggctggcaaggcgcatagnnnnnnnnnnnnnnn

SEQ ID NO: 36836 - DNA, 158 bp, Homo sapiens
  misc_feature: GYAE6OF01CC7GX.29.24.C02.1.454.CMB.1.raw
  modified_base (157)..(158): a, c, t, g, unknown or other
  misc_feature (157)..(158): n is a, c, g, or t
tcagatagagtactcacgaccggtgctcgatttagtacagatcgttagggaaagggaccgaaggtggaaatcaaacgaactgtggctgcaccatctgtcttcatcttcccgccatctgaagtactctatctgaggcgggctggcaaggcgacatagnn

SEQ ID NO: 36837 - DNA, 584 bp, Homo sapiens
  misc_feature: GYAE6OF01BBFVS.29.24.C02.1.454.CMB.1.raw
  modified_base (227)..(227): a, c, t, g, unknown or other
  misc_feature (227)..(227): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (438)..(438): a, c, t, g, unknown or other
  misc_feature (438)..(438): n is a, c, g, or t
tcagatagagtactcacgaccggtgctcgatttagtacagatcgttaggggaaaggggggggtctcaggaggcagcgctctcaggacgtcaccaccatggcctggctctgctcctcctcaccctcctcactcagggcacagggtcctgggcccaggctgccctgactcagcctccctcgcgtccggtctcctggacagtcagtccacatctcctgcactgacaaccngctagtgacgttggtggttcgaagtatgtctctgtaccaacaaccacccgacaaacgccccaaatcatctattttagacgtcacgtacgccacctcgacgggtcctgactcgtcttctcgtcgctcagtctgccacnccggcctccgcgtaccgtctcgcggctcgnggtctagaggtanggagtactagtatttactgtcgcagctcatntcgacgtgatacgacgcgactaccgttaccagtgtacgacgttccggtcggggaaccggggtacgaggtacccgttacggaccccggttcgaagggttacccacggtaaccccggacggtaccgtccccggttaacccgtcccggg

SEQ ID NO: 36838 - DNA, 209 bp, Homo sapiens
  misc_feature: GYAE6OF01ER3WV.29.24.C02.1.454.CMB.1.raw
  modified_base (163)..(209): a, c, t, g, unknown or other
  misc_feature (163)..(209): n is a, c, g, or t
tcagatagagtactcacgaccggtgctcgatttagtacagatcgttagggaaagggaccaaggtggaaatcaaacgaactgtggctgcaccatctgtcttcattccttccccgcatctagaacgtactctatctgaggcgggctcggcgaaggcgactagagnnnnnnnnnnnnnnnnnnnnnnnnnnnnnnnnnnnnnnnnnnnnnnn

SEQ ID NO: 36839 - DNA, 154 bp, Homo sapiens; identical to SEQ ID NO: 36819
  misc_feature: GYAE6OF02IHG9R.29.24.C02.1.454.CMB.1.raw
  modified_base (154)..(154): a, c, t, g, unknown or other
  misc_feature (154)..(154): n is a, c, g, or t

SEQ ID NO: 36840 - DNA, 155 bp, Homo sapiens
  misc_feature: GYAE6OF02IN57C.29.24.C02.1.454.CMB.1.raw
  modified_base (153)..(155): a, c, t, g, unknown or other
  misc_feature (153)..(155): n is a, c, g, or t
tcagatagagtactcacgaccggtgctcgatttagtacagatcgttagggaaagggaccaaggtggaatcaaacgaactgtggctgcaccatctgtcttcatcttcccgccatctgaagtactctatctgagcgggctggcaaggcgcatagnnn

SEQ ID NO: 36841 - DNA, 164 bp, Homo sapiens
  misc_feature: GYAE6OF02HU2ND.29.24.C02.1.454.CMB.1.raw
  modified_base (154)..(164): a, c, t, g, unknown or other
  misc_feature (154)..(164): n is a, c, g, or t
tcagatagagtactcacgaccggtgctcgatttagtacagatcgttagggaagggaccaaggtggaaatcaaacgaactgtggctgcaccagtctgtcttcatcttcccgccatctgaagtactctatctgagcgggctggcaaggcgcatagnnnnnnnnnnn

SEQ ID NO: 36842 - DNA, 165 bp, Homo sapiens
  misc_feature: GYAE6OF02G3ZRQ.29.24.C02.1.454.CMB.1.raw
  modified_base (154)..(165): a, c, t, g, unknown or other
  misc_feature (154)..(165): n is a, c, g, or t
tcagatagagtactcacgaccggtgctcgatttagtacagatcgttagggaagggaccgaaggtggaaatcaaacgaactgtggctgcaccatctgtcttcatcttcccgccatctgaagtactctatctgagcgggctggcaaggcgcatagnnnnnnnnnnnn

SEQ ID NO: 36843 - DNA, 161 bp, Homo sapiens
  misc_feature: GYAE6OF02GSTRR.29.24.C02.1.454.CMB.1.raw
  modified_base (154)..(161): a, c, t, g, unknown or other
  misc_feature (154)..(161): n is a, c, g, or t
tcagatagagtactcacgaccggtgctcgatttagtacagatcgttagggaaagggaccaatgtggaaatcaaacgaactgtggctgcaccatctgtcttcatcttcccgccatctgaagtactctatctgagcgggctggcaaggcgcatagnnnnnnnn

SEQ ID NO: 36844 - DNA, 154 bp, Homo sapiens; identical to SEQ ID NO: 36819
  misc_feature: GYAE6OF02IU6E8.29.24.C02.1.454.CMB.1.raw
  modified_base (154)..(154): a, c, t, g, unknown or other
  misc_feature (154)..(154): n is a, c, g, or t

SEQ ID NO: 36845 - DNA, 562 bp, Homo sapiens
  misc_feature: GYAE6OF02HCF8V.29.24.C02.1.454.CMB.1.raw
tcagatagagtactcacgaccggtgctcgatttagtacagatcgttagggaaagggggtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggtttacactcgaaactactggagtgggtgtggcctggatccgtcacgcccccaggaaacggcccttgaatggcttgcactcatttattggaatgatgatgagcgctacagcccatctctgcaagaacgagggtcaaccatcaaccgaaggaccaaccctacccgaaaacgggtcggtcctacaacaatcgaaccaacatacggaccctaggtcggacacgagccaactactattactgtcgcacggtactacttttccagtctcttccttctgacttcgtcggccacgtattcgtcggtcctacgtcctctctcgccctccgaccgaccggcccacgtccgtcccttccccg

SEQ ID NO: 36846 - DNA, 586 bp, Homo sapiens
  misc_feature: GYAE6OF02HDEF6.29.24.C02.1.454.CMB.1.raw
  modified_base (335)..(335): a, c, t, g, unknown or other
  misc_feature (335)..(335): n is a, c, g, or t
tcagatagagtactcacgaccggtgctcgatttagtacagatcgttagggaaagggggtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggtttacactcgaaactactggagtgggtgtggcctggatccgtcagcccccaggaaaggcccttgaatggcttgcactcatttattggaatgatgatgagcgctacagcccatctctgcagaacnggtacacatcaccaaggacacctacccgaaaaccgggtcgtacctcacaatcgaaccaacactacggaccctaggtacggacaccgagccacaatacttactgtacgctaacggacgtactttttccagtcgtccttcctttctcgtacgttcgtcgggacctacggtacttcgtcggtccgtaccgttcctcccttcgtcctacccgtccacccgaaccggtccctaacgtccggttcccttacccccgg

SEQ ID NO: 36847 - DNA, 356 bp, Homo sapiens
  misc_feature: GYAE6OF01E47UF.19.10.A10.1.454.CMB.1.raw
  modified_base (354)..(356): a, c, t, g, unknown or other
  misc_feature (354)..(356): n is a, c, g, or t
tcagtactctcgtgcacgaccggtgctcgatttagcgtcgatctcagggtccgggagatcatgagggtgtccttgggtttggggaagaggaagactgacggtcctgccacaggtggtgctgggcacggtgggcactcgacacatccatttactattgtacaaatgaatactggggacggggaaattggggccagggaaccctggtctccgtctcgtcagcctccaccaagggcccatcggtcttccccctggcgccctgctccaggagcacctccgagagcacagcggccctgggctgcctggtcaaggactacttcccacgagagtactgagcgggctggcaaggcgcatagnnn

SEQ ID NO: 36848 - DNA, 497 bp, Homo sapiens
  misc_feature: GYAE6OF01DVECT.19.10.A10.1.454.CMB.1.raw
  modified_base (195)..(195): a, c, t, g, unknown or other
  misc_feature (195)..(195): n is a, c, g, or t
  modified_base (325)..(325): a, c, t, g, unknown or other
  misc_feature (325)..(325): n is a, c, g, or t
  modified_base (493)..(494): a, c, t, g, unknown or other
  misc_feature (493)..(494): n is a, c, g, or t
tcagtactctcgtgcacgaccggtgctcgatttagcgtcgatctcaggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagcaccttctttgcctggtaccagcagagacctggccaggctcccaggctcctcgtttatggtgcgtccaccagggccactggcatccccganaggttcagtgcagtgtgtctgggacagacttcactctcaccatcagcagactggagcctgaagattttgctagtgtattactgtcaacgatatgatgagtcactcgtggtgacatttggcagggaccaaggttgaagtcaaacgactgtggctgcaccatctgtcttnntcc

SEQ ID NO: 36849 - DNA, 498 bp, Homo sapiens
  misc_feature: GYAE6OF01AOKI4.19.10.A10.1.454.CMB.1.raw
  modified_base (296)..(296): a, c, t, g, unknown or other
  misc_feature (296)..(296): n is a, c, g, or t
  modified_base (325)..(325): a, c, t, g, unknown or other
  misc_feature (325)..(325): n is a, c, g, or t
  modified_base (494)..(495): a, c, t, g, unknown or other
  misc_feature (494)..(495): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgttatggtncgtccaccagggccactggcatccccganaggttcagtggcagtgtgtctgggacagacttcactctcaccatcagcagactggagcctgaagtatttgctagtgtattactgtcaacgatatgatgagtcacctcgtggtgactattggcgagggaccaggtgaagtcaaacgacgtgtggctgcacatctgtcttnntcc

SEQ ID NO: 36850 - DNA, 363 bp, Homo sapiens
  misc_feature: GYAE6OF01B6CWE.19.10.A10.1.454.CMB.1.raw
  modified_base (356)..(363): a, c, t, g, unknown or other
  misc_feature (356)..(363): n is a, c, g, or t
tcagtactctcgtgcacgaccggtgctcgatttagcgtcgatctcaggggtccgggagatcatgagggtgtccttgggttttgggggaagaggaagactgacggtcctgccacaggtggtgctgggcacggtgggcactcgacacagccatttactattgtacaaatgaatactggggacgggggaaaattggggccagggaaccctggtctccgtctcgtcagcctccaccaagggcccatcggtcttccccctggcgccctgctccaggagcacctccgagagcacagcggccctgggctgcctggtcaaggctacttcccacgagagactgagcggctggcaaggcgcatagnnnnnnnn

SEQ ID NO: 36851 - DNA, 445 bp, Homo sapiens
  misc_feature: GYAE6OF01DN465.19.10.A10.1.454.CMB.1.raw
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (283)..(283): a, c, t, g, unknown or other
  misc_feature (283)..(283): n is a, c, g, or t
  modified_base (413)..(413): a, c, t, g, unknown or other
  misc_feature (413)..(413): n is a, c, g, or t
  modified_base (438)..(445): a, c, t, g, unknown or other
  misc_feature (438)..(445): n is a, c, g, or t
tcagtactctcgtgcacgaccggtgctcgatttagcgtcgatctcgagggggagaagagctgctctagttaggacccaggaggaaccatggaaaccccagcgcagcttctacttcctcctgctactctggctcccagatagcacggagaaatttctgacgcagtctccaggcacctgtcttgaccatggcatcccganaggttcagtggcagtgtgtcngggacagacttcactcncaccatcacgcagacctggagcctagaagtatttgcagtgtattacngtcaacgatagtgatgagtcacctccgtgtagacaatttggccaaggggaccaaggttcgaaagtacaaaacgaactgtggctgcaccgatctgtctcatcttccgccaatcagacacgagagtactgancgggcagggcaaggcgacaagttgnnnnnnnn

SEQ ID NO: 36852 - DNA, 635 bp, Homo sapiens
  misc_feature: GYAE6OF01DS5OS.19.10.A10.1.454.CMB.1.raw
  modified_base (345)..(345): a, c, t, g, unknown or other
  misc_feature (345)..(345): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtgggggaggcgtggtccgaggcccggggggtccctgagactctcctgtagaagttatggattcaacttcgctagcggctggctgtgcgtgggttcgccaggctccgaggggaagggctgggaggtgggtggccgnagtacgaaggaggagatagtaggaaggggaggacgacgagactacggctcggccacccggtgaggacggcagtactttaccagtgtacaagagatgaattacaactaaagtacagtgtatcgtagactaaagtcgaaacagaccgtaagaacgaccgaaggaaccacgacgtacctaatttactaattacgaaactaaagtagtaaagtaacgggtaaggggggaaacgggggtaaaagttcgggggaacccgtaacggggtaaccccgttgggtacccgtccggtaccg

SEQ ID NO: 36853 - DNA, 363 bp, Homo sapiens
  misc_feature: GYAE6OF01AY7KK.19.10.A10.1.454.CMB.1.raw
  modified_base (360)..(363): a, c, t, g, unknown or other
  misc_feature (360)..(363): n is a, c, g, or t
tcagtactctcgtgcacgaccggtgctcgatttagcgtcgatctcaggggtccgggagatcatgagggtgtccttgggttttgggggaagaggaagactgacggtcctgccacaggtggtgctgggcacggtgggcactcgacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggctgcctggtcaaggacacttccccacgagagtactgagcgggctggcaaggcgcatagnnnn

SEQ ID NO: 36854 - DNA, 731 bp, Homo sapiens
  misc_feature: GYAE6OF01A1SDP.19.10.A10.1.454.CMB.1.raw
  modified_base (206)..(206): a, c, t, g, unknown or other
  misc_feature (206)..(206): n is a, c, g, or t
  modified_base (274)..(274): a, c, t, g, unknown or other
  misc_feature (274)..(274): n is a, c, g, or t
tcagtactctcgtgcacgaccggtgctcgatttagcgtcgatctcgagggggagaagagctgctctagttaggacccaggagggaaccatggaaaccccagcgcagcttctactcctcctgctactctggctcccagactagcaccggagaaattttctgacggtcagtctccaggtcaccgtgtcttgaccactggcatcccganaggttcagtggcagtcgtgtacgtcgggaccagaccttccactctcgaccatccacgcagcctggacnccctgaagtattttcggacaaggtcgtagttacctcggtcgaaccgtatagtgaatgagtcgaaccttccggtaggtacggtaacctaagttttcgggaccgaaggggtacctaaacggggtttcgaaacggttaccgaaaacggtaaaccgttggttaacggtcgttacggaccgtaacccgtaaacggttaccttacgggttcccgtttacgaactttcccgttttaacccccggcctaacgtaccgttacgggaaacccttaccgggaaacgtacgggttaaaccttcggaaacgggttcccgggaacgttcgggaaccgtaaacgggggtcccgtaaccggtaaaaggtacccggggtacgtacggttacgacgtacgtacgtacgtacgtacgtacgtacgtacgtacgtacgtcgtacgtacgtacgtacgtacgtacgtcgtcgtcgtcg

SEQ ID NO: 36855 - DNA, 364 bp, Homo sapiens
  misc_feature: GYAE6OF01E2386.19.10.A10.1.454.CMB.1.raw
  modified_base (359)..(364): a, c, t, g, unknown or other
  misc_feature (359)..(364): n is a, c, g, or t
tcagtactctcgtgcacgaccggtgctcgatttagcgtcgatctcaggggtccgggagatcatgagggtgtccttgggttttgggggaagaggaagactgacggtcctgccacaggtggtgctgggcacggtgggcactcgacacatccatttactattgtacaaatgaatactggggacgggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagtactgagcgggctggcaaggcgcatagnnnnnn

SEQ ID NO: 36856 - DNA, 373 bp, Homo sapiens
  misc_feature: GYAE6OF01BMCST.19.10.A10.1.454.CMB.1.raw
  modified_base (367)..(373): a, c, t, g, unknown or other
  misc_feature (367)..(373): n is a, c, g, or t
tcagtactctcgtgcacgaccggtgctcgatttagcgtcgatctcaggggtccgggagatcatgagggtgtccttgggttttggggggaagaggaagactgacggtcctgccacaggtggtgctgggcacggtgggcactcgacacagccatttactattgtacaaatgaatacgtggggacgggggaaaattggggccagggaaccctggtctccgtctcgtcagcctccaccgaagggcccatcggtccttccccctggccgccctgcctccgaggacgccacctccgagagcacagcgccctgggctgcctggtcaaggactacttcccacgagagtactgagcgggctggcaaggcgcatagnnnnnnn

SEQ ID NO: 36857 - DNA, 441 bp, Homo sapiens
  misc_feature: GYAE6OF01BF0N3.19.10.A10.1.454.CMB.1.raw
  modified_base (204)..(204): a, c, t, g, unknown or other
  misc_feature (204)..(204): n is a, c, g, or t
  modified_base (429)..(441): a, c, t, g, unknown or other
  misc_feature (429)..(441): n is a, c, g, or t
tcagtactctcgtgcacgaccggtgctcgatttagcgtcgatctcagggggggagaagagctgctcagttaggacccagagggaaccatggaaaccccagcgcagcttctcttcctcctgctactctggctcccagatagcaccggagaaattttcttgacgcagtctccaggcaccctgtctttgaccactggcatccccganaggttcagtggcagtgtgtctgggacagacttcactctcaccatcagcagactggagcctgaagattttgcagtgtattactgtcaacgatatgatgagtcacctcgtggtgactagttggccagggaccaaggttgaagtcaaacgactggtggctgcaccatctgtcttcatctcccgctatctgacacgagagtactgagcgggctggcgaaggcgcatagnnnnnnnnnnnnn

SEQ ID NO: 36858 - DNA, 620 bp, Homo sapiens
  misc_feature: GYAE6OF01A6R29.19.10.A10.1.454.CMB.1.raw
  modified_base (196)..(196): a, c, t, g, unknown or other
  misc_feature (196)..(196): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaanacgccaccctctcctgcagggccataagagtgttgacagctaccttctttgcctggtaccagcagacgacctggccaggcctcccgaggcctccgtcgtttatggtcgaccgtccaccgacgggccacgtcggcactccccgatagttcagtcgcagtgtgtctgggacngacttcactcgtacaccntcagcagacgtggactccgtagaagtgtttacgctagttgtaacttacgtgtacgtaaacgtattagtgagttacgacgttccaccgttacggtggtacgtacttaggtttcggacccggtaggggtaaccctaagggttacgaaacggttaaccgaaaacggttacgtcgggtacggtacctacggacctaaacccgtgttaccgttcgttaccgtttaccaccgtttacccccg

SEQ ID NO: 36859 - DNA, 566 bp, Homo sapiens
  misc_feature: GYAE6OF01BCYU8.19.10.A10.1.454.CMB.1.raw
  modified_base (334)..(334): a, c, t, g, unknown or other
  misc_feature (334)..(334): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggcctcccaggtcctccttcgtttatggtgcgtccaccgagggccacgtggccactccccganaggttcagtggcagtgtgtctgggacagacttcactctcacatcagcagcgtggagccgtagaagtattttgactagttgtattactgtacaacgtatatgatgagtcaccgtcggtggtgtactagttcggacgtagggtaccgtaagggttaggaaacgtaccgaaacggtacgttaggtacgggctacgacctaaccgtacgttcgttagtccttaccgtcgttccccg

SEQ ID NO: 36860 - DNA, 595 bp, Homo sapiens
  misc_feature: GYAE6OF01C520A.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctgggagtgggttggccgcatcgaaagaggagatagtgaaggggaggcgacagactacgctgcacccgtgagaggcagatttaccatgtcaagagatgattcaacaaagtacagtagtatctagactaaatgaaacagacctagaacgaccgagaacacagccaatttacctattagtaacaaagttgaaaagttacggtaggggggaaacgggggtaaaaagttcgggggaacccgtaaggggaaaccccgttgggtacccgttccggttacccg

SEQ ID NO: 36861 - DNA, 590 bp, Homo sapiens
  misc_feature: GYAE6OF01BXCZM.19.10.A10.1.454.CMB.1.raw
  modified_base (453)..(453): a, c, t, g, unknown or other
  misc_feature (453)..(453): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccagcccggggggtccctgagactctcctgtagaagttatggattcaacttcgctagcggctggctgtgctgggtcgccaggctccgaggggaggggctgggagtgggttggccgcatcaagaggagatagtggaaggggaggcgacagactacgctgcaccgtgagaggcagatttaccatgtcaagagatgattcaacaaagtacagtgtatctagacaaatcgaacngcctaggaacgaccgaggaccacgagcctaatttactattagaacaaagtgtaaagttacggtaggggggaaaccgggggtaaaagttcggggggaaccctaacgggggaaaccccttggggtcccgttccggtccg

SEQ ID NO: 36862 - DNA, 583 bp, Homo sapiens
  misc_feature: GYAE6OF01DXN15.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcgccaggctccgaggggaggggctggagtgggttggccgcatcgaagaggagatagtggaaggggaggcgacgagactacgctgccacccggtgagaggcagtatttaccatgtacaaagagatgaattacaacaaagtacagttagtatctagacaaatgaacagcctagaacgaccgagacacgagcctaatttactattataaacaagtagaaatacgggtagggggaaacggggtaaattcgggggaccaacggggacccgttggtccgtccggtaccg

SEQ ID NO: 36863 - DNA, 671 bp, Homo sapiens
  misc_feature: GYAE6OF01BLY8J.19.10.A10.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (432)..(432): a, c, t, g, unknown or other
  misc_feature (432)..(432): n is a, c, g, or t
tcagtactctcgtgcacgaccggtgctcgatttagcgtcgatctcgaggggggagaagagctgctcagttaggacccagagggaaccatggaaaccccagcgcagcttctcttcctcctgctactctggcctcccagataccactggagaaatagtgatgacgcagtctccagcccacctgtctgtgtctcgagggaancgccacctctccngcagggccagtcagngtgtagcagacaacttacgcctaggtaccagaccaacgaaaccgtggaccacggtccctacccgaggtcccttaccgtctaactccgtagtcggtcgacctactcccgaaccggcgggcctacgtcggtactcccgaggtccgtaggttcgaggtcggacgtagggtgggtactggggtactagtacgttcactctacgacctancgacgtcgtacgtcccgtagacgtagtacgtaggttaagttgttttcgactttaacggttttattacgttaggtacctagtacgtaaacgtttaagtaaacgttacgtacggtaccttacgtaccgggtttacgggttccgggaacggggtaaacggacgggtaaagggtcgtaaacggtataacccggaaaagttccgtagggtacgtcgttacgaccttaacggtcttccggtttag

SEQ ID NO: 36864 - DNA, 595 bp, Homo sapiens
  misc_feature: GYAE6OF01CXFJQ.19.10.A10.1.454.CMB.1.raw
  modified_base (379)..(379): a, c, t, g, unknown or other
  misc_feature (379)..(379): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagtcaccctctcctgcagggccgataagagtgttgacagcaccttctttgcctggtaccagcagagacctggccaggcctcccgaggctcctcgtttatggtgcgtccaccgagggcccacgtcggccacgtccccgactaggttcaggtggcagtgtgtctgggacagacttcactctcacntcagcagactggagccgtagaagtatttgctagtagttattacgtgtacaacgtatatagtatgtacgtctaccgtcggtggttacggtacgttagtttacggaccggtacgggggtaaccgtaaagggttacggtaaacggttacgaaaacggtaacgtggttacggacgtcggacctaacccgtattccgttagttaccttcgtacgttccccg

SEQ ID NO: 36865 - DNA, 536 bp, Homo sapiens
  misc_feature: GYAE6OF01BCVER.19.10.A10.1.454.CMB.1.raw
  modified_base (516)..(516): a, c, t, g, unknown or other
  misc_feature (516)..(516): n is a, c, g, or t
  modified_base (530)..(530): a, c, t, g, unknown or other
  misc_feature (530)..(530): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttcttgcctggtaccagcagagacctggccaggcctcccaggctcctcgtttatggtgcgtccaccgagggcccacgtggccacgtccccgacaggttcaggtggcagtgtgtcgtgggacagtacttcactctcacatcagcagactggacgctagaagtatttgactagtgtattactgtacaacgtatatgtatgagtcaccgtcggtggtggtactagttcggccgaggggacctaaggttagaacgtacgaaacgtacgtgtggctgcactnttactgtcttcgtnttcccg

SEQ ID NO: 36866 - DNA, 692 bp, Homo sapiens
  misc_feature: GYAE6OF01BRLMP.19.10.A10.1.454.CMB.1.raw
  modified_base (196)..(196): a, c, t, g, unknown or other
  misc_feature (196)..(196): n is a, c, g, or t
  modified_base (429)..(429): a, c, t, g, unknown or other
  misc_feature (429)..(429): n is a, c, g, or t
  modified_base (672)..(672): a, c, t, g, unknown or other
  misc_feature (672)..(672): n is a, c, g, or t
tcagtactctcgtgcacgaccggtgctcgatttagcgtcgatctcgagggggaagagctgctcagttaggacccagagggaaccatggaaaccccagcgcagcttctcttcctcctgctactctggctcccagatagcaccggagaaattttctgacgcagtctccaggcaccctgtctttcgacccctggggaanacgccaccctctcctgccacgggccataagagtgttgacagctacctttcttcgccttggtaccagcagacgacctggccaggcctcccgaggtcctccgttacgtttagtcgggtcgccgtccaccgtacgggcccacgtcggccaccgtccccggatacgggtttccaggttcggccgtaggttcgtacggttcgtggggactacggtcttccaccgttctaccaaccgtntaccgaggtaccaaggtaccgttggtacgccgtagtaacgttagttttcgacgtaggttacgttaacgtttaccgtacggttacctaaacgtacttagtagtacgttacgtacgtaccgtaccgttcggttacgggtacggtacgtacggtttcggaccggtacgggtaaccgtaagggttaacgaacgtaaccgtaaacggtacgtaggtacggtcgtacgaccgtaaccgtacttacgttnttaccttcgtcgttaccccg

SEQ ID NO: 36867 - DNA, 598 bp, Homo sapiens
  misc_feature: GYAE6OF01DMU3R.19.10.A10.1.454.CMB.1.raw
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagtaaattttcttgacgcagtctccaggcaccctgtctttgacccctggggaaagacgccaccctctcctgcgagggccgataagagtgttgacagctaccttcttgcctggtaccagcagacgaccgtggccaggcctcccgaggccttccgtcgtttagcggttcgcgtcccaccgaggggcccacgtgggccaccgtccccgacgtacggttcaggtcggctaggtgtgtcgtgggactagactcactctcacatcagcagacgtaggacgtacgtagtaagttagtttagcgtagttgttaatactagtactaacgtatagtagtagtagtacgtctaccgttcggttaggtcgtacgtaggtttcggaccggtagggaacgtaaggtagaacgtacgaaacggtacgtgtacggtctagaccacgtactctagttccttcgtacgttcccg

SEQ ID NO: 36868 - DNA, 611 bp, Homo sapiens
  misc_feature: GYAE6OF01ED0ZB.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagtttggatttttcctttctgcttattttaaaaggtgtcctgtgtgaggtgcgcctggtggagtcgtgggggaggcgtgggtccaggcccggggggtccctgagactctcctgtagaagttatggattcaacttcgctagcggctggctgtgctgggttcgccaggctccgaggggaagggcgtgggaggtggggttcggccgcatcgaaaggaggagatagtggaagggggagcgacagactacgctgccaccgtgagaggcagtattaccatgaacagagatagatacaataaagtacagtactatcgagacaaatacgaactacgaccgtaggaacgaccggaggaaccagacgtaccttaattaactatttacgaactaaagtagtaagttaacggggaggggggaaaaccggggtaaggtacggggaccgtaaacggggacccgtacggtccgtccggtcg

SEQ ID NO: 36869 - DNA, 646 bp, Homo sapiens
  misc_feature: GYAE6OF01CLHAV.19.10.A10.1.454.CMB.1.raw
tcagtactctcgtgcacgaccggtgctcgatttagcgtcgatctcagggggaagagctgctcagttaggacccagagggaaccatggaaaccccagcgcagcttctcttcctcctgctactctggctccaagatagcaccggagaaattttcttgacgcagtctccaggcaccctgtctttgacccctgggaaagagccaccctctcctgcagggccgataagagtgttgacagctaccttctttgcctggtaccagcagagacctggccaggcctcccgaggctcctcgttatggtcgccgtccaccgagggccacgtcgcacgtccccgataggttcagtggcaggtgtgtcgtgggacagtacttcactctcaccatcagacagacgtggacgtactagaagtagttttagacctaagttagttaactttacgtagtacctaagtaattacgtagaagtacgtaacgttccgtaacccgttaccggttacgggtacggtaaccgttagtttaccgggtaccggtacggggtaacccgtaagggttaggaaacggtaccgtaaaacgggtaaaccgttaggtacggtaccgttacgaccgtaacccgtattaccgttacgttaccgtttccgtacgttaccccg

SEQ ID NO: 36870 - DNA, 611 bp, Homo sapiens
  misc_feature: GYAE6OF01BH5QI.19.10.A10.1.454.CMB.1.raw
  modified_base (464)..(464): a, c, t, g, unknown or other
  misc_feature (464)..(464): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggtcgccaggctccgaggggaaggggctgggaggtggggttggccgcatcaaggaggagatagtggaaggggaggcgacagactacgctgccacccgtgagaggcagtatttaccattgacaaagagatgaattcaactaaagtacagttgtaactctagactaaagtnaaacaggacctaggaacgaccggaggaacacgacgacctaatttacctagttagaaactaaagtggaaattacgggtaggggggaaaccgggggtaaaagttcggggggaaccctaacggggtaaccctgggttcccgtccggtccg

SEQ ID NO: 36871 - DNA, 645 bp, Homo sapiens
  misc_feature: GYAE6OF01C4L2O.19.10.A10.1.454.CMB.1.raw
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctccagatagcaccggagtaaattttctgacgcagtctccaggcaccctgtctttgaccccgtggggaaagacgccaccctctcctgcagggccgataagagtgttgacagcaccttcttgcctggaccagcagagaccgtggccaggcctcccacggtctccgttcgtttatggttcgcgtccgaccgacgggcccacgtcggccaccgtcccggactacggttcagtcggctagtgtcgtgtagggactaggtaccttcactctccaactatcagacagaccgtggacnccgtagaacgttnttttagactacgttagttaactttacgtgtacgtaaacgtatacgtgtaatacgacgttacctacccgttacgggttcggtggtacttaggtttacgggaccggtacggggtaaccgttaacgggttaagaaacggttacgaaaaccggtaacgttaggacggtcctacggtaaccaccgtaacttacgtagtttaccttccgttactttaccccg

SEQ ID NO: 36872 - DNA, 798 bp, Homo sapiens
  misc_feature: GYAE6OF01BRIQM.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttagtatttttcctttctgtcttaattttaaaaggtgtacctgtgtgaggtgcgccgtggtggagtcgtgggggaggcggtggtccgacggccccggggggtcctgacgtacctctccgtagtagtaagttatggtatcaacttcgctagcggctggctggtgcgtgggtccgccgaggctaccggaggggaggggcgtgggtaggtgggtcggccgcagtacgaaaggaggagagtagtagggaaggggacggacgaacgacggtaacgtacgcgtaccgaccgtaacccggtaggaacggacggaccgtaagtaaccgtttaaccgaagttacggtaacgaaggtaagtatacggtattaacaaacgtaaagtactaggttagtatacgtagtaacaaagtacgaaacagtaccgtaacggaacgacccgggaaggaacctaacgtccggaaccctttaagttttaaacccgttagttaaacccgttaaaacgtaaaagtttaaccgggaaaggtttaaaccgggggtaaccggggggggggtaaaaaccgggggttaaaaacgggtttaccccgggggggaaacccggttaaacccgggggtaacccggttttaccgggggttacccccgttcccgggttaaccccgg

SEQ ID NO: 36873 - DNA, 621 bp, Homo sapiens
  misc_feature: GYAE6OF01C3LU0.19.10.A10.1.454.CMB.1.raw
  modified_base (203)..(203): a, c, t, g, unknown or other
  misc_feature (203)..(203): n is a, c, g, or t
  modified_base (593)..(593): a, c, t, g, unknown or other
  misc_feature (593)..(593): n is a, c, g, or t
  modified_base (596)..(596): a, c, t, g, unknown or other
  misc_feature (596)..(596): n is a, c, g, or t
  modified_base (598)..(621): a, c, t, g, unknown or other
  misc_feature (598)..(621): n is a, c, g, or t
tcagtactctcgtgcacgaccggtgctcgatttagcgtcgatctcagggggggagaagagctgctcagttaggacccagagggaaccatggaaaccccagcgcagcttctcttcctcctgctactctggctccagatagcaccggagtaaattttcttgacgcagtctccaggcaccctgtcttgaccatggcactccccganggttcagtggctagtgtgtcgtgggacagtaccttcactctaccaccatcagccagactggacgcctagagtatttgctagtgttattactgtacgagacgtagtagtaggtaacgtttcaacctttcgttacggttccggtttaccgggaccggtaaacgggtaaccggtaaagggtaaacgtaaaagttaacggaaaacggtaacgttcggtagggtacgtacgacgtaaacctagttccgtttggttacccttacgttaacccttcccgtttaccccggactctttaccgtaaggaacctaaaccgggtagtaaaccggttacgtacgggtaaccggggtcgggtaccgtagggtaaccggaacgggcccgtaagtaagttaacggntgngnnnnnnnnnnnnnnnnnnnnnnnn

SEQ ID NO: 36874 - DNA, 662 bp, Homo sapiens
  misc_feature: GYAE6OF01AQX91.19.10.A10.1.454.CMB.1.raw
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgaccccgtggggaagagcccaccctctcctgcagggccataagagtgttgacagctacctttctttgcctcggtaccagcagacgacctgggccacggcctcccgaggtccttcccgttcgtttagtcgggttcgcccgttcccgaccgtacgggccctaccgtggcctactcccccggaatacggttcaggttcggcctaggttgtcggtcgtggggtacagtaccttccgaaccttcaccacctactcgacggacacggtacgtggacgtccgtagtaacgttagttttacgacgttacggttagttagtttaaccgtgtactaacgtagttagtagtagtgacgttaccgtacccgttcggtcggtacgtacgttacggttacggaccggtacgggaacgttagggtacgaaacggtacgaaacggtacgtggtacggtcgtacgacctacgtacgttctcgttacttcgtcttcccg

SEQ ID NO: 36875 - DNA, 597 bp, Homo sapiens
  misc_feature: GYAE6OF01BILZ9.19.10.A10.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (310)..(310): a, c, t, g, unknown or other
  misc_feature (310)..(310): n is a, c, g, or t
  modified_base (333)..(333): a, c, t, g, unknown or other
  misc_feature (333)..(333): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccataagngtgtgacagcaccttcttgcctggtaccagcagagacctggccaggcctcccgaggcctcctcgtttagtggtcgccgtccaccgngggccacgtggccactccccganaggttcaggtggcagtgtgtcgtgggacaggtccttcactctcacatcgagcagtactggactccgtagagtatttcgacgtagtgttacttacgtacgtacgtaacgtatagtgtagtgacgtactaccgtacggtggtacgtagtgttacggaccggtagggtaaccgtaagggttacgaaacgtaccgtaaaacggtacgttaggtcggtaccgtacgtacccgaacgtacgtacgttacgttccttactaccgttccccg

SEQ ID NO: 36876 - DNA, 639 bp, Homo sapiens
  misc_feature: GYAE6OF01BWY4C.19.10.A10.1.454.CMB.1.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
  modified_base (436)..(436): a, c, t, g, unknown or other
  misc_feature (436)..(436): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttctgacgcagtctccaggcaccctgtctttgacccctggggaaanagcccaccctctcctgcagggccagtaagagtgttagacagctacctttctttgcctggtaccagcagacgacctggaccaggcctcccgaggcctccttcgtttancggtcgccgtaccgaccgtagggcccacgttcgggcctacgtcccccggagtacgggtttccagggttcggactaggttgtcggtcgtaggggacaggtaccttcactctacacctatccagcagacgtggacnccgtagaagttgtttagactagttgtattacgtgtaactaagtatagtgtagtgacgtctaccgtcgtggtacgtacttaggtttacgggaccggtagggtaacctaagggttacgtaaacgtaaccgaaaacggtacgttaggtacggtccgtacggaccctacgtacgttaccgttaggttaccttccgtaccttccccgg

SEQ ID NO: 36877 - DNA, 799 bp, Homo sapiens
  misc_feature: GYAE6OF01EK8VP.19.10.A10.1.454.CMB.1.raw
  modified_base (308)..(308): a, c, t, g, unknown or other
  misc_feature (308)..(308): n is a, c, g, or t
tcagtactctcgtgcacgaccggtgctcgatttagcgtcgatctcaggggagctctgggagaggagtcccagccttggggttcccgagttgttttcgttcagtgatcaggactgaacacgtaggactcaccatggagtttggcctgagttggtattttcctttctgtcttaattttaaaaggtgtctgtgtgaggtgcgccgtggtggagtcggtgggggaggcggtcggtccgacgggccccggggggtccctggacgaccttcctccgttgtaagtaagttagtggattcaacttcgactaggcgngtggctgtgtcgtggtccgcgacggccgtccggaggggagggcgtgggtaggttggggtcgccgacagtacgaaggaggaagagttaggacgggaaggggacgacgaacgaagacgtacgctacggacccgtaccggtggacggacgtacgaacgttactttaaccgagttacggtaacgaaaggtagtaagttacgtaactaaaccgtaaacgaaaacggtttaccgtaaaggttacgttaacgttaccgtaaggtaacctaaaacggtaacgaaaccgaacggtaccgtaaggaaaccggtaccggaaacggaacctaacgacgttaaccttaacgtttaaacgtacgtttaaacgaaacgttaaagtaaacgggttaaacggttaacgggggtaaacggggggaaaacgggggttaaaggttacccgggggtaaaccgggtaaacgggttaaccccggttacgggttaccccgtccggttaaccccgg

SEQ ID NO: 36878 - DNA, 1000 bp, Homo sapiens
  misc_feature: GYAE6OF01DWESU.19.10.A10.1.454.CMB.1.raw
tcagtactctcgtgcacgaccggtgctcgatttagcgtcgatctcgagggggaagagctgctcagttaggacccagagggaaccatacggaaaccccagcgcacgtcttcctccttccctcctgcctactcgtcggcctcccaagatacgaccgaaccgggtaattaaactttttcgttggaaccgctacggttcctacccgacggccctacccgttgtttccgtttaccggaaccccggtagggggaaacgccgacccctaccctcctccgtcggaccggaacggggaccgtaagttaaggtacgttaggttacgaacctacgtaccctttaccgtttccgttcgtccgttacggtaaccgacgaccggtaacggaccgtaccggtcggacccgtaccggtccctacccggtacgttccgtttaccgtttacggttttacggtccgggttccggttaccccggtaaccggaacccgggtaccgggtacccgtaccggtacccgggtacccgtaaccccgtaccccgggtaacggttaccgggtttaccggtacggggttacgggtccggttagggtttcggttacggggtaccggtaacggggtacctaaccggttacccttacctacccgtaccctaccgtaaccgtaccgtacggaaccgtaccggtaacggtaccgggttacggaaccgttacggttaaggttaacgtttcgtttaacgacgtttagttacggttaactttaccggaacttacgtaaacgttgttacgtaagtcggttaaccggtaccgttacccggttaccgggtttagggtaaccggttacgggtaaccgtttaccggggtacggggaaaccgggtaacgggtaaacgttaagggtaacctaaaccggtaaaaccggttaggttaccggtaggttaccggtaccgtaccgttaaccccgtacgtttcggtttcccgttaaccgttttccgtaaccccttccggttaacccccgg

SEQ ID NO: 36879 - DNA, 811 bp, Homo sapiens
  misc_feature: GYAE6OF01AITTY.19.10.A10.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagtactctcgtgcacgaccggtgctcgatttagcgtcgatctcagggagctctgggagaggagtcccagccttgggttcccgagttgttttcgttcagtgatcaggactgaacacgtagactcaccatggagtttggcctgagttggtattttcctttctgtcttaattttaaaggtgtcctgtgtgagtgcgcgtgtgngtgtggggaggcgtggtccgacggcccggggtccngacgactctctagtagtagttagtgtattctaacttcgctacggcggtcgtcggtcgtgtcggtcgttcgggttccgccgtacgggccgtaccggagggggtaacggggtcgtaggggtcgggttacggggttcgggcccgacgtaagtacggaaaggtacggaggtaacgtaggtaggaacggggaggacgacgaaggtaccgtacgtacgtcgaccgtaccggtagacggacggtacgtaacgttaacttaaccgtaagttacgtaacgaaggtacgtaacgttagtaacgtttaacgaaacgttaaagtaccgttagttacgtacgttacgttaaggaactaaacgttaagaaacccgttagaccgttaagggaaaccgacccggtaaaggaccctaacggacgttaaccttaaagttttacgttaagttaacgtaaagtttaaaacggaacggttaaacggtacgggggttaaaacgggggggtaaacggggttaaacggttaacgggggaaccccgggttaaccggggtaaacccgttttccggggaacccgtttcccgggttaacccg

SEQ ID NO: 36880 - DNA, 727 bp, Homo sapiens
  misc_feature: GYAE6OF01CB8IV.19.10.A10.1.454.CMB.1.raw
  modified_base (196)..(196): a, c, t, g, unknown or other
  misc_feature (196)..(196): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctgctccagatagcaccggagtaattttctgacgctagtctcgacggcaccttgttcttcggacccgtagggaanacgcccacctctccgtgcgacggaccagtaagagtgttagacacgccgttaccttcgttacgccgtggtaccaggacgagacgaccgtcggccacggcctaccgagtccttccgttcggtttagtcggtccgtaccgtacccgacggaccgggtcctaccggtcgcccgaaccgtccccggtaacgtacggttacccgagggtccggtacgtacggttcggtcgtacggtacgggacctaacgttacttacgtaccgtaccgtaacacccgtagtacgacgaccgacgttacccgaggacgtacgtaagtaaggtttacttagacgttacggtagtttacttaacggtactagaaacgttgtaacgtacgtggtaactacgtacgtacggttcggtagtacgggtacctaggtacccggtacgggacggtaaccgttaagggttaacaaacgggttaaccaaacgggttagtacggtaccggattacggaaccttacgtacgttccttaacgttcgttacctacgtccccg

SEQ ID NO: 36881 - DNA, 680 bp, Homo sapiens
  misc_feature: GYAE6OF01AOPLH.19.10.A10.1.454.CMB.1.raw
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
tcagtactctcgtgcacgaccggtgctcgatttagcgtcgatctcaggggagctctgggagaggagtcccagccttggggttcccgagttgttttcgttcagtgatcaggactgaacacgtaggactcaccatggagtttggcctgagttggtattttccttctgtcttattttaaaaggtgtcctgtgtgaggtgcgcctggtggagtcgtgggggaggcgtggtccaggcccgggggtcctgagacgtctccgtgtagaagttatggattcaacttcgctagcggctggctgtgcgtggtcncgagctccgagggagggtctagggagtggttcggaccgntagtcgaaggtaggagatacgtaggaagggagacgacagacgtacgctacgctaccggtgtacgacggacagtacgtttaacgacgtttacgacaaaggtacgatttaccgggtaactttaacgaagttaaaacgtacgtaggttacgttaaacgtcccgttagaaccttaaagttacggaaacctacggtacctaagggaaaccgaaccgtacgaacgacctaggacccttaattttaacatttacgaaactaaaggtcgtaaagtcgggtaagggggaaaccggggtaaattcccggggacgtaaacgggtacccgttggtcccggtcgtacccg

SEQ ID NO: 36882 - DNA, 628 bp, Homo sapiens
  misc_feature: GYAE6OF01C5DCP.19.10.A10.1.454.CMB.1.raw
  modified_base (184)..(184): a, c, t, g, unknown or other
  misc_feature (184)..(184): n is a, c, g, or t
  modified_base (275)..(275): a, c, t, g, unknown or other
  misc_feature (275)..(275): n is a, c, g, or t
  modified_base (456)..(456): a, c, t, g, unknown or other
  misc_feature (456)..(456): n is a, c, g, or t
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (554)..(554): a, c, t, g, unknown or other
  misc_feature (554)..(554): n is a, c, g, or t
tcagtactctcgtgcacgaccggtgctcgatttagcgtcgatctcaggggagctctgggagaggagtcccagccttggggttcccgagttgttttcgttcagtgatcaggactgaacacgtagactcacatggagtttggctgagttggtattttccttctgcttatttaaagtgtctgtgtgngtgcgctggtggagtgtgggggaggtcggtggtccgacggcccgggggtcctgacgacgtctccgtgtagaagttatgtatcaacgttcgntagcgcgtggctgtgcgtggtcgcgtcggctcggagggagggtcgtagggtaggtgggtcgccggtacgagtacgaaggaggagtagtaggtacggaaggggaggacgaagaacggactacggctcggaccgtaccgtagagacggtacgaagtaacgttactagtacggaataagaagtnagtactagaaacgtaaatacaaggtntagacctanaanagtagaacctggaacgtagaacgaacgaagactagaactacttaattactaatacgtaanaaacgtgtaaacggtacgggtaagggggaaccgggtaagtacgggaccgtaacgggacgtcgtccggccgttac

SEQ ID NO: 36883 - DNA, 717 bp, Homo sapiens
  misc_feature: GYAE6OF01AD1ES.19.10.A10.1.454.CMB.1.raw
tcagtactctcgtgcacgaccggtgctcgatttagcgtcgatctcaggggagctctgggagaggagtcccagccttgggttcccgagtgttttcgttcagtgatcaggactgaacacgtaggactcaccatggtagtttggcctgagttggtattttccttttctgtcttaattttaaaaggtgtcctgtgtgaggtgcgccgtggtggagtcgtgggggaggcgtcggtccgacggcccgggggtccctggagtacctctcgtgtagtaagttatggtattcaacttcgctaggcggcgtggtctggtgcgttcgggtcgccgaggccgtccgaaggggaacggggcgtagggaggttcgggttggccgtcatacgaaggacggagaagtagtagggaaggggacggacgaacgaagaactaccgctcgaccgaccggtacggagacggactaagttaacttaaccagtacgtacaaaggatagtagtaacttaccaaagtaaacgtacgtacgttattacgctaggtaactaacgtacgaaacgacgtaccgtaacggaacggaacgtaacggaacctacgtaacgtaccttaaatttacgaggtttaactaaaacgtaaagtacggtaaaggttaaccggggtagggggggaaaaaccgggttaaaggttccgggggaacctaaaccggggtccttcggtacgtccccggttag

SEQ ID NO: 36884 - DNA, 721 bp, Homo sapiens
  misc_feature: GYAE6OF01ET3ES.19.10.A10.1.454.CMB.1.raw
  modified_base (220)..(220): a, c, t, g, unknown or other
  misc_feature (220)..(220): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggtattttcctttctgtctaattttaaaaggtgttcctgtgtgaggtgcgcctgggtggagtcgtgggggnggcggtggtccgacgggccccggggggtccctgacgtactcctcctgtaagaagttataggattcacttcgctagcggctggctggngcgtggtcgccgaggctcgagggacggcgnggnggtcggtggccgcagtacgaaggaggagagtagagggaaggggtacggacgaacgtaggacctacggcgtacgacccgtacccggtaggaacgacggtacgtaaggtaaccgtttacagtacgtaacgaagtaagtacgtacgttaacgttaaaccgtaacgtaaacgaatttaccgtaaagttcgttaagacctaaaggtacgaaaaccttaggaaccccttaaggaaaccgtaccggaaagggtaacccgaacggaacgacccaagttaccctaatttacgtaaactaaagtacgtaaaagttacgtaaggggtaacggggtaaagggtaacggggggaaactacgggggacccaagggtacccgttcggtcgtcccgg

SEQ ID NO: 36885 - DNA, 604 bp, Homo sapiens
  misc_feature: GYAE6OF01CXRP2.19.10.A10.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (585)..(587): a, c, t, g, unknown or other
  misc_feature (585)..(587): n is a, c, g, or t
  modified_base (589)..(589): a, c, t, g, unknown or other
  misc_feature (589)..(589): n is a, c, g, or t
  modified_base (592)..(604): a, c, t, g, unknown or other
  misc_feature (592)..(604): n is a, c, g, or t
tcagtactctcgtgcacgaccggtgctcgatttagcgtcgatctcagggggggagaagagctgctcagttaggacccagagggaaccatggaaaccccagcgcagcttctcttcctcctgctactctggctcccagatacgcaccggagtaaatttttctgacgcagtctccaggcaccctgtctttgaccagtggcactccccgataggttcagtcggctagtgtgtcgtgggacagtactcactctcacntcagcagacgtggacncgtagaagtnttttgacgtagttcgttattacgtgtacaacgtntatagattcgagtcctaccgttcggtggtacggtactacggttacggaccggaagggtaaccgtaagggttacggaaaacgtacgaaacggttaacgtggttacggacctacggacctaaccgtattccgttgttaccttacgtacctttcccgttaccccgacttacgttcgacgaacccgtacggtacgtaaccggttacggacggaccgggtacggtcggtacgaaaccgggtcggtaacgtcgtaaagtgggacncgtgngngagtcgnnngngcnnnnnnnnnnnnn

SEQ ID NO: 36886 - DNA, 633 bp, Homo sapiens
  misc_feature: GYAE6OF01BZ6BE.19.10.A10.1.454.CMB.1.raw
  modified_base (308)..(308): a, c, t, g, unknown or other
  misc_feature (308)..(308): n is a, c, g, or t
  modified_base (606)..(608): a, c, t, g, unknown or other
  misc_feature (606)..(608): n is a, c, g, or t
  modified_base (610)..(612): a, c, t, g, unknown or other
  misc_feature (610)..(612): n is a, c, g, or t
  modified_base (614)..(615): a, c, t, g, unknown or other
  misc_feature (614)..(615): n is a, c, g, or t
  modified_base (617)..(618): a, c, t, g, unknown or other
  misc_feature (617)..(618): n is a, c, g, or t
  modified_base (620)..(633): a, c, t, g, unknown or other
  misc_feature (620)..(633): n is a, c, g, or t
tcagtactctcgtgcacgaccggtgctcgatttagcgtcgatctcagggggggagaagagctgctcagttaggacccagagggaaccatggaaaccccagcgcagcttctcttcctcctgctactctggctccagatagcaccggagtaaattttctgacgcagtctccaggccaccctgttctttgacccactcggcacgtcccccgataggtttcaggtggctaggtgtgtcgtgggacagtaccttcacctctcgaccatcacgcaggacgtggacgcctaggtaattattttcgacgttagttnttaacttacgtcgtaacgaaacgtattagtacgtagtcggtacgtacctaacccggttcggtaggtacggtactacggtttacggacccggtaacgggtaaccgtaaaggggttacgaaacgttaacgaaaccggtaacgttcggtagggtctaagcccgtaacgtaacgttcgttcttacccgttctacctttccccgtaccccgtataaccttccgtacgaacgtaccggaaggttacgtacgggtcggaacgggcccgggtagaccggggtacacgggtcccgacgttaagcgannnannngnngnngnnnnnnnnnnnnnn

SEQ ID NO: 36887 - DNA, 870 bp, Homo sapiens
  misc_feature: GYAE6OF01BJAUW.19.10.A10.1.454.CMB.1.raw
  modified_base (182)..(182): a, c, t, g, unknown or other
  misc_feature (182)..(182): n is a, c, g, or t
  modified_base (239)..(239): a, c, t, g, unknown or other
  misc_feature (239)..(239): n is a, c, g, or t
tcagtactctcgtgcacgaccggtgctcgatttagcgtcgatctcgagggagctcgtgggagaggacgtcccagtccgtttcgggttcccgtagtttgtttttcgttcgagtgatcgagactagaacgacgtaggacctcaccgagtggtagtttcggctgtagtttgttctttttcctttntgtactttaagttttaaagtgttctgtgtgagtgcgtcgtggtggtgtcggtggggnggtcggtcggtccggccgggtcccggggtccgtgacgtaccttcgtcgtagtaagtaagttagtagttacttacgtacgttcgcgtacggcgtcgtggtcgtggtcgtcggttccggtccgaccgtacggtaccggtaccgggaggggagggtggttagggttacgggttcgggtccggccgtacgtaacgtaacggaaggaaggaagtaagtaagggaagggaacgggacggacgaacgacgtaacgccgacgtacgaccgacggaggaacggacggtaacgtaacgttaacctttacgagttacgaagtaaagtagtaattaacgtaaataaacgtaaacgtaagtacgttagttacgttacgttaacgtaagtaactaacgtaaccgaacgtaccgtaaccgggaaaccgaaccgggtaacccgtaaacgttaaccgaaccttaaccgtttaacgtttaacgttttaaacgttaacgttaaacgtaaaacgttaaaggtttaaccgggtaaacgggggttaaacgggggtaaacggggggttaaaacgggttaaacccggggttaccccgggaaacccgggtttacccgggttaacccggtttccggttcccccggttaccgtacccg

SEQ ID NO: 36888 - DNA, 361 bp, Homo sapiens
  misc_feature: GYAE6OF02I7GR2.19.10.A10.1.454.CMB.1.raw
  modified_base (358)..(361): a, c, t, g, unknown or other
  misc_feature (358)..(361): n is a, c, g, or t
tcagtactctcgtgcacgaccggtgctcgatttagcgtcgatctcaggggtccgggagatcatgagggtgtccttgggttttgggggaagaggaagactgacggtcctgccacaggtggtgctgggcacggtgggcactcgacacatccatttactattgtacaaatgaatactggggacgggggaaattggggccagggaaccctggtctccgtctcgtcagcctccaccaagggcccatcggtcttcccctggcgccctgctccaggagcacctccgagagcacagccggccctgggctgcctggtcaaggactacttcccacgagagtactgagcgggctggcaaggcgcatagnnnn

SEQ ID NO: 36889 - DNA, 495 bp, Homo sapiens
  misc_feature: GYAE6OF02F97V6.19.10.A10.1.454.CMB.1.raw
  modified_base (324)..(324): a, c, t, g, unknown or other
  misc_feature (324)..(324): n is a, c, g, or t
tcagtactctcgtgcacgaccggtgctcgatttagcgtcgatctcaggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgttatggtgcgtccaccagggccactggcatccccganaggttcagtggcagtgtgtctgggacagacttcactctcaccatcagcagactggagcctgaagatttgcagtgtattactgtcaacgatatgatgagtcacctcgtgtgactagtttggccagggaccaggttgagtcaacgaactgtggctgcacatctgtcttcatcc

SEQ ID NO: 36890 - DNA, 443 bp, Homo sapiens
  misc_feature: GYAE6OF02GUWA1.19.10.A10.1.454.CMB.1.raw
  modified_base (204)..(204): a, c, t, g, unknown or other
  misc_feature (204)..(204): n is a, c, g, or t
  modified_base (431)..(443): a, c, t, g, unknown or other
  misc_feature (431)..(443): n is a, c, g, or t
tcagtactctcgtgcacgaccggtgctcgatttagcgtcgatctcagggggggagaagagctgctcagttaggacccagagggaaccatggaaaccccagcgcagcttctcttcctcctgctactctggctcccagatagcaccggagaaattttcttgacgcagtctccaggcaccctgtctttgaccactggcatccccganaggttcagtggcagtgtgtctgggacagacttcactctcaccatcagcagactggagcctgaagattttgcagtgtattactgtcaacgatatgatgagtcacctcgtggtggacatttggccagggaccaaggttgaagtacaaacgaactgtaggctgcacatctgtcttcatcctccgccatctgacacgagagtactgagcgggctggcaaggcgacagtagnnnnnnnnnnnnn

SEQ ID NO: 36891 - DNA, 390 bp, Homo sapiens
  misc_feature: GYAE6OF02JE3HP.19.10.A10.1.454.CMB.1.raw
  modified_base (365)..(390): a, c, t, g, unknown or other
  misc_feature (365)..(390): n is a, c, g, or t
tcagtactctcgtgcacgaccggtgctcgatttagcgtcgatctcagggggttccggggagatcatgagggtggtccttgggttttggggggaagaggaagactgacgggtccctgcccacaggtggtcgctgggcacggtgggcactcgacacatccatttactattgtacaaatgaatactggggacgggggaaaattgggccagggaaccctggtctccgtctcgtcagcctccaccaagggcccatcggtcttcccctggcgccctgctccaggagcacctccgagagcacagcggccctgggctgcctggtcaaggctactcccgacgagagtactgagcgggctggcaaggcgcatagnnnnnnnnnnnnnnnnnnnnnnnnnn

SEQ ID NO: 36892 - DNA, 540 bp, Homo sapiens
  misc_feature: GYAE6OF02GKGDJ.19.10.A10.1.454.CMB.1.raw
tcagtactctcgtgcacgaccggtgctcgatttagcgtcgatctcaggggagctctgggagaggagtcccagccttggggttcccgagtgtttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcaccgtgagaggcagatttaccatgtcaagagatgattcacaaagtacagtgtatctgcaaatgaacagcctagaacgaccgaggaacacagccatttacattagtacaatgaatacgtaggggaacggggaaagtggggacagggaaccctgggtctccgtcg

SEQ ID NO: 36893 - DNA, 507 bp, Homo sapiens
  misc_feature: GYAE6OF02H39V8.19.10.A10.1.454.CMB.1.raw
  modified_base (290)..(290): a, c, t, g, unknown or other
  misc_feature (290)..(290): n is a, c, g, or t
  modified_base (323)..(323): a, c, t, g, unknown or other
  misc_feature (323)..(323): n is a, c, g, or t
  modified_base (459)..(459): a, c, t, g, unknown or other
  misc_feature (459)..(459): n is a, c, g, or t
  modified_base (478)..(478): a, c, t, g, unknown or other
  misc_feature (478)..(478): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccacctctcctgcagggccataagagtgttgacagcaccttctttgcctggtaccagcagagacctggccaggctccaggctcctcgtttanggtgctcccaccagggccactggcatccccganaggttcagtggcagtgtgctggggacagcttcactctcacatcagcagactgagcctgaagatttgcagtgtatactgtcaaacgatatgatgagtcacctccgtgtggacagtttgccgagggaaccaagggttnaagtactaaacgaactagnggctagcaccatctagtcgttcattcccg

SEQ ID NO: 36894 - DNA, 515 bp, Homo sapiens
  misc_feature: GYAE6OF02FSSUP.19.10.A10.1.454.CMB.1.raw
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccgagggccacgtggcactccccgacaggttcagtggcagtgtgtctggggacagacttcactctcaccatcagcagactggagcctgaagtattttgactagtgttattactgtacaacgtattatgatgagtcaccgtcgtgtgactagttggcgagggaccaaggttgagtacaacgtactgtacggctgcacatctgtcttcatcccg

SEQ ID NO: 36895 - DNA, 443 bp, Homo sapiens
  misc_feature: GYAE6OF02IKV3M.19.10.A10.1.454.CMB.1.raw
  modified_base (434)..(443): a, c, t, g, unknown or other
  misc_feature (434)..(443): n is a, c, g, or t
tcagtactctcgtgcacgaccggtgctcgatttagcgtcgatctcaggggggagaagagctgctcagttaggacccagagggaaccatggaaaccccagcgcagcttctcttcctcctgctactctggctcccatatagcaccggagaaattttcttgacgcagtctccaggcaccctgtctttgaccactggcatccccgacaggttcagtggcagtgtgtctgggacagacttcactctcaccatcagcagactggagcctgaagattttgcagtgtattactgtcaacgatatgatgagtcacctccgtggtggacatttggccagggaccaaggttgaagtcgaaacgaactgtggctgcaccatctgtcttcatcttcccgcatctgacacgagagttactgacgcgggctggcgaaggcgacagtagnnnnnnnnnn

SEQ ID NO: 36896 - DNA, 588 bp, Homo sapiens
  misc_feature: GYAE6OF02GL5K8.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggttcgccaggctccgaggggaaggggctgggagtggggttggccgcatcaagaggagatagtaggaaggggaggcggacagactacgctgcacccgtgagaggcagatttacatgtacaagagatgattacaacaaagtacagtagtatctagacaaatagaacagcctaggaagaccgaaggacacagacctatttaactattagtaacaaagtgaaagttacggtaggggggaacggggtaaaggttcgggggaccgtaacggggaaccccgtgggtaccgtccggtccg

SEQ ID NO: 36897 - DNA, 633 bp, Homo sapiens
  misc_feature: GYAE6OF02JYKGT.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgcgtgggttcgccgaggctccgagggaaggggctgggaggtgggttggccgcagtcgaaggaggagagtagtaggaaggggagacgacgagacgtacgcgtgaccgaccgtgagacggcaagtatttaccagttcgacaagagatgattacaacgtaaagtacaggttagtaatctagactaaagtgaaacgtagcctagaacgaccgagaaccacgaagcctaaagtttactagttacgaactaaagtcggaaaacttacgggtaaggggggaaaccggggtaaaagttcgggggaacccgtaacggggtaaccccgttagggtacccgtacccgtaccgg

SEQ ID NO: 36898 - DNA, 570 bp, Homo sapiens
  misc_feature: GYAE6OF02IHU7D.19.10.A10.1.454.CMB.1.raw
  modified_base (365)..(365): a, c, t, g, unknown or other
  misc_feature (365)..(365): n is a, c, g, or t
  modified_base (454)..(454): a, c, t, g, unknown or other
  misc_feature (454)..(454): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccgagggaaggggctgggagtggggttggccgcatcaagaggagatagtggaaggggnggcgacagactacgctgcaccgtgagaggcagatttaccatgtacaagagatgattcaacaaagtacagtgtatctagacaaatgaacngcctagaacgaccgaggacacagcctaattactattagaacaaagtgaaatacggtagggggaacggggtaaaagttcgggggacctaacggggtaacccctgggtacctccgtcg

SEQ ID NO: 36899 - DNA, 573 bp, Homo sapiens
  misc_feature: GYAE6OF02HY49F.19.10.A10.1.454.CMB.1.raw
  modified_base (197)..(197): a, c, t, g, unknown or other
  misc_feature (197)..(197): n is a, c, g, or t
  modified_base (326)..(326): a, c, t, g, unknown or other
  misc_feature (326)..(326): n is a, c, g, or t
  modified_base (399)..(399): a, c, t, g, unknown or other
  misc_feature (399)..(399): n is a, c, g, or t
tcagtactctcgtgcacgaccggtgctcgatttagcgtcgatctcagggggaagagctgctcagttaggacccagagggaaccatggaaacccccagcgcagcttctcttcctcctgctactctggctcccagatagcaccggagaaattttcttgacgcagtctccaggcaccctgtctttgacccctggggaaanagccaccctctcctgcagggccgataagagtgttgacagcaccttcttgcctggtaccagcagagacctggccaggctcccaggctcctcgtttatggtgcgtcaccagggccactggcactccccganaggttcagtggcaggtgtgtctgggacagacttcactctcacatcagcagactggagcgtagaagtattttgntagtagtattactgtacaacgtatatgtatagagtacaccgttccgtaggtcggtactacgtttgggaccgaggggtaaccgtagggttacgaacgttaccgaaaacggtaacgttggtaggtccgtacgaccgtacctacgttcctacggttccttttaccgtatttaccccg

SEQ ID NO: 36900 - DNA, 526 bp, Homo sapiens
  misc_feature: GYAE6OF02GPTZQ.19.10.A10.1.454.CMB.1.raw
  modified_base (197)..(197): a, c, t, g, unknown or other
  misc_feature (197)..(197): n is a, c, g, or t
  modified_base (327)..(327): a, c, t, g, unknown or other
  misc_feature (327)..(327): n is a, c, g, or t
  modified_base (510)..(510): a, c, t, g, unknown or other
  misc_feature (510)..(510): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagngccaccctctcctgcagggccgataagagtgttgacagcaccttcttgcctggtaccagcagagacctggccaggctcccaggctcctgtttatggtgcgtccaccgagggccacgtggcactccccganaggttcagtggcagtgtgtctgggacagacttcactctcaccatcagcagactggagcctagaagtattttgctagtgtattactgtacaacgatatgatgagtcaccgtcgtggtagaacgtagttgccgtagggaacctaagggttagaagtacgaaacggtaacgtaggtggctgcaccngtctgtcttcattccg

SEQ ID NO: 36901 - DNA, 494 bp, Homo sapiens
  misc_feature: GYAE6OF02HCLGV.19.10.A10.1.454.CMB.1.raw
  modified_base (204)..(204): a, c, t, g, unknown or other
  misc_feature (204)..(204): n is a, c, g, or t
  modified_base (387)..(387): a, c, t, g, unknown or other
  misc_feature (387)..(387): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (473)..(479): a, c, t, g, unknown or other
  misc_feature (473)..(479): n is a, c, g, or t
  modified_base (481)..(494): a, c, t, g, unknown or other
  misc_feature (481)..(494): n is a, c, g, or t
tcagtactctcgtgcacgaccggtgctcgatttagcgtcgatctcaggggggagaagagctgctcagttaggacccagagggaaccatggaaaccccagcgcagcttctcttcctcctgctactctggctcccagatagcaccggagtaaattttctgacgcagtctccaggcaccctgtctttgaccactggcactccccganaggttcaggtggcagtgtgtctgggacagacttcactctcaccatcagcagacctggacgcctagaacgtattttgctagtgtattactgtacaacgtatatgatgagtcaccgtccgtggtcggactagtttcggccgaaggggtaccaaagggttgaacgtacaaaacggtaactggtagntcgcaccgatctgtctcactccttcccgcctatcctgaccacgagagtactggacgcgggctggacgaggcgacagtagnatncgnnnnnnngnnnnnnnnnnnnnn

SEQ ID NO: 36902 - DNA, 368 bp, Homo sapiens
  misc_feature: GYAE6OF02G1VT5.19.10.A10.1.454.CMB.1.raw
  modified_base (359)..(368): a, c, t, g, unknown or other
  misc_feature (359)..(368): n is a, c, g, or t
tcagtactctcgtgcacgaccggtgctcgatttagcgtcgatctcaggggtccgggagatcatgagggtgtccttgggttttggggggaagaggaagactgacggtcctgccacaggtggtgctgggcacggtgggcactcgacacagccatttactattgtacaaatgaatactggggacgggggaaaattggggccagggaaccctggtctccgtctcgtcagcctccaccaagggcccatcggtcttccccctggcgccctgctccaggagcacctccgagagcacagcggccctgggctgcctggtcaaggactacttcccagagagtactgagcgggctggcaaggcgcatagnnnnnnnnnn

SEQ ID NO: 36903 - DNA, 551 bp, Homo sapiens
  misc_feature: GYAE6OF02GR5F3.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcaccgtgagaggcagatttaccatgtcaagagatgattcaacaaagtacagtgtatctgcaaatgaacagcctagaagaccgaggacacagcctaattactattgtacaaatgaaatacggtaggggaacgggggtaaattggggaccaaggggaacccgtggtcctccgtcg

SEQ ID NO: 36904 - DNA, 651 bp, Homo sapiens
  misc_feature: GYAE6OF02GJ1F1.19.10.A10.1.454.CMB.1.raw
  modified_base (348)..(348): a, c, t, g, unknown or other
  misc_feature (348)..(348): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctggagactctcctgtagaagttatggattcaacttcgctagcggctggctgtgcgtgggttccgccaggctccgaggggaaggggcgtgggaggtggggttggccgnagtcgaaaggaggagatagtagggaaggggacggcgacgaggactacgctgcagtccgtgacgaggcaagtatttaccagttgtacaagagatagtattacaacaaagtacagttgtaatcgtagacaaagtcgaaactagacctaggaaaccgaaccggaaggaaccaacgagtacctaatttacgttatttacgtaaactaaagttacgtaaacgttaccgggtaagggggggtaaacggggttaaaaggttcggggggaaccccgaacgggggtaaccccttggggttacccttcccggg

SEQ ID NO: 36905 - DNA, 546 bp, Homo sapiens
  misc_feature: GYAE6OF02JHHFS.19.10.A10.1.454.CMB.1.raw
  modified_base (372)..(372): a, c, t, g, unknown or other
  misc_feature (372)..(372): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccataagagtgttgacagcaccttcttgcctggtaccagcagagacctggccaggctcccaggctcctcgtttatggtgccgtccaccagggccacgtggcactccccgacaggttccaggtgcagtgtgtcgtgggacagcttcactctacaccntcagcagactggacgctagagtatttgctagtgttattactgtacaacgtatagtagatgacgtactaccgtcggtggtcgacttagttcggcgtacgggaccgtaagggttagtagtacgaaacgtacgtacgtcggcgtgaccgtactcttaccgtgttccttcacgttccc

SEQ ID NO: 36906 - DNA, 667 bp, Homo sapiens
  misc_feature: GYAE6OF02FYX7D.19.10.A10.1.454.CMB.1.raw
  modified_base (341)..(341): a, c, t, g, unknown or other
  misc_feature (341)..(341): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtcctgagactctcctgtagaagttatggattcaacttcgctagcggctggctgtgcgtgggttcgccaggctccgagggaaggggctgggaggtgggtggccgnatcgaaggaggagatagtggaaggggaggcgaacgagaactacgctgaccgacccggtgaggaggacagtactttaaccgattacgtacaaaggagtataggtaattaccgaaactaaaaggttaccaagtttacgttaatcgttagaacctaaaagtcgaaacacgaccctaaggaaacgaacccggaaggaaccaaccgaacgtacccttaagtttaactagtttacgaaactaagtacgaaagttacgggtaacggggggtaaacgggggtaaagttcgggggaccctaacggggaacccgttgggttaccctccggttaccg

SEQ ID NO: 36907 - DNA, 611 bp, Homo sapiens
  misc_feature: GYAE6OF02ICWO7.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcgcaggctccgagggaggggctgggagtggggtggccgcatcgaagaggagatagtggaaggggagacgacagactacgctgcaccgtgagaggcagtatttaccatgtacaagagatgtaattacaaactaaagtacaggttgtaatctaggtacaaatagaaacagtccgtaaggaacgaaccggaaggaaccaacacgacctatttaactattagtaacaaagtgaaatacgggtaaggggggaacggggggtaaagttcgggggaaccgaacggggtaacccgttagggtacccgtaccggttaccg

SEQ ID NO: 36908 - DNA, 612 bp, Homo sapiens
  misc_feature: GYAE6OF02HAHQI.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctggagactctcctgtagaagttatggattcaacttcgctagcggctggctgtgctgggttcgccaggctccgagggaggggctgggagtgggttggccgcatcgaagaggagatagtggaaggggagcgacagactacgctgcaccgtgagaggcagtactttaccatgtacaagagatgattcaacaaagtacagtatactcgtagactaaagtacgaaacacgaccgtaaggaacgaaccggaaggaaccaccgacgtaccttaatttaactattacgtaaactaagtagtaaagttacggggtaaggggggtaaacggggtaaagttcggggaccgtaacgggtacccgtcgggtaccgtccggtccg

SEQ ID NO: 36909 - DNA, 540 bp, Homo sapiens
  misc_feature: GYAE6OF02HBANB.19.10.A10.1.454.CMB.1.raw
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccagtcagagtgttagcagcaacttagcctggtaccagcagaacctggccaggctcccaggctcctcatctatggtgcatccaccaggggcccactggtactcccagccaggttcagtggcaggtggtctggggacaggagttcacttctcaccatcagcagcctgcagtctagtaagtatttgctagtttattacttgtcagtcagttataataactcggacctacgagtacgtttcgggcggtacgggaccgtaagggtggagtacgtacgaaacgacgtggtggactgcacgtactcgtacgttcttactacttcctcccg

SEQ ID NO: 36910 - DNA, 604 bp, Homo sapiens
  misc_feature: GYAE6OF02FPOBC.19.10.A10.1.454.CMB.1.raw
tcagtactctcgtgcacgaccggtgctcgatttagcgtcgatctcaggggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagctaccttctttgcctggtaccagcagagacctggccaggctcccaggctcctcgtttatggtgcgtccaccgacgggccacgtcggcactcccccgacacggttcaggtggcagtgtgtcgtgggacagtacttcactctacaccatcagcacgtcctgcaggtctagaagatggtcggactaggtttatattcgtacgtaactaattaatttaatttactactttcggtacggtacggtttcggaaccgtaacgggtacgtaaggggtagtaacgttatacgtaggtacgaacgtgggtacggtccgtacggaccgtaaccgtacgttcgtacgtttccgttactacttcccgttaccccgtacccg

SEQ ID NO: 36911 - DNA, 680 bp, Homo sapiens
  misc_feature: GYAE6OF02HDGG2.19.10.A10.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (376)..(376): a, c, t, g, unknown or other
  misc_feature (376)..(376): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccataagagtgttgacagcaccttcttgcctggtaccagcagagacctggccaggcctcccaggcttcctcgttanggtncgtccaccagggccagtggcactccccgatcggttcagtggcaggtgtgtcgtgggacagtaccttcactctcaaccgtntcgacgacagtaccgtggacgtccgtaggaacgttacttttacggacgttagtagttaactttacgtagttactaaacgtattaacgtagtaagttagtacgttaccgtacccgttcccggttagggttacggtaacgttaggttttaccggggaaccggtaacgggggtaaccggtaaacggggtttaacggtaacgttaaccggtaaaaccggtaaacggtttacgggtaacgggtccgtacggtaaccgacccggttaacgttccggttacggtttacctttacgtaccgtttacccccgg

SEQ ID NO: 36912 - DNA, 691 bp, Homo sapiens
  misc_feature: GYAE6OF02IQT6F.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggagcgtggtccagcccgggggtccctgagactctcctgtagaagtatggattcaacttcgctagcggctggctgtgctgggttcgccaggctccgagggaagggctggagtgggttgccgcatcgaaagaggagatagtcggaaggggaggcgacagaacgtacgcgtacgcgacccgtgaaggacggccgaagagttttaacccagttagacaaaggtagaacttgaaacgttcaaacgaaaagttacgaaagttgtaaagtccgtagtaacaaaacgtgaaaactagtacccgtagaaacgaacccggaacgggaacctaacgacggtaacctaaactttaactaacgtttacgtaaacggtaaaattacgggaaaacttaacgggtaacgggggtaaaaccggggggttaaaagttaacccgggggtaccgaaacggggttaaccccgtaacgggttcccgtacccgggttaaccg

SEQ ID NO: 36913 - DNA, 586 bp, Homo sapiens
  misc_feature: GYAE6OF02HDDGL.19.10.A10.1.454.CMB.1.raw
  modified_base (293)..(293): a, c, t, g, unknown or other
  misc_feature (293)..(293): n is a, c, g, or t
  modified_base (326)..(326): a, c, t, g, unknown or other
  misc_feature (326)..(326): n is a, c, g, or t
  modified_base (384)..(384): a, c, t, g, unknown or other
  misc_feature (384)..(384): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttcttgcctggtaccagcagagacctggccaggctccccaggctcctcgtttanggtgcgtccaccagggccactggcatccccganacggttcagtggcagtgtgtctgggacagcttcactctcaccatcagcagacgtggancctagaagtatttcgcgtagtgtattacgtgtactaacgtatatagtagtgtacgtctaccgtccggtagggtacggtactagttttacgggaccgtaaggggaaccgtaagggttagaacgttacgaaacggtaacgtacggttacggacttacggacccgtaccgttactccgttagttacctttacgaccgtttccccg

SEQ ID NO: 36914 - DNA, 643 bp, Homo sapiens
  misc_feature: GYAE6OF02GA4B8.19.10.A10.1.454.CMB.1.raw
  modified_base (301)..(301): a, c, t, g, unknown or other
  misc_feature (301)..(301): n is a, c, g, or t
  modified_base (467)..(467): a, c, t, g, unknown or other
  misc_feature (467)..(467): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcgctggctgtgctgggttcnccaggctccgagggaagggctggagtgggttggccgcatcgaaggaggagatagtggaagggggagcgaacagactacgctgccaccgtgagaggcagtactttacgatgtacaagagatgattacaaacgtaaagtacagtagttatctagaacaaatagaaacncgctaggaaacgaccggaagaccaacgacgacccttaatttactaacgtttacgtaaaccgtaaagttacgtaaacgttacgggtaagggggggtaaaccggggggttaaaaaggtttcggggggaacccgtaaaccgggggtaaccccgtaggggttacccgtcccggttacccg

SEQ ID NO: 36915 - DNA, 646 bp, Homo sapiens
  misc_feature: GYAE6OF02FXJK5.19.10.A10.1.454.CMB.1.raw
  modified_base (400)..(400): a, c, t, g, unknown or other
  misc_feature (400)..(400): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcggtggtccaggcccggggggtccctgagactctcctgtagaagttatggattcaacttcgctagcggctggctgtgctgggttcgccaggctccgagggaaggggctgggaggtggggttggccggcagtcaaggaggagatagtggaaggggaggcgacgagactacgctgcaccgtgagngcagactttaccatgtacaagagatgaattcaaacgtaaagtacgagttagtaatctaggactaaaagtcgaaacacgtaccgtagaaacgaaccggaaggaaccaacgaacgaccttaagtttaactaagtttacgaactaaagttacgtaaattaccggggtaaggggggtaaacggggggtaaaagttcggggggaacccgtaacgggggtaacccgttcgggttacccgtcccggttaccgg

SEQ ID NO: 36916 - DNA, 587 bp, Homo sapiens
  misc_feature: GYAE6OF02HO8SL.19.10.A10.1.454.CMB.1.raw
  modified_base (562)..(562): a, c, t, g, unknown or other
  misc_feature (562)..(562): n is a, c, g, or t
  modified_base (567)..(587): a, c, t, g, unknown or other
  misc_feature (567)..(587): n is a, c, g, or t
tcagtactctcgtgcacgaccggtgctcgatttagcgtcgatctcagggggggagaagagctgctcagttaggacccagagggaaccatggaaaccccagcgcagcttctcttcctcctgctactctggctcccagatagcaccggagtaaattttcttgacgcagtctccaggcaccctgtctttgaccactggcactccccgataggttcagtggcagtgtgtctgggacagacttcactctcaccatcagcagactggacgcctgaagtattttggacagtggttattactgtaccaacgtatataggataggagtcctaccgtcggtaggtgtactagttcggaccgtaagggacctaagggtttagaacgtacgtaaaacggtaacgtggtggctacgcgaccctaattccgttacgttccgtttacctaactttcccgttacccccggtaccttattccgttaacggtaccgaaacggtacggtaaacgttaaccgtagggaccgggtaccggggtccgttacggggtaccgaaagggtaccgacgtaagtaggcngcagnnnnnnnnnnnnnnnnnnnnn

SEQ ID NO: 36917 - DNA, 692 bp, Homo sapiens
  misc_feature: GYAE6OF02GQLH9.19.10.A10.1.454.CMB.1.raw
  modified_base (308)..(308): a, c, t, g, unknown or other
  misc_feature (308)..(308): n is a, c, g, or t
  modified_base (492)..(492): a, c, t, g, unknown or other
  misc_feature (492)..(492): n is a, c, g, or t
tcagtactctcgtgcacgaccggtgctcgatttagcgtcgatctcaggggagctctgggagaggagtcccagccttggggttcccgagtgttttcgttcagtgatcaggactgaacaccgtaggactcaccatggagtttggcctgagttggattttcctttctgctattttaaaaggtgtcctgtgtgaggtgcgcctggtggagtcgtgggggaggcggtggtccgaggccccggggggtccctggagactctcctgtagaagttatggattcaacttcgctagcggctggctgtgcgtgggttcnccaggcctcgaggggaaggggctgggaggtggggttggccgcagtacgaaggaggagatagtagggaaggggaggacgaacgaggacgtaacgcgtacgccgacccggtagacgagggcaaggtacttttacgagtgtaacgaagagatgtatacgaactaaacgtacagttgtaactcgttanacgtaaatcgaaacgacgtaccgtaagaacgtaacccggaggaaccacgaacaccttaagttttactaagtttacgtaacctaaagtaggtaaacttaacgggggtaaggggggtaaaaccgggggggttaacgtaacgggggtacccggtaaacgggggtacccccgtttaggggttaccccttcccgggttaacccgg

SEQ ID NO: 36918 - DNA, 382 bp, Homo sapiens
  misc_feature: GYAE6OF02HTQV6.19.10.A10.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (352)..(352): a, c, t, g, unknown or other
  misc_feature (352)..(352): n is a, c, g, or t
  modified_base (376)..(382): a, c, t, g, unknown or other
  misc_feature (376)..(382): n is a, c, g, or t
tcagtactctcgtgcacgaccggtgctcgatttagcgtcgatctcaggggtccgggagatcatgagggtgtccgttgggttttgggggaagaggaagactgacggtcctgccacaggtggtgctgggcacggtgggcactcgacacagcctatttactattgtaacaaatgaatacgtgggggacgggggaaaattggggccagggaaccctggtctccgtctcgtcagcctccaccgaacggcccagtcggtccttcccccgtggccgccctgctccaggacncaccgtcgagngcctacgaggccggccctgggctggacctggtcaaggacctacctcccagagatacngagccggctggacaggctcatagnnnnnnn

SEQ ID NO: 36919 - DNA, 769 bp, Homo sapiens
  misc_feature: GYAE6OF02JDASU.19.10.A10.1.454.CMB.1.raw
  modified_base (503)..(503): a, c, t, g, unknown or other
  misc_feature (503)..(503): n is a, c, g, or t
tcagtactctcgtgcacgaccggtgctcgatttagcgtcgatctcaggggagctctgggagaggagtcccagccttgggttcccgagtgttttcgttcagtgatcaggactgaacacgtaggactcaccatggagtttggcctgagttggattttcctttctgctattttaaaaggtgtcctgtgtgagtgcgcctggtggagtcgtgggggaggcgtggtccgacggcccggggggtccctgagacctctccgtgtagagttagtggattacaacttcgactaggcggcgtggtcgtgtgtcgtgggttccgccgtaggccgttccgaagggggaacggggtcgtgggtaggttggggttcggcccgtcgacgtaccgaaagggagggtaacgaagttaacgtacggggaaagggggagggaccggaacgaacggaaccttaccggactcggaccgacccggtaggacgacggctaagtactttaccgagtcgtacgaaagngtaagtcgtaattaccgaaacgtaaagtacgaggttagtaacttcgtaagacctaaagtacgtaaacgacgaccggttagaaaccggacgaacgggtaacccaagtaccgtaacttaacttttaacgttaacgttacgtaaacgaagttacggttaaacgtaacgggggttaaacgggggggaaacgggggttaaaacggttccggggaacccggttaaacggggtaacccccggtttacggttaccccggttccggttaacccgg

SEQ ID NO: 36920 - DNA, 749 bp, Homo sapiens
  misc_feature: GYAE6OF02HU50K.19.10.A10.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (298)..(298): a, c, t, g, unknown or other
  misc_feature (298)..(298): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagtaaattttctgacgcagtctccagcaccctgtctttgaccccgtgggaaancgcccaccctctcctgcaggccataagngtgtgacngctacttcttgcctggtaccagcagacgaccgtggccaggcctcccgaggtccttccgtcgtttagnggtcgccgtcccaaccgagggccctacgtggacctaccgtccccggaagtacggttacacggttcggactaggttcggtcgtacgtaggggaacctaggtacctttacgaaccttccgtaccaaccgtatccgaacgtccaaggtaccgttaggacgtccgtaaggtaacgtttacgtttcggacgttaaggttacgttaacgtttacgtacgttaaccgaaacgttagtaacgtagtagtacggtaacgttcccgtaacccggtttaccggttaggtacggtaaccgtttacgggtttacccgggaaccgggtaaacggggtaaccgttaaagggtttaacggtaaccggttaaccgtaaaaccggtaacgttacggtacggtaccgttaccggaacccgtaccgttacgttacccgttacgtttaccgttacctaccgtttacccccgg

SEQ ID NO: 36921 - DNA, 716 bp, Homo sapiens
  misc_feature: GYAE6OF02H5WHM.19.10.A10.1.454.CMB.1.raw
tcagtactctcgtgcacgaccggtgctcgatttagcgtcgatctcagggggaagagctgctcagttaggacccagagggaaccatggaaaccccagcgcagcttctcttcctcctgctactctggctccagatagcaccggagtaaatttttctgacgcagtctccaggcaccctgtctttgacccctgggaagagccacctctcctgcagggccgataagagtgttgacagctacctttcttcgccttggtaccagcaaggagtaaccgtggccaagggcctacccgaggtccttccgttacgtttatcgggtagcgtacccaccgaacgggcctaaccgtggaccacttacccccggaagtaacgggttttcccgaaggttcgggcctaagggttcgtcgttacggttacggggactaacggtacctttaccgtaaaccgtccgttaacaaccgtaattaccgaacggtacctaggtaacccgttagggaacgtacccgttaggtaaacgttactttttggaccgtagttagttaactttacgtagttaacaaacggttataagttacgaagttcgacgttactacccgttcggtacgggtacgtacgtagtttcggacggaacgggtaaccgtaagggttacgaacgtaacgaaacgtacgtagtacggcgttacgacgtaaccgtacgtcgttagtcgttactacgttaccc

SEQ ID NO: 36922 - DNA, 873 bp, Homo sapiens
  misc_feature: GYAE6OF02GZ12C.19.10.A10.1.454.CMB.1.raw
tcagtactctcgtgcacgaccggtgctcgatttagcgtcgatctcaggggagctctgggagaggagtcccagccttggggttcccgagtgtttcgttcagtgatcaggactgaacacgtaggactcaccatggagtttggcctgagttggattttcctttctgctatttaaaaggtgtcctgtgtgaggtgcgcctggtggagtcgtgggggaggcgtggtccaggcccgggggtccctggagactctcctgtagaagttatggattcaacttcgctagcggcgtggctggtcgtcgttgggttccgccgtagggtcctacccggaaggggggaagggggtcgttaggggtagggttacgggggtttcgggcccggtaccgtaacgttacggaaagggaacggggaaggtaacgttaaggtaggggaaaaggggggtacgggacggaaacgtaacggaaccgttacggcgtacggaccgtacccggtaggacggaaggacgaagttacttttaaccgaagtttcggaacctaaagggagtaagttagggtaaactttaccgaaaacgttaaaaacggtaccgtaaaggttcgttaaacgttcccgtaaggaaacctaaaaacgtcggtaaaaacccgacgggtacccgttaaaggaaaccgggaaaccccgggttaaggggaaaccccaccggtaaacggtaaccccgttaaagttttaacccgttaagttttaaccgtaaacgtaacgttaagggttaaaccggttacgggggttaaacggggggggtaaccggggggttaaaacgtttcggggggaacccgttaaccgggggttaacccccgtcggggtttaccctccccgggttacccgg

SEQ ID NO: 36923 - DNA, 720 bp, Homo sapiens
  misc_feature: GYAE6OF02FGRQT.19.10.A10.1.454.CMB.1.raw
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (483)..(483): a, c, t, g, unknown or other
  misc_feature (483)..(483): n is a, c, g, or t
tcagtactctcgtgcacgaccggtgctcgatttagcgtcgatctcagggggagctctgggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtgggggaggcgtggtccgacggccccgggggggtccctggagactcctcctgtagaagttatggattcaacttcgctagcggctggctgngctgggtcncaggctcgagggagggctggagtgggtgccgnatcgaaggaggagatagtaggaaggggagcgaacgagtaacacggctcgaccacccggtaggaacgacgggcaagttactttaccgagttcggtacaaggaatagtacgtaattaccaaacgtaaaagttacgtaaggttnttaacgttccttaaggaacctaaaagtcggaaacctaacggtacccggaaagggaaaccgtaaacccgggaagggtaacccaaccggtaaccgtaaccttaagtttaacctaagtttacgaaacctaaagtaacggtaacgttagggggtaaacggggggtaaccgggggttaaaagttccgggggggaaccttaaacgggggaaccccgtttgggtacccgttacccggttaccgg

SEQ ID NO: 36924 - DNA, 761 bp, Homo sapiens
  misc_feature: GYAE6OF02IXPS6.19.10.A10.1.454.CMB.1.raw
  modified_base (217)..(217): a, c, t, g, unknown or other
  misc_feature (217)..(217): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttccttctgctattttaaaaggtgtcctgtgtgaggtgcgcctggtggagtcgtgggggaggnggtggtccacggcccgggggtcctggagacctctcctgtagtaagttatggattcaacttcgctagcggtctgctgtgcgtggttcgcaggcctccgaggggacgggtcgtgggtaggtggggtcggccgacgagtacgaaggaggaagtagtaagtagggaagggggacggtacgaacgaaggaccgtaacggccgtacgaccgacccggtaggaacggtaacggaccgtaagtaacgttttacccagttacgtaacgaaaggagtaacgtagtacttaacaaaccgtaaagtaccgtagttagtaacgtctagtaactaaagtcgaaacacgtaaccgtaaggaaaccggtaacccggaacggtaaccgaacccgtaacgtaacccgttaattttaaaccgtaatttacgtaaactaacgtaacggtaacggttaaacgggggtaacggggggtaaacgggggttaaaaccggttcggggggaaacccggttaaccggggtaaccccgtttacggggttaccccgttacccgggttacccgg

SEQ ID NO: 36925 - DNA, 781 bp, Homo sapiens
  misc_feature: GYAE6OF02JZPB0.19.10.A10.1.454.CMB.1.raw
tcagtactctcgtgcacgaccggtgctcgatttagcgtcgatctcaggggggaagagctgctcagttaggacccagagggaaccatggaaaccccagcgcagcttctcttcctcctgctactctggcctcccagactagcaccggagtaaatttttctgacgcagtcctccgaggcctacccttgttctttcgacccgtaggggaaacgcgcccaccctctcctgcgacgggaccagtaagagtgtgacacgctacttccttgccgtcggtaccaggacacgacgtaccgtcggacgtacgcctccgacggtcctccgttgtttacgcgggtcgaccgttcccgaccggacggacccacggtcgacctaccgtaccccggattacggtccgaggtgtcgagtcggttcgcggtagggactaggtaccttccgacttccgacctaccgtataccgacgtaccgacgggtaccgtaggtaccggtaccgttaggtaaacgttttacgttttacgggacgtttaacgggttacgtttaaacgttaaccgtttacgggtaaacctaaacggtttaagtaggtttaacgtacggttaaccgtaacggtttcccgtaccgtttaccgggttcggtaaccgggttaacgtttacgggttacgggtaaccggtaaacgggttaaccgggtaaggttacggtaaccgtaaccgtaaacggtacggttacggtacggttacgaccgttaaccgtacgtacttccgtacgttaccgttaccgttccgtcccg

SEQ ID NO: 36926 - DNA, 714 bp, Homo sapiens
  misc_feature: GYAE6OF02HNWXQ.19.10.A10.1.454.CMB.1.raw
  modified_base (368)..(368): a, c, t, g, unknown or other
  misc_feature (368)..(368): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccataagagtgttgacagctaccttcttgcctggtaccagcagacgacctggccaggcctcccgaggtcctccgtcgtttagtggtcgtcgtcccaccgacggccacgtcggccactccccgagtacggtcaggtcggctaggtgtcgtcgnggggaacaggtaccttcaccttctccacctactcacgcaagaccgtagggacgtcccgtaggtaacgttagttttggacgtacggttagttaacgtttaccgtagttaccgtaaacggttataagttgtaactaggtaccggttacgtaccccgttaccgggttggggtacgttaccggttaacgggttttacccggggaccgggtaaaccggggtaacccgttaaggggttagttaaacggtaaccggtaaaacggttaaaccggttcggggtaacggtaccgtacggtaacccgtaaccggtacgttccgtttacggtttcgtttacccgtacctttaccccgg

SEQ ID NO: 36927 - DNA, 750 bp, Homo sapiens
  misc_feature: GYAE6OF02FTLZC.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtcctgacgactctcctgtagaagttatggattcaacttcgctagcggctggctggtgcgttgggttcgccgaggctccgaggggaaggggcgtgggaggtggggttcggccgcgatcgaaaggagggagagtagtaggaagggggaggcgaacgacggaactacgcgtacgccgtaacccgtgaacggaggaccgaagtaacttttaccgagttcgtaacgaaaggagtaagtagtaactttaccgaaacgtaaaaggtaccaagggttagttaatacgttacgaactaaaagtcgaaaccgacgtacccgtaggaaaccgacccgggaaggaaccgaaccgaacgtacccgttaaagttttaaccgttaacgtttacgttaacctaaaagtttacggaaaacgtttaaccgggggtaacggggggggtaaaacgggggttaaacgggttacgggggacccgggaaaccggggttaaccccggttacgggttaccccggttcccggtacccgg

SEQ ID NO: 36928 - DNA, 709 bp, Homo sapiens
  misc_feature: GYAE6OF02I7YE8.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccgacggcccgggggtccctgagctctccgtgtagtagttatggtattactaacgttcgactagcggcgtggctgtgcgtggttcgcaggctccgagggagggcgtggaggtgggttggccgcgagtcgaagaggagagtagtaggaagggaggacgagacgacgtacgctacgcgaccgtagagacggacgagtacttacctagtacgtacgaaagacgtagtagtaagtcaaacgtaaaaggtctaacggtagttaactacgttacggaaactaaagttcgaaaccggaacgtaccgtaaggaacgaaacccgggaacggaccaaaccgtacgaaccccgttaatttaacccgtaatttaccgtaaagtaaacgttgaaaaccggtttaaggggtaacggggggtaaaaccgggggtaagtttaccggggggaaccccgtaaggggtaaccccggtttcggttacccggtccgttaacccggg

SEQ ID NO: 36929 - DNA, 753 bp, Homo sapiens
  misc_feature: GYAE6OF02GM9KY.19.10.A10.1.454.CMB.1.raw
  modified_base (178)..(178): a, c, t, g, unknown or other
  misc_feature (178)..(178): n is a, c, g, or t
  modified_base (486)..(486): a, c, t, g, unknown or other
  misc_feature (486)..(486): n is a, c, g, or t
tcagtactctcgtgcacgaccggtgctcgatttagcgtcgatctcaggggagctctgggagaggagtcccagccgttggggttcccgagtgttttcgttcagtgactcaggactgaacacgtagactcacatggtagttgctgagttgtacttttcttctgtacttaatttaaaggtntcctgtgtgaggtgcgccgtggtggagtcggtgggggaggcggtggtaccggacgggcccccggggggtcccgtgacggtaccttcctccgttagtaaggtaagttacgtaggtatttactaacgttcgactaggcggccgtggtcgtgtcggtcggttcgggttaccgccgacggtccgtacggaacgggggaaggggtccggtagggtaggtggggtcggccgacgagtacgaaggacggagtagtagtaagggaacgggacggacgacaacggaacgtacgccgcgaacccgtaccgagaacggngacgtactaacgttaacagtactaacgaaaggtagtaatggtaataacgtaaacgtaaggtaactaggttaattacgtacgacgaaagtaaataccgaagacgttaaccgaagtaacggaccgtaagaaccacgtaacgtaacttacgttaacgttagttaactaacggtaataacggtaaacggttacgggtaacggggggaaacgggttaacggtccggggtaaccggacccggtaacgttacgggttaccccgtacgtacccgg

SEQ ID NO: 36930 - DNA, 696 bp, Homo sapiens
  misc_feature: GYAE6OF02HPRK0.19.10.A10.1.454.CMB.1.raw
tcagtactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccgtctcctgcagggccgataagagtgttgacagcacttcttgcctggtaccagcagacgaccgtggccaggcctccaggtctccgtcgtttatggtcgccgtccgaccgaggggcccacgtcggccacgttcccccgacgtaggttcgaggtggacgtaggtcgtcggtcgtggggaactagtacgttctactcctacgacagtcaaggcaacggtacgtacgggacgtcccgtaggtaacgtttatttcggacgttaaggttacggtttaatttaccgttagtaccgttaaaacggtagttacgttaggatttaggtacgttacccgtacccggtttcgggttagggtaaccgggtacgttaacgttttaccggggaacgggttaaacggggaacccgttaaaggggttacgtaacggtaacgaaacggtacgttcgggttacgacgttcgacgtaccgtagttaccgtgtttaccttccggtactttccccg

SEQ ID NO: 36931 - DNA, 845 bp, Homo sapiens
  misc_feature: GYAE6OF02JUFLO.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggatttttcctttctgtcttattttaaaaggtgtcctgtgtgaggtgcgctggtggagtcgtggggaggcggtggtccgacggcccgggggtccctggagaccgtccgttcctagtacgtaagttagtggtacttactaacgttccgcttaacggccggtcgtggtcgtggttcggacgttcggggtttccgacccggaagggtcccttaccggaacgggggaacgggggtccggtagggggtaacgggtttgggggttcggcccggcgtaacgtaccgaaaggtagggagtaacgttaaggtagggaaaggggcggacgaacgaggaacgtaccgagcgaccgaccgtagacgagtacgacgttacgttaacctagtacgtacgaacgtaagtagtacgtacgtaacgtaaacgtaaacgtaacgtaagttacggttaacgttacgtacgtaacgtaaacgtaacgtaacgtaacgtaccgtaacgtaacggaaccggaaccggaaccgtaaccgtaaccgtaccgttaactttaacgtttaacgtttacgttaaccgttaaacggttaacgttaacggttaaacgggttaacgggggtaaacgggggttaaacggggttaaccgggggttaaccggggtccgggttaaaaaaaaacccggttccgggtttacccggttacccggtttacccggg

SEQ ID NO: 36932 - DNA, 725 bp, Homo sapiens
  misc_feature: GYAE6OF02HR5WO.19.10.A10.1.454.CMB.1.raw
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (543)..(543): a, c, t, g, unknown or other
  misc_feature (543)..(543): n is a, c, g, or t
  modified_base (586)..(586): a, c, t, g, unknown or other
  misc_feature (586)..(586): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctcggcctcccagatagccaccggagtaaattttcttagacgcacgtcctccgaggccaccctgtctttcgaccccgtaggggaaacacgcccncctcctcctcggacgacgggaccgaataagngtacgttgaccngacctacttctcggacctcggtaccaggcacgacgtaccgtggacccgacggtccgtaccacggtccttaccccgtttggtttacgtcggttacgacccggttacccaaccggaccggccctaacgtcgggtaacctaccccgtccccgtaaacggtcggtttaccgagggtcggtactaacggttcggttacggccgtacggggtaactcggtaactcccgtaccttcgactaacccgtagccgaacgcgtacggacgttacggacggcgtagtacgttacgtnacgttagtcgttaacttcgtacgtactaagtacgtatggaacncgtacggtcctacggtttccggaagttcggtaaccgttcgtcgtacccgggtaggaaccgttaaggtacgaacgtaccgtaacgcggttacgtggaccgtacgctaacgtgttacccgtcgtttactccttagtacccg

SEQ ID NO: 36933 - DNA, 905 bp, Homo sapiens
  misc_feature: GYAE6OF02JWJZJ.19.10.A10.1.454.CMB.1.raw
  modified_base (160)..(160): a, c, t, g, unknown or other
  misc_feature (160)..(160): n is a, c, g, or t
  modified_base (637)..(637): a, c, t, g, unknown or other
  misc_feature (637)..(637): n is a, c, g, or t
tcagtactctcgtgcacgaccggtgctcgatttagcgtcgatctcagggagctcgtgggagaggagtcccagccttgggttcccgagtgttttcgttcagtgatcgaggactgaacacgtaggactcaccatggagttgctgagttggtattttcctttntgtactattttaaaaggtgtcctgtgtgaggtgcgtccgtggtggagtcgtgggaggcgtggtccgacggccccgggggtcctacggagtactccgtccgtgtagtaagttatggtacttacgaacttcgacgtacgcggtactggtctgtcgcgttcgggttccgccgacggtccgtcccggaaggggtacggggtcgttacgggagggttgggttccggaccgtcgtaaggtaccgaaggaacggtaagtacgttaaggtacgggaaggggaggtaccgaacggtaacggaaccgtaccggtacgtacggtacccgaaccggttaaggaacggtaccggacgtaacggtttaaacgtttacccgtaagtacggtaacgtaaaggacgttaacgtaagtaacgttaaccgtaaaacgttaaacgtacggtttaagttacttaaaccggtacgttaacggtaaataaaaacggttanaaaacccggtacgtaaccggttaaaccgaaaggtaaaccccggtacggaaaccgttaaaccgtaacgttaaacccgtttaaacgtttaaccgttttaacggtttaaacgtaaacgtttaaacggttacggttaaaaaccgggtttaacgggtaaaaccggggggtaaaccgggggtttttaaaaagggaccccggggtttaacccggggaaaaccccgggttttaccgggttacgggtttcccccgtaaccccgggtttttacccggg

SEQ ID NO: 36934 - DNA, 770 bp, Homo sapiens
  misc_feature: GYAE6OF02GJSM9.19.10.A10.1.454.CMB.1.raw
  modified_base (143)..(143): a, c, t, g, unknown or other
  misc_feature (143)..(143): n is a, c, g, or t
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggctcccagatgcaccgganaaattttctgacgcagtctccaggcacctgtcttgaccctgggaaatgccacctctcctgcagggccatagactgtcgacngcacttcttgcctggtaccngcagagcctggccnggctccaggctcctgttanggtcncgtaccgaccgagggccagtcggaccacgtccccggacgtcggtttacgaggtcggactacggtggtcgtctacgggggactaggtacctttcgaaccttactaccaacccgtagttacccgaaggtcccgaaacggtaccgtacggggtacgtaaccccggttagggttaaacggtttaacgtttttacggaccgttaaggtttacggtttaaaccgtttaacccggttaggttaaacccgttaaacggtacgttaacgttaaccggttaagtacggtaacgttccggtaacccgtttacgggttacgggtaccgggtacgttaacggtttaccggggtaacccgtagggggttaacccgtaaaggggtttccggaaacgttaacgtaaaccgggtaacgtttacggggaccgttaccggtacgtaacccgtaaccgtacggttttacccggtacgtttacccgtttaccgtaaccgtttcccccgg

SEQ ID NO: 36935 - DNA, 1199 bp, Homo sapiens
  misc_feature: GYAE6OF02HNIVC.19.10.A10.1.454.CMB.1.raw
tcagtactctcgtgcacgaccggtgctcgatttagcgtcgatctcaggggagctctgggagaggagtcccagccttggggttcccgagtgttttcgttcagtgatcaggactgaacacgtaggactcaccatggtagtttggcctgagttggtatttttcctttctgtacttattttaaaaggtgtcgtgtgtgaggtgcgctggtggagtcggtgggggacggcggtggtccgacgggccccggggggttcccgtaggacgtaccgtccttcccgttaggtaacgtaagttagttagggtaactttacctaaaccgtttcggtccgttaacggccggtccgtgggtccgttggtcgtccggttcggggttcccgccggtacgggtcccgttaccgggtaacggggggaaacgggggtccggttaggggtacggggtttcggggggtttacgggacccggtacggtaacggttaccggaaaaagggtaagggtaaggtaagttaagggtaacggggaaaaggggggtaacgggacccgaaacggtacggtaaacccggtacggtaccgtacggtacccgaccccggtagggaacgggtacggtacggtaaaccggttaactttaaaccgtacgttaacggtaaccgtaaaaggtaacggttaaacgttaacggttaacgttaaacccgttaaaaacgtaaaaaccgggtttaaaccggtaaacgggtttacggtttaaccgttaaccgttacggttaaaaacccgttaaaacggttaaaaccgtaaaaaccgggaacccgttaaaacccggggtaaacggttaaaaccggggaaaccccgggttaaaaccgggaaaacccccggtaaaccggttaaacccccggttaaaccccgttttaaaaacccggtttttttaaaaccccgggtttaaacgttttttaaaaccccggggtttaaaaaaccgtttaaaaacggggttaaaaacccggttaaaaacggggggtttttaaaaccccgggggggtttaaaaaccgggggggggggttaaaaaaaacccggggggggggggttttttaaaaaccccggggggtttttaaccccgggggggggtaaaaacccccccggggggggttttaaaacccccgggggggttttaaaaaaccccccccggggggttttttaacccgggggggttttaa

SEQ ID NO: 36936 - DNA, 747 bp, Homo sapiens
  misc_feature: GYAE6OF02IQHI0.19.10.A10.1.454.CMB.1.raw
  modified_base (249)..(249): a, c, t, g, unknown or other
  misc_feature (249)..(249): n is a, c, g, or t
  modified_base (330)..(330): a, c, t, g, unknown or other
  misc_feature (330)..(330): n is a, c, g, or t
  modified_base (427)..(427): a, c, t, g, unknown or other
  misc_feature (427)..(427): n is a, c, g, or t
  modified_base (464)..(464): a, c, t, g, unknown or other
  misc_feature (464)..(464): n is a, c, g, or t
  modified_base (551)..(551): a, c, t, g, unknown or other
  misc_feature (551)..(551): n is a, c, g, or t
  modified_base (571)..(571): a, c, t, g, unknown or other
  misc_feature (571)..(571): n is a, c, g, or t
tcagtactctcgtgcacgaccggtgctcgatttagcgtcgatctcaggggagctctgggagaggagtcccagtccttggggttcccgagtgttttcgttcagtgatcaggactgaacacgtaggactcaccatggagttggctgagttggacttttccttctgtcttaattttaaaaggtgtcctgtgtggaggtgtcgccgtggtggagtcggtggggaggtcgtggtccgacgggcccgggggtccnggaagtcgtcctccgtagtagtaagttagtgagttacaacgtcgacgtacgcggcgtcggctagtcgtagttcgggtaccncggtacggtcctaccggaaggggaacgggtcggtgggtacggtcggttacggccgacgtacgtacgaaaggtaggaagagtaggtaaggggaagggnggacgacgaaagtacacggcgtacggaccgacccggnggacggtaacggacgacggttaaccttactaacggggttacaacggtaaaggtagaaccgtaggtaacttaacgaaagtaaacgtanacggttagacttacggtaanactaaaagtacggaactcgaacaagtaaacgaacgtaaccgaacgtaagacctaacgttaaacttattacgaagtttaacgtaaagaagttaaaccgaggggtaaaccgggggtaaaggtaaacggtaccgggtacgaaaccgggttacccgtacgggttcccgtaacttacccgg

SEQ ID NO: 36937 - DNA, 713 bp, Homo sapiens
  misc_feature: GYAE6OF02GYV43.19.10.A10.1.454.CMB.1.raw
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (355)..(355): a, c, t, g, unknown or other
  misc_feature (355)..(355): n is a, c, g, or t
tcagtactctcgtgcacgaccggtgctcgatttagcgtcgatctcaggggagctctgggagaggagtcccagccttggggttcccgagtgttttcgttcagtgatcaggactagaacacgtaggactcaccatggagtttggcctgagttggtattttcctttctgtcttaattttaaaaggtgtcctgtgtgaggtgcgccgtggtggagtcggtgggggaggtcggtggtccgacgggccccgggggtcctggagactctcctgtagtaagttnagtnttactactcgactagcgntggctgtgcgttggtccgcgnggccncgaggggagggcgtgggaggtggtcggccgnagtacgaagagagatagaggaaggggaggacgacgaagaaccgtacgtcgtagccgtaccggagaacggacggacgtaacgttaactttaaccgtagtacgtaacggaagtaagtacttaggtacctaacgtaaaacgaaaggttaacctagttagttacgttccgtagaactaaacgtacgacctaacgtacgtaacggaaaccggtacggaacgaaccgaaccgtacgtaacctttagttttaaccagtttaacgtaataaagtaggaaaggtttcggggaaaggggggtaacgggtaaacgggtccgggaacggttaaacccgggacccggttcggtacccggttaccggtccgg

SEQ ID NO: 36938 - DNA, 835 bp, Homo sapiens
  misc_feature: GYAE6OF02HCSMN.19.10.A10.1.454.CMB.1.raw
  modified_base (294)..(294): a, c, t, g, unknown or other
  misc_feature (294)..(294): n is a, c, g, or t
  modified_base (820)..(820): a, c, t, g, unknown or other
  misc_feature (820)..(820): n is a, c, g, or t
tcagtactctcgtgcacgaccggtgctcgatttagcgtcgatctcgaggggggaagagctgctcagttaggacccagagggaaccatacggaacccagcgcagcttctcttcctctgctactctggcctccagatacgcaccggtaagttaacttttctcgacgcacgtcctaccgacggcctaccctgttccttcggacccggtaggggaaacgacgcccaccctccgtccgtgacggacgggaccaagtagtagtgtacgacacgcttaccgttgttcgccttacggaccgngacgtacggacgtaccggtcggaccacggtcctacccggacggttccttcccgtttacggtttaggtccgggttcggacccgtaccgaaccggaccgggtcctacggtcgacctaccggtacccggacggttaccggttacgacggtacggtacgttacggtcggttacggtacggacgggtaaccgtcgtaaccttccctaagtcccgtaaccaccgtaacgtcgacggtacggagtaccggtcggtaacgcgtaaggtaacgttgtttaggacgttaggtttaacgtacttacgtaccggtaataacgttaatagttacggaacgtttacgaccgtttcccggtaaaccggtttccggggtaggtttacgtaccggttacgggtaaccggggtaaccgggggaacggttaaacccgggttaaagttaccggtaacggtaaacccggtaaccggttaagggtccgggttaaacgtcccgttaaccggtaactcctttaacggtgttacccgggtttacttacccnccggttacccccggg

SEQ ID NO: 36939 - DNA, 672 bp, Homo sapiens
  misc_feature: GYAE6OF02IZSUM.19.10.A10.1.454.CMB.1.raw
  modified_base (447)..(447): a, c, t, g, unknown or other
  misc_feature (447)..(447): n is a, c, g, or t
  modified_base (487)..(487): a, c, t, g, unknown or other
  misc_feature (487)..(487): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctgctccagatagcgacggagtaattttcgtgacgtcagtctaccgaggtcctacctgttcttcgacccgtgggaaagcgtccacctctcctgcgacgggcatagagtcggttacgacgtacgtccttaccgttctttcgccgttacggtaccacggcgtaacggacgaccgtggaccgacggcctccgagtccttccgttcgttttacgtcggtcgtccgtcgaacccggacggtcctacggtcggtaccaccgtacccgacggtacgtcgtggtcggcgtacgttcgtgtcgtacggactacgtcttaccacgtcttcgaaccntaccgtacggcgttacggcgttacgaccgtaccgtaagtnttaccggtttagtctacggttacggtttaatctaacgtacttaacgtatacgttcgattcgtaccgtacgttccgtacgtacggtcgttaacggttcggtcggtaacgtacggtacgtaagtacgtaatacgtaaccgtggtagtcggtacacgcgtactcgtactggtacttacggtcccttcg

SEQ ID NO: 36940 - DNA, 976 bp, Homo sapiens
  misc_feature: GYAE6OF02GWZCS.19.10.A10.1.454.CMB.1.raw
  modified_base (205)..(205): a, c, t, g, unknown or other
  misc_feature (205)..(205): n is a, c, g, or t
tcagtactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggngtcgtgggggaggcgtggtccgaggcccgggggtccctgagtacctctcctgtagaagttagtggattcaacttcgactaggcggctggtctgtgcgtgggttccgccgaggcctacgaggggaacggggcgtgggaggttggggtcggccgcgagtacgaaggaaggagtagtacgtaggaaggggaggacggtaacgacggaacctaccggcgtcggaccgtacccgggtaggaacggacggaccgtaacggtaccttttaacccgaggtttaaccggtaacgtaaacgggtaggtaaacgttcgtaaaacgtttacccggaaaacgttaaaaggttacccggttaaagggttaccgtttaaacggtttacccggtaaggttaaacccgtaaaaagtttaccccggaaaaaccttaccgggtaaaaccccgggtttaaacggggaaaacccggggtaacccccggggttaaaaacgggaaccccgtaaacccggttaaccggttaaaccccgttttaaaactttttttaaacccgggttaaaccgtttttaaaccgggtaaaaacccttaaaacgggtttaacggttaaaacggggtttaaaaccccggggggggtttaaaccgggggggggggtaaaaaaccccggggggggtttaaaagggttttccccggggggggaaaaccccggggttaaacccccggggggttttaaaccccggggtttcccgggggttttaacccccgtttccccggggttttaacccccgg

SEQ ID NO: 36941 - DNA, 894 bp, Homo sapiens
  misc_feature: GYAE6OF02IH0MO.19.10.A10.1.454.CMB.1.raw
  modified_base (52)..(52): a, c, t, g, unknown or other
  misc_feature (52)..(52): n is a, c, g, or t
tcagtactctcgtgcacgaccggtgctcgatttagcgtcgatctcagggganctctgggagaggagtcccagccttggggttcccgagtgttttcgttcagtgatcaggactgaacacgtaggactcaccatggagtttggcctgagttggtatttttcctttctgtcttaattttaaaaggtgtcctgtgtgaggtgcgtccgtggtggaggtcggtgggggaggtcggtggtccgacgggccccggggggtccctggacgtactcctccgtaggtaagtaagttatggtacttactaacttcgctaggcggtcgtggctggtcgtcgttgggttccgaccgacggtccgtaccggaagggggacggggtcggtaggggtagggttcgggggttcggaccggtcgtagtacgaaaggaggagtaagtaaggtagggaaggggaggacgaacgagacgtacgctacgacccgtaaccggtaggaacgacggaccgtaagttaaccgtttaccaagtttacggtaacgaaaggtagtaagttacgtaacttaaccgaaaagtaaacgttaacgtagttacgttaacttacgagtaaactaaaggtacgaaactaccggtacgtaaacgggaaaccggtaaccggaaacggaaccaaccgtaacgttacccgtttaaaacgttttaacgttaaacgttttaaccgtaaaaaccgtaaaacggttaacggttaaaacgggttaaccgggggggtaaaaacggggggggggggtttaaaaccgggggtttaaaaaccgggggtttccccggggggggaaaacccggtttaaaccccgggggggttaaacccccgtttacgggggttttacccccggtttaccccgggttaaccccggg

SEQ ID NO: 36942 - DNA, 725 bp, Homo sapiens
  misc_feature: GYAE6OF02FJNYL.19.10.A10.1.454.CMB.1.raw
  modified_base (199)..(199): a, c, t, g, unknown or other
  misc_feature (199)..(199): n is a, c, g, or t
  modified_base (524)..(524): a, c, t, g, unknown or other
  misc_feature (524)..(524): n is a, c, g, or t
tcagtactctcgtgcacgaccggtgctcgatttagcgtcgatctcagggggaagagctgctcagttaggacccagagggaaccatggaaaccccagcgcagcttctcttcctcctgctactctggacctcccagatacgcaaccggagtaaattttctgacgcagtctccaggcacctgtctttcgacccgtgggaaancgccaccctctcctgcgagggaccgtaataacggtagttcgttacgaaccagtcctacctttcgtttagcccgtaggtaacccaggaccgagaaccggtaccgtcggaccacggtcctaccccgaaggtcccttactttacggtttagcggtccaccggttacccaaccgtacgggaccacgtcggaccactaccccggataggttccgaagtcggactaggttcgtacggtcggtaacgggactacgttaccttaccgtaacctttccaccgtaaacactcccgagtaccgagtaacgtggaaccgtaccgtagttaaacgttnttacgacgtagttacgtttaactacgtacgtacgaaacgtaattacgaagtcgttacgaacgtccgttaaccgttaccgggttggtacgtacgttagggtttaccggaccggtaacgggtaacctaaggttagtaccgtaacgtaacgtaacgtggttcacggacctacgacttcgtacgttcgtcttactaccgttcccg

SEQ ID NO: 36943 - DNA, 451 bp, Homo sapiens
  misc_feature: GYAE6OF01EKOOG.13.46.E02.1.454.CMB.1.raw
  modified_base (437)..(451): a, c, t, g, unknown or other
  misc_feature (437)..(451): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttcccccctggcaccctcctccaacgagcacctctgggggcacagcggccctgggctgcctggtcaaggactacttcctagtacgtgactgagcgggctggcaaggcgcatagnnnnnnnnnnnnnnn

SEQ ID NO: 36944 - DNA, 538 bp, Homo sapiens
  misc_feature: GYAE6OF01AV9LK.13.46.E02.1.454.CMB.1.raw
tcagtcacgtactacacgaccggtgctcgatttagactcatctacagggaaagggtgatcaggactcctcagttcaccttctcacaatgaggctccctgctcagctcctggggctgctaatgctctgggtcccaggatttagaggggatgctgtaatgactcagtctccactctccctgcccgtaaaaccccttggacagccggcctccatctcctgcagttctagtcaaagcctcgtacatcatgatggcacactacttgaattggttcggcagaggccaggccaatctctaaggcgacctaatttataaggtgtctgacagggacctccggggtcccagacagattcgagcggcaggtgggtcaggcacgtgatttcacactagaaatcagcgagggtggaggcgtaggaggtagttgttagttgggcttcgttatttattgctatgactaagcaacacacgtcggccgtacgtacgtttcggaccgtaggggaccaaggcgtagggaagacgtacaatacgaacgtggtggtacg

SEQ ID NO: 36945 - DNA, 502 bp, Homo sapiens
  misc_feature: GYAE6OF01AMWN3.13.46.E02.1.454.CMB.1.raw
tcagtcacgtactacacgaccggtgctcgatttagactcatctacagggaaagggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcacctaatttataaggtgtctgacagggactccggggtccagacagattcagcgcagtggtcaggcactgatttcacactgaaatcagcagggtgaggctgaggatgttatgggctctattatgcatgcaagcaacacactggccgtactacgttttggacccgtaggggaccaaggcttggagtatcaaatcgaactggtggtcg

SEQ ID NO: 36946 - DNA, 506 bp, Homo sapiens
  misc_feature: GYAE6OF01CFP05.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccgggtccagacagattcagcggcagtggtcaggcactgatttcacactgaaaatcagcagggtggaaggctgaggatgttattggctctattattgcatgacaagcaaacacactggaccgtacacttttggccgtaggggaccaaggctaggagatacaatacgaactggtggtcg

SEQ ID NO: 36947 - DNA, 516 bp, Homo sapiens
  misc_feature: GYAE6OF01CU567.13.46.E02.1.454.CMB.1.raw
  modified_base (316)..(316): a, c, t, g, unknown or other
  misc_feature (316)..(316): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaaggtntctagacagggactccggggtcccagacagatcagcgcagtggtcaggcactgatttcacactagaaatcagcgagggtggaggctgagatgtagtgggctctattatgcatgacaagacaacacactcggccgtacgtaccgttttaggaccgtacggggaccaaggcgtaggagatacaatacgaacgtgtggtaccg

SEQ ID NO: 36948 - DNA, 562 bp, Homo sapiens
  misc_feature: GYAE6OF01DLBQX.13.46.E02.1.454.CMB.1.raw
  modified_base (315)..(315): a, c, t, g, unknown or other
  misc_feature (315)..(315): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtntctgacagggactccggggtcccagacagattcagcggcagtgggtcagggcactgatttcacaactagaaaatacaggacgaggggtcggaagggcgtggagggattgttaagttgggtctcttatttatttgacatagtcaagaccaacaccactgggacccgtacgtaccgttttacgggaccgaaggggaacccaaggtcgtaaggaggaacttacgaaattaccggaaacgtggtggtaccg

SEQ ID NO: 36949 - DNA, 422 bp, Homo sapiens
  misc_feature: GYAE6OF01BKIQB.13.46.E02.1.454.CMB.1.raw
  modified_base (414)..(422): a, c, t, g, unknown or other
  misc_feature (414)..(422): n is a, c, g, or t
tcagtcacgtactacacgaccggtgctcgatttagactcatctacagggaaagggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaagggcccatcggtcttccccctggcaccctcctccaagacgcacctctggggcacagcggccctgggctgcctggtcaagggactacttcctagtacgtgactgagcgggctggcaaggcgcatagnnnnnnnnn

SEQ ID NO: 36950 - DNA, 423 bp, Homo sapiens
  misc_feature: GYAE6OF01BAER2.13.46.E02.1.454.CMB.1.raw
  modified_base (417)..(423): a, c, t, g, unknown or other
  misc_feature (417)..(423): n is a, c, g, or t
tcagtcacgtactacacgaccggtgctcgatttagactcatctacagggaaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtctggggccaagggaccacggtcaccgtctcctcagcctccaccaagggcccatcggtcttccccctggcaccctcctccaagagcacctctggggcacagcggccctggctgcctggtcaggactacttcctagtacgtgactgagcgggctggcaaggcgcatagnnnnnnn

SEQ ID NO: 36951 - DNA, 542 bp, Homo sapiens
  misc_feature: GYAE6OF01BRN91.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttactaaggtgtctgacaggactccggggtccagacagattcagcgcagtggtcaggcactgatttcacatagaaatcagcgagggtggaggctgaggatgttagttggcttctattatgctatgactaagcaacacacgtcggaccgttactacgttttacggccgtaaacggggacccaaaggtccgtagggaagaacgttacgaaacggtaccggaaacttgggtacggtaccg

SEQ ID NO: 36952 - DNA, 590 bp, Homo sapiens
  misc_feature: GYAE6OF01CPJ5K.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgtacctaatttataaggtgtctggacacgggacgtccggggtcccagtaccgagacttcgagcggcaggtggtacaggcacgtgattcacactagaaatcagcgagggtggaggcgttaggaggtagttggttagttgggtccttagttatttagttgtacgaagttacgacgtaacgaccaaacaccgtacgtcggtacccgttaacgtacgttttacgggacccgtaacggggtaaccaacggtcgtagggaacgtacgttaccaaagtacgtaaacgtggtacggtaccg

SEQ ID NO: 36953 - DNA, 505 bp, Homo sapiens
  misc_feature: GYAE6OF01C7BOD.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagagggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgccctaatttataaggtgtctgacagggactcccggggtcccagacagattcagcggcagtgggtcaggcactgatttcacactgaaatcagcagggtggaggctgaggatgttatgggctctattattgcatgcaagcaacacactggccgtacacttttggccgaggggaccaaggctggagatcaatcgaactgtgggtaccg

SEQ ID NO: 36954 - DNA, 725 bp, Homo sapiens
  misc_feature: GYAE6OF01E50C7.13.46.E02.1.454.CMB.1.raw
tcagtcacgtactacacgaccggtgctcgatttagactcatctacagggaaagggtgatcaggactacctcagttcaccttctcacaatgaggctccctgctcagctccgtggggctgctaatgctcgtgggtcccaggatttaggaggggatgctgtaatgactcagtctccactcctccctgcccgtcacccttggacagcccggcctccatcctcctgcagttcagtcaaagcctcgtacatcatgagtggcacaccttacgttgaagttggttcggcagacgccaggccaatcctaccaaggccgtaccttaagtttagtaacggtgtacgtcgacggacggtaccgtcccggggtaccagacagacttcgacggtcggacgtacgggttcgggtcgacgggtacctaacgtacgttaacgttttaccaaacctaacgtaacggaaaaacttccggaagggaccgggtaagggggttacggggaacggttcggttaagggagggttagtttaggttttaggtttcggggtacctttacgtttaagtttaagttcggtactaagttacggacaaacggtacccaaacgtacccgtaccgggttaccggtacccggtttaccgttaaccgggtttaccgggaacccgggaacggggtaacccaacgggtcgtacgggaaattacgtaacctaaggttacccggaacgttcgggtacggtcccg

SEQ ID NO: 36955 - DNA, 513 bp, Homo sapiens
  misc_feature: GYAE6OF01A6D1A.13.46.E02.1.454.CMB.1.raw
  modified_base (315)..(315): a, c, t, g, unknown or other
  misc_feature (315)..(315): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtntctgacagggactccggggtcccagacagattcagcggcaggtggtcaggcacgtgatttcacactgaaatcagcagggtgaggctgaggatgttagttggctctattattgcatgacaagcaacacactcggccgtactacgttttggacccgaggggaccaaggctaggagactacaagtacgaactggtggtacg

SEQ ID NO: 36956 - DNA, 433 bp, Homo sapiens
  misc_feature: GYAE6OF01DLVJD.13.46.E02.1.454.CMB.1.raw
  modified_base (211)..(211): a, c, t, g, unknown or other
  misc_feature (211)..(211): n is a, c, g, or t
  modified_base (424)..(433): a, c, t, g, unknown or other
  misc_feature (424)..(433): n is a, c, g, or t
tcagtcacgtactacacgaccggtgctcgatttagactcatctacagggaaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtattttcngtgcgaggttagcagtggctggtacttacgcaatggacgtctggggccaagggaccacggtcaccgtctcctcagcctccaccaagggcccatcggtcttccccctggcaccctcctccaagacgcacctcgtgggggcacgagccggccctgggctcgcctggtcaagctacttcctagtacgtgactgagcgggctggcaaggcgcatagnnnnnnnnnn

SEQ ID NO: 36957 - DNA, 583 bp, Homo sapiens
  misc_feature: GYAE6OF01E1KXM.13.46.E02.1.454.CMB.1.raw
  modified_base (342)..(342): a, c, t, g, unknown or other
  misc_feature (342)..(342): n is a, c, g, or t
  modified_base (391)..(391): a, c, t, g, unknown or other
  misc_feature (391)..(391): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctctgcatagaatgatatacctattggattggtatctgcagaagccgagggcagtcctccacaactcctgatctagttgggttctaagtcgggcctccggggtccctgacnggttcaggtggcagtggatcgaggcactagtatttacactagtaaactnaagcaggtagtggagcgtggaggtagttgggtttagggtttatacgtgtaccgtagtcgacgtaagtcctacgtaaccgtaaacttccgtacggtaccgggtacgttttcccgggtcccgttaggggaacccgtaaagggtagggaacgtaacgtaaccgaaaacggttaacgtggtcgggccttaaccggg

SEQ ID NO: 36958 - DNA, 534 bp, Homo sapiens
  misc_feature: GYAE6OF01CM89J.13.46.E02.1.454.CMB.1.raw
  modified_base (315)..(315): a, c, t, g, unknown or other
  misc_feature (315)..(315): n is a, c, g, or t
  modified_base (415)..(415): a, c, t, g, unknown or other
  misc_feature (415)..(415): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtntctgacagggactccgggtcccagacagattcagcggcagtggtcaggcacgtgatttcacactgaaatcagcagggtggaggctgaggatgttagtggntctattattgcatgacaagcaacacactcggaccgtactacgttttcggaccgtacgggggacccaaggtccgtagggaacgtacgttacaaacgtaccgtaaacgtggtcgggtaccg

SEQ ID NO: 36959 - DNA, 534 bp, Homo sapiens
  misc_feature: GYAE6OF01BO6PD.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggtttcggcagaggccaggccaatctctaaggcgcctaatttataaggtgtctgacagggactccggggtcccagacagattcagcggcagtggtcaggcactgatttcactactgaaaatcagcagggtggaggctgaggattggttagttgggcttctattattgctatgcaagcaaacacacgtggccgttactacgttttacggaccgtacggggtacccaaggtccgtaggagaacgtaccaaagtaccgaacttggtggtaccg

SEQ ID NO: 36960 - DNA, 429 bp, Homo sapiens
  misc_feature: GYAE6OF01EOMF7.13.46.E02.1.454.CMB.1.raw
  modified_base (422)..(429): a, c, t, g, unknown or other
  misc_feature (422)..(429): n is a, c, g, or t
tcagtcacgtactacacgaccggtgctcgatttagactcatctacagggaaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtctggggccaagggaccacggtcaccgtctcctcagcctccaccaagggcccatcggtccttccccctggccaccctcctccaagagccacctctgggggcacagcggccctggctgcctggtcaaggctacttcctagtacgtgactgagcgggctgggcaaggcgcatagnnnnnnnn

SEQ ID NO: 36961 - DNA, 419 bp, Homo sapiens
  misc_feature: GYAE6OF01C29PX.13.46.E02.1.454.CMB.1.raw
  modified_base (326)..(326): a, c, t, g, unknown or other
  misc_feature (326)..(326): n is a, c, g, or t
  modified_base (410)..(419): a, c, t, g, unknown or other
  misc_feature (410)..(419): n is a, c, g, or t
tcagtcacgtactacacgaccggtgctcgatttagactcatctacagggaaaggggctggtgtgggtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaagaggtggctggtcgcatggtttttgatctctggggccaggggacaatggtaaccgtctcttcagcctcaccaaggcccatcggtcttcccctggcgccctgctccaggancacctccgagcgcacagcgccctgggctgcctggtcaaggactacttccagtacgtgactgagcgggctggcaaggcgcatagnnnnnnnnnn

SEQ ID NO: 36962 - DNA, 575 bp, Homo sapiens
  misc_feature: GYAE6OF01EN241.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctctactctccctgcccgtcacccttggacagccggcctccatctcctgcagttctagtcaaagcctcgtacatcatgatggcacacctactgaattggttcgcagaggccaggccaatcctaccgaaggccgaccttaatttataaggtgtctgacgagggaccgtccgggtcccagacagtatcgagcggcgaggtcgggtcaggcagtgtatttcactactagaaactcgagcgaggggtggaggcgtaggaggtagttgttagttgggtcttagttattagttgctagtgacaagaccaacgactaccgtcggacccgttacgttaccgtttcgggacccggtaacggggaacccaaggtccgtagggaagacgtacgaacgtaccggaacgttggtcggtaccg

SEQ ID NO: 36963 - DNA, 575 bp, Homo sapiens
  misc_feature: GYAE6OF01EFLYM.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacactacttgaattggttcgcagaggccaggccaatctccaaggcgcctaatttataatgttttacccggactcgtgggtcccagacagattcagcgcagtgggtcaggcactgattcactattagaaatcaccgagggtgaggctagaggatggttgggtatttatactgcatgacaagctaactatttcgtcggtccttttctaccgtttccgggcccgttagggaaccctaaaggtcgggtaactaaccccgtaaagttacccggtaaacttcgggttacggaccgttcggaccctaaccctaacgttccgttcggtttaccc

SEQ ID NO: 36964 - DNA, 561 bp, Homo sapiens
  misc_feature: GYAE6OF01BXY1F.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggacctccggggtcccagacagattcagcggcagtgggtcaggcactgatttcacactagaaatcagcgagggtggaggctggaggtagttggttagttgggtcttcttagtttagttgctaagtggtacaagacaaaccactacgtcggacccgtaccgtaccgttttacggaccgtacgggggacccaaggtccgtagggaagtacgtacaacgttacggaacgttggtcggtacg

SEQ ID NO: 36965 - DNA, 563 bp, Homo sapiens
  misc_feature: GYAE6OF01EOJ18.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctactgaattggttcgcagaggccaggccaatcctaccgaaggccgaccttaatttaagtaaggttgtctagacgagggtaccgtccggggtcccagtacagtattcgagcggcaggtgggtcaggcacgtgtatttcacactagaaatcgaagcgagggtggaggcgtagaggtattgttagttgggctcttaattattgactagtgacaacgacaacacacgtggaccgtaacgtacgttttacggaccgtaacggggtaaccaaggtcgtaggtaagactacaaagtaccgaaacgtggtggtaccg

SEQ ID NO: 36966 - DNA, 455 bp, Homo sapiens
  misc_feature: GYAE6OF01DT1R1.13.46.E02.1.454.CMB.1.raw
  modified_base (443)..(455): a, c, t, g, unknown or other
  misc_feature (443)..(455): n is a, c, g, or t
tcagtcacgtactacacgaccggtgctcgatttagactcatctacagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggctacttttgatatcgtggggccaagggtcgatggtcatcgtctcttcagcctccaccaacgggcccatccgggttccttccccccgtggccgcccctgcctccgaggacgccaccctccgagacgcacagccggccctgggctgcctggtcaaggactacttcctagtacgtgactggacgcgggctggcaagggcgacagtagnnnnnnnnnnnnn

SEQ ID NO: 36967 - DNA, 518 bp, Homo sapiens
  misc_feature: GYAE6OF01BX8H1.13.46.E02.1.454.CMB.1.raw
  modified_base (423)..(423): a, c, t, g, unknown or other
  misc_feature (423)..(423): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaatcagcagggtggaggctgaggatgttattgggctctatnttgcatgacagcaacacactggccgtactacgttttggaccgtagggggacccaaggctagggagacgtcaaacgttccgaaacttggtggtccg

SEQ ID NO: 36968 - DNA, 595 bp, Homo sapiens
  misc_feature: GYAE6OF01B80BQ.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtcaaagccctcgtacatcatgagtggcacacctacttgtaattggttcggcagacggccaggccaatcctaccgaacggccgtaccttaatttagtaaaggttgtcgtgacgacgggaccgtccggggtaccagacagtacttcgagcggcaggtggtacgaggcacgtgtactttcacactagaaactcgagacgagggtaggaggcgtaggaggtagttggttagttgggcttacgttatttagttgtactatgacgaagacaacacgtaccgtacggtccgttacgtacgtttacggaccggtacgggaacccgaaggtcgtagggtaacgtacgtacgtaacgtaccggtaacgtggtcggtaccg

SEQ ID NO: 36969 - DNA, 551 bp, Homo sapiens
  misc_feature: GYAE6OF01DUCH3.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatcctccaaggcgcctaatttagtaaggtgtctgacagggacctccggggtcccagacagattcagcggcaggtggtcaggcacgtgatttcacactagaaactcagcgagggtggaggcgtggagggtattggttagttgggtcttacttagtttattgactagtgacaagacaacacacgtcggtacccgttacgtaccgttttacggaccgtacggggaaccaaggtcgtaggagactacaactacgaacgtggtgtccgg

SEQ ID NO: 36970 - DNA, 577 bp, Homo sapiens
  misc_feature: GYAE6OF01AD1FR.13.46.E02.1.454.CMB.1.raw
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggtttcggcagaggccaggccaatctaccaaggccncctaatttataaggtgtctgacagggacctccggggtcccagacagattcagcggnaggtggtcaggcactgacgtttcacactagaaatcgagcgagggtggaggctaggaggtagttggttagttgggtcttacttagtttagttgctatgacgtaagaccaactacgtacttacgtaccgttacctaccgttttgggacccggtaacgggggtaacccaaggtcgtacgggaagtacgtacgtaaacgttaccggtaacgttgggtcggtaccg

SEQ ID NO: 36971 - DNA, 663 bp, Homo sapiens
  misc_feature: GYAE6OF01CBFBJ.13.46.E02.1.454.CMB.1.raw
  modified_base (384)..(384): a, c, t, g, unknown or other
  misc_feature (384)..(384): n is a, c, g, or t
  modified_base (422)..(422): a, c, t, g, unknown or other
  misc_feature (422)..(422): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttaggaggggatgctgtaatgactcagtctccactctccctgcccgtcacccgttggacacgccggcctccatcctcctgctagttctagtcaaacgtcctacgtacatcatgagtcggcaccacctacttagtaattggttcgcaggacggccaggccaatcctaccgaacggtccgaccttaatttagtaaggtcgtctggaacgacgggaccgtcccgggtacccagacagattcgagcggngaggtggtacacggctacgtgtactttcgactacgtanaaagtcaaggacgtagggtaggacggtacgtaggaagggtagttggtttaaggtttcgggtacttacgtttaagtttaagtttggactaacgttaggaacgtaaacggactaaaccgtaaccgtaccgttaccgggtaccgttaaccgttaccgttttacgggacccggtaacggggaacccaacgggtcgttagggaacgttaacgtaccgtaactacggtaaccgttgggtggtacccg

SEQ ID NO: 36972 - DNA, 444 bp, Homo sapiens
  misc_feature: GYAE6OF01BU8U4.13.46.E02.1.454.CMB.1.raw
  modified_base (367)..(367): a, c, t, g, unknown or other
  misc_feature (367)..(367): n is a, c, g, or t
  modified_base (429)..(429): a, c, t, g, unknown or other
  misc_feature (429)..(429): n is a, c, g, or t
  modified_base (434)..(444): a, c, t, g, unknown or other
  misc_feature (434)..(444): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccggaaccctggtcaccgtctcctcacgcctccaccaagggcccatccggtcttccccctggccaccctcctccaagacgcacctctggggcacngcggccctgggctgcctggtcaaggctactcctagtcgtgactgagcgggctggcaaggcgnatagnnnnnnnnnnn

SEQ ID NO: 36973 - DNA, 550 bp, Homo sapiens
  misc_feature: GYAE6OF01CGKZS.13.46.E02.1.454.CMB.1.raw
  modified_base (297)..(297): a, c, t, g, unknown or other
  misc_feature (297)..(297): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcgcagaggccaggccaatctccaaggcncctaattataaggtgtctgacagggactccgggtcccagacagattcagcggcgagtggtcaggcactgatttcacactagaaaatcagcgagggtggaggctggaggtattggttagttgggtcttacgttattagttgctagtgactaagacaacacacgtcggaccgtacgtacgttttcgggacccgtaacggggacccaaggtcgtagggaagtaacgtaccgaagttaccgaacgttggtggtaccg

SEQ ID NO: 36974 - DNA, 428 bp, Homo sapiens
  misc_feature: GYAE6OF01EES39.13.46.E02.1.454.CMB.1.raw
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (414)..(428): a, c, t, g, unknown or other
  misc_feature (414)..(428): n is a, c, g, or t
tcagtcacgtactacacgaccggtgctcgatttagactcatctacagggaaaggggctggtgtgggtctcacggattgacaatgatgggagagacacaatccacgcggattctgtgaggggccgattcaccacatcgagagacaacgccaagaacacggtatatctgcaaatgaaacagtctgagaggcgaagacacggcggtttacttctgtgcaagaggtggctggtcgcatggttttgatctcgtggggccaggggacaatggtaaccgtctcttcagcctccacaaggcccatcgtcttccccnggccncctgctcagngcacctcgagngcacagcggcctggctgcctggtcaagtactacttcctagtacgtgacgtgacggccgggactggacaaggcgacatagnnnnnnnnnnnnnnn

SEQ ID NO: 36975 - DNA, 554 bp, Homo sapiens
  misc_feature: GYAE6OF01A181F.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgcagaggccaggccaatctccaacggcgacctaatttataaggtgtctgacgagggactccggggtcccagacagattcagcggcaggtggtcaggcactgatttcacactagaaaatcagcgagggtggaggctgaggtattggttatgggtcttcttattattgactagtgacgaagcaacacacgtcggtaccgtacgttacgtttcggaccggtacggggaaccaacggtcgtagggaacgaacgtaccgaaacgttaccgtaacgttggtacgggtaccg

SEQ ID NO: 36976 - DNA, 804 bp, Homo sapiens
  misc_feature: GYAE6OF01DIMW6.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggatttaggaggggatggctgtaatgactcagtctccactctccctcgcccgtctacccttggacagcccggcctccatctcctgctagttctagtcaaagcctcgtacatcatgagtcggacactacctacttagtaagttggttcgcgagacggccgaacggcctaatccgtaccgacggtaccgtaccttaagttttaagtaacggttgtcgtaggaacgacgggtaccgtcccggggtaccaggaacgaggtaactttacgacggtaccgggacgtagggtcggggttacgacgggtacgtaacgttaggttaacttttacccgaaccgttaaacgttaacggtaaaaaacgttaccggaacgggtccggtaaacggggggttagggtaacgggggttaccgttaaggggtaaagggttacggttttaagggttttaacgggtttacgggtttaccgtttaaccgttttaaagttttaagtttacggttaccgtaaggtttcgaacccgtaaacgaaccctaaacccgtaacggtaccgttaccgggtacccgttaacccgttacggttttaccgggacccgggtaaccggggtaacccgtaacggtcgtaacggggtaacgaacgttacgtaaacgttaccggtaacggtcggtggtaccgg

SEQ ID NO: 36977 - DNA, 643 bp, Homo sapiens
  misc_feature: GYAE6OF01C06AS.13.46.E02.1.454.CMB.1.raw
  modified_base (213)..(213): a, c, t, g, unknown or other
  misc_feature (213)..(213): n is a, c, g, or t
  modified_base (314)..(314): a, c, t, g, unknown or other
  misc_feature (314)..(314): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccgcctccatctccngcagttctagtcaaagcctcgtacatcatgatggcacactacttgaattggttcggcagacggccaggaccaatctaccgaggcgacctaattataaggtntactgacagggacgtccgggtccagacagtacttacgagtcggactaggtcgggtcagggcacgtgtatttcactactagaaatcgagcgagggtggaggcgtaggaggtagttaggtttagtgggttacttacgtttaactttagttaggtactaagttacggaacgtaacgacaaacctaacgtaccgttacgggtaacccgttaaccgttaccggtttttaccgggacccggtaaacgggggtaacccgtaacggtaccggttaacgggtaaggtaacgtaccgttaaacggttaccggtaaaccgttagggttcgggtaacccgg

SEQ ID NO: 36978 - DNA, 606 bp, Homo sapiens
  misc_feature: GYAE6OF01B68Z0.13.46.E02.1.454.CMB.1.raw
  modified_base (405)..(405): a, c, t, g, unknown or other
  misc_feature (405)..(405): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaagcgacctaatttataaggtgtctgacagggacctccgggtccagacagacttcagcgcgagtggtcaggcacgtgatttcactactagaaactcgagcgagggtggaggngtaggaggtattggtttaagttgggtcttacgtttaatttagttgacgtaagtcgacgtaaacgtaccaaactaccgtaccgttacgggtacccgttacgttaaccgtttttacgggacccgtaacggggggtaaccctaaacgggtccgtagggaaacgacgttaaccgaaacgttaaccggaacttgggtcggtacccg

SEQ ID NO: 36979 - DNA, 614 bp, Homo sapiens
  misc_feature: GYAE6OF01CG7PC.13.46.E02.1.454.CMB.1.raw
  modified_base (310)..(310): a, c, t, g, unknown or other
  misc_feature (310)..(310): n is a, c, g, or t
  modified_base (566)..(566): a, c, t, g, unknown or other
  misc_feature (566)..(566): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttaggaggggatgctgtaatgactcagtctccactctccctgcccgtcaccctggacacgccggcctccatctcctgctagttctagtacaaagcctcgtacatcatgatggcacacctatgaattggttcgcagagcagccaatctacagcgtactaatttacgtaagtntctgacgtaggacgtccgggcagacagatcgagcgacaggtcggtacaggctacgtgtacttcaacactagaaatcgaggacgtagggtggagcgtaggaggtagttaggttagtgggtcttactttaatttgttacgactaaggttcaacgtaaacggactaaaccgtaccgtaacggtcggtaaccgttaccgttaacggtttccgggaaacccggtaacggggtaaaccccgaaggtccggtaacggggtaanaaccgttaccgaaacggttaccggtaaacggttcggtcgggtaacccg

SEQ ID NO: 36980 - DNA, 403 bp, Homo sapiens
  misc_feature: GYAE6OF01DQ5VV.13.46.E02.1.454.CMB.1.raw
  modified_base (398)..(403): a, c, t, g, unknown or other
  misc_feature (398)..(403): n is a, c, g, or t
tcagtcacgtactacacgaccggtgctcgatttagactcatctacagggaaagggcctggagtgggtctcaggtatttatgggaacagtgaaagaatagggtatgcggactctgtgaagggccgattcaccatctcgagggacaacgccaagaactcgctgtatctgcaaatggagagcctgagagccgaggacacggctgtatattattgtgtgagattagcgcactactttgactacgtggggccagggaccctggtcaccgtctcctcaacctccacaggccatcgtctcccctgcacctcctccagacgcacctctggggcacagcggccctgggctgcctggtcaaggactacttcctagtacgtgactgagcgggctggcaaggcgcatagnnnnnn

SEQ ID NO: 36981 - DNA, 531 bp, Homo sapiens
  misc_feature: GYAE6OF01C8VB6.13.46.E02.1.454.CMB.1.raw
  modified_base (505)..(505): a, c, t, g, unknown or other
  misc_feature (505)..(505): n is a, c, g, or t
  modified_base (508)..(531): a, c, t, g, unknown or other
  misc_feature (508)..(531): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacaggcctatattactgtgcagtgatgggccacgaccacgtacttttggagtggtgcgctcgacccgtcggggcccggacctggtcaccgtctcctcacgcctccaccgaacgggcccacgtccggtccttccccccgtggcccgtccctcgcctccgacgggacgaccacccgtcccggagacgccaccgacggccgggcccgtcggggcctcggcccgtaggtacgaaacgggtaccttaacctttccgtaacgtacgtgaccgtggacggcgggcgtggaccggaacggcgacgacgtagncgnnnnnnnnnnnnnnnnnnnnnnnn

SEQ ID NO: 36982 - DNA, 608 bp, Homo sapiens
  misc_feature: GYAE6OF01ESXQN.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccttcacccttggacagccggcctccatctcctgcagttctagtcaaagcctcgtacatcatgatgggcacacctacttgaattggtttcggcagaggccaggccaatctccaaggcgcctaatttataaggtgtctgacagggacctccggggtcccagacagatcagcggcagtggtcaggcactgatttcacactagaaaatcgagcgaggggtaggaggtctaggaggtacgttggtttaagttgggtccttacgttagtttagttgtcctaagttgccgaaagtccgaaaccgacgtaaccttggggtaccccgttaacgttaccggtttttacgggcccggtaaacgggggtaacccctaaaggtccgtaggggaacgacgttacccgaaagtacccggaaacttggtcgggttaacccgg

SEQ ID NO: 36983 - DNA, 531 bp, Homo sapiens
  misc_feature: GYAE6OF01ECUVN.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggtttcgcagagccaggccaatctccaaaggcgacctaatttataaggtgtctgacagggactccgggtcccagacagatcagcgcagtggtcaggcactgatttcacactagaaaatcagcgagggtggaggctgaggtatgttagttgggctctattattgcatgacaagcaaacacacgtggaccgttactacgttttacggaccgacggggaaccaacggcgtacggaagaactacgaaacttacgaaacttggtacggtacg

SEQ ID NO: 36984 - DNA, 734 bp, Homo sapiens
  misc_feature: GYAE6OF01BJEXC.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacacgccggcctccatctcctgcagttctagtcaaagcctcgtacatcatgatggacacacctacttgaattggtttcgacagaggccaggcccaatcctaccgaaggccgtaccttaattttataacggtgtactgacgagggtacctcccggggtccagacagtacttcgagcggcagggtggtcgagggcacgtgtactttccaacgtacgtaagtaaaagttcgaacggtacggtaagggggtacgggtacggggtaccgttagggaagggttaaggtttaggttttaaacggtttcggggggtaccttttaccgtttaagttttaacgtttaggtacccttaagttaccggtaacgaaacgggtaaccctaaaacgtaacccgtaaccgttaccggggttaaccccgttacgtttaaacccggtttttaccggggaacccggtaacggggggtaaccctaacgggtaccgttaacggggaaagttaaccgttaaccgtaacgttaaccggtaaacgttgggttacggtacccggg

SEQ ID NO: 36985 - DNA, 554 bp, Homo sapiens
  misc_feature: GYAE6OF01AJNXZ.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccgggtccagacagattcagcggcaggtggtcagcactgatttcacactagaaatcagcgagggtggaggcgtaggaggtagttggttagttgggtcttacgttattagttgactatagactaagacaaccaacgactacggtcccgttacgtaccgttttacgggccgtaacggggaccaaggtcgttaggaagagtacgaacgtaccgaaacttggtggtaccg

SEQ ID NO: 36986 - DNA, 655 bp, Homo sapiens
  misc_feature: GYAE6OF01EXEU9.13.46.E02.1.454.CMB.1.raw
  modified_base (587)..(587): a, c, t, g, unknown or other
  misc_feature (587)..(587): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (602)..(602): a, c, t, g, unknown or other
  misc_feature (602)..(602): n is a, c, g, or t
  modified_base (608)..(609): a, c, t, g, unknown or other
  misc_feature (608)..(609): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (620)..(624): a, c, t, g, unknown or other
  misc_feature (620)..(624): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (645)..(645): a, c, t, g, unknown or other
  misc_feature (645)..(645): n is a, c, g, or t
  modified_base (647)..(648): a, c, t, g, unknown or other
  misc_feature (647)..(648): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
tcagtcacgtactacacgaccggtgctcgatttagactcatctacaggaaagggctggtgggtggtctcgacggattgacaatgatgggagagacacaatccacgcggagttctgtgagggccgattccaccaccatcgagagacgaacgccaaaggaacacggtactatctgcaaatcgaacagtctgacgaggcgaagacgacggtcggtttacttctgtgacaagaggtggtctggtcgctagttggttttgatctcggtggggaccgaggggtaactaaagtagggttaacccgtcgttccttcgacggtaccctaacccgaacccgaacgggccccaacttacccggtcccctttacccccgtggaccttcccgttacgtcctccggaagggtacgaccgtaacccgttcccggaacgacggaccgtaactaacggcccggtcccgttcggggcctcggtccccttacgggtaccaacgggtaacctaccgtttacccgtaacggtttacccgtcgtaaccgtcggtaaggtcccgggtccgttcggggacctaaccgggccggtaccgtaagtaaccgggntgtcgtagntntgcncagcanngcgcncncgcnnnnngtgtgtgcggcgngngcgtcncnncngngcg

SEQ ID NO: 36987 - DNA, 498 bp, Homo sapiens
  misc_feature: GYAE6OF01A6DGL.13.46.E02.1.454.CMB.1.raw
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (476)..(498): a, c, t, g, unknown or other
  misc_feature (476)..(498): n is a, c, g, or t
tcagtcacgtactacacgaccggtgctcgatttagactcatctacagggaaaggggctggagtggttggcagtcatttcagatgatggcaatgataaatattacgcacgctccgtgaagggccgattcgccaatctccagagacaattccaggaacacgctgtacctggagatggacggcctgagacctgacgacacggcaatttatactgtgcgtagggtttatgtgttggaacgtggtacacggaaatggttcgacccgtgggccacgggaacctggtcgtcgtctcgtctcgcctccaccgaacgggcccagtccggtccttcccccgtggccgcccctgccgtccgaggtcnccaccgtccgagcgcacncgccgcccgnggctcgcctggtaccaacggtaccttcgttcctacgtacggtgtacctggacgccgggactcggggacaacgggcgactagtacggncgncnnnnnnnnnnnnnnnnnnnnnnn

SEQ ID NO: 36988 - DNA, 585 bp, Homo sapiens
  misc_feature: GYAE6OF01CJGM4.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaatttggttcggcaggaggccaggccaaatcctaccgaaggccgtaccttaaatttagtaaggtgtactggacgagggaccgtccggggtacccagacagtattcgaggcggcaggtggtcagggcacgtgtatttcactacgtagaaatcgagcgagggtggaggcgtggaggtagttggttagttgggtcttagttatttagttgctagtcgactaacgactaacacgtacgtacggtaccgttacgttacgtttaggaaccggtacggggaacctaaggcgtagggaagtacgtacgtaacgtagtaacgttggtcggtaccg

SEQ ID NO: 36989 - DNA, 428 bp, Homo sapiens
  misc_feature: GYAE6OF01DTK55.13.46.E02.1.454.CMB.1.raw
  modified_base (209)..(209): a, c, t, g, unknown or other
  misc_feature (209)..(209): n is a, c, g, or t
  modified_base (327)..(327): a, c, t, g, unknown or other
  misc_feature (327)..(327): n is a, c, g, or t
  modified_base (411)..(428): a, c, t, g, unknown or other
  misc_feature (411)..(428): n is a, c, g, or t
tcagtcacgtactacacgaccggtgctcgatttagactcatctacagggaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttcngtgcgaggttagcagtggctggtacttacgcaatggacgtctggggccaagggaccacggtcaccgtctcctcagcctcaccaaggccatcggtctccccctgcaccctcctccaagncacctcgtggggcacagcggccctggctgcctggtcaaggctactcctagtacgtgactgagcgggctggcaaggcgcagtagnnnnnnnnnnnnnnnnnn

SEQ ID NO: 36990 - DNA, 538 bp, Homo sapiens
  misc_feature: GYAE6OF01BVTYV.13.46.E02.1.454.CMB.1.raw
  modified_base (351)..(351): a, c, t, g, unknown or other
  misc_feature (351)..(351): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagagggatgctgtaatgactcagtctccactctccctgcccgtcacccttggacagccggcctccatctcctgcagttctagtcaaagcctcgtacatcatgatggcacacctacttgaattggttcgcagaggccaggccaatctccaaggcgcctaatttataaggtgtctgacgagggactccggggtcccagacagatcgagcggnaggtggtcaggcactgtatttcactactagaaatcgagcgagggtggaggctaggagtattggttagttgggacttcttatttagttgctatgactaagacaacacgacgtcggaccgttactacgtttcggaccgtaggggaccaaggtcgtaggagactacgaagtacgtaaacgtggtcgtacg

SEQ ID NO: 36991 - DNA, 532 bp, Homo sapiens
  misc_feature: GYAE6OF01C6YF6.13.46.E02.1.454.CMB.1.raw
  modified_base (172)..(172): a, c, t, g, unknown or other
  misc_feature (172)..(172): n is a, c, g, or t
  modified_base (510)..(532): a, c, t, g, unknown or other
  misc_feature (510)..(532): n is a, c, g, or t
tcagtcacgtactacacgaccggtgctcgatttagactcatctacagggaaaggggctggagtgggtaggtttcattaggagcaattctcatgatgggacaacagaatacgccgcgtctgtaaaaggcagattcaccatctcaagagatgagtccagaagcatcgcctttcngcagatgagtagcctgaagaccgaggacacagccatctattactgtgctaagagagttattgcagttccctacgacctgctagtcgggggtccgttgggtcggccacggtcggggccgacgggccacccgtcggtccacccggtcctccgcacgccctccaccgaacgggcccacgtccgtccttcccccgtgcctaccctccctaccaacgcgccaccgtcgtcggggcacgacggccggcccgtgggcctcgccgtggtacaacggtactaccgttcgtaacgttacgtcgtacgtcgacggccgggtcgtacggacgaacgggcgactagtagcnnnnnnnnnnnnnnnnnnnnnnn

SEQ ID NO: 36992 - DNA, 590 bp, Homo sapiens
  misc_feature: GYAE6OF01ETJTE.13.46.E02.1.454.CMB.1.raw
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcagagcctcctgcatagaatgatatactattgattggtatctgcagaagccgaggcagtctccacaactcctgatctagttgggttctaagtcgggcctccggggtcctgacgaggttcagtggcagtgatcgaggcactagtatttacactanaaatnagcagagtggagcgtagaggtagttgggtttagggtttattacgtgtactagtgacgtaagtcttacgtaactaaacctcgtacggtaccggttaccgtttccgggtaccccggttaacggggaaacccgtaaagggtaccgggtaaagtaaccgtaaaccgtaaaaccgtacgttacggtagggtaccctggacccgtaaacccg

SEQ ID NO: 36993 - DNA, 604 bp, Homo sapiens
  misc_feature: GYAE6OF01BFQUJ.13.46.E02.1.454.CMB.1.raw
  modified_base (418)..(418): a, c, t, g, unknown or other
  misc_feature (418)..(418): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcacccttggacagcccggcctccatctcctgcagttctagtcaaagcctcgtacatcatgatggcacacctacttgaattggtttcggcaggacggccaggccaatctccgaaggctacctaatttactaaggtgtctgaacgaggacgtccggggtcccagactagattcgagcggacaggtcgggtcagggctacgtgtatttcactactagaaaatcgtagacgtaagggnggagacgtggagtagtagtttacgtgggtccttaagttactttaagttgactacgtagaaccgtaagacctaacaacgacgtacggtccgttaacttaccggtttaacggcccggtaaacgggacctaacggtcgttacgggaacgtaaccgttactaaagtacccggaagttggtacggtacccg

SEQ ID NO: 36994 - DNA, 524 bp, Homo sapiens
  misc_feature: GYAE6OF01EOISH.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgcagaggccaggccaatctccaaggcgacctaatttataaggtgtctgacgagggacgtccgggtcccagacagatcagcggcagtcggtcaggcatgtatttcacactagaaatcagcgagggtggagcgtagaggtattgttagttggcttacgtatttatgctagtgactaagacaacacacgtcggcctactacgtttggaccgtacggggaccaaggtcgtaggagatacaagtacgaacgtggcgtacg

SEQ ID NO: 36995 - DNA, 673 bp, Homo sapiens
  misc_feature: GYAE6OF01CO1T1.13.46.E02.1.454.CMB.1.raw
  modified_base (394)..(394): a, c, t, g, unknown or other
  misc_feature (394)..(394): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagagggatgctgtaatgactcagtctccactctccctgcccgtcacccttggacagccggcctccatctcctgcagttctagtcaaagcctcgtacatcatgatggcactacctacttagaagtttggttcggcaggacggccaggacccaaatcctaccgaaggccgtaaccttaaagttttaagtaaggttgtacttaggaacgacgggtaccgtcccggggtaccaagacgtagtattccgaaggtccggnaaggttgggtacacgggtactaccgttggtaacttttaccaacgtaacgtaaggtaaaacttcgaacgaccgggtaaggggttacgggaacggtacgtagggtaggtaagtttaggtttaaggttcgggttacttaccgtttaatttagttcgaataggttagaacgtaacgacaacgtacgtacgtcggtaccgttacgttacggtttacggacccgtaaggggtaaccctaggtcgtacgggagtaactacgtaactaccggtaactggtcgtaccg

SEQ ID NO: 36996 - DNA, 673 bp, Homo sapiens
  misc_feature: GYAE6OF01BXXZB.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacacgccggcctccatctcctgcagttctagtcaaagcctcgtacatcatgatggcacacctacttgaattggtttcggcagacggccaggccaatctccaaggcgacctaatttataggtgtctgacagggactccgggtccagacagattcgagtcggcgaggtgggcgaggcacgtgtacgtttcactactagaaaactcgaggcgaagggtggaggcgtaggaggagttaggttaagttcgggtacttacgtttatttaagttgtacgtaagttacgacgtaaacggtaccaaaccgtaaccgtaaccggtaccgggttacccggttaaaccgtttaaccggtttttacccggggaaccccgggtaaccggggggtaaaccctaaacggggtcccggttaacggggaaaccggttaacgttaaccggttaaaaccgttaacccgggtaaacgtttacgggtccgggttaacccgg

SEQ ID NO: 36997 - DNA, 738 bp, Homo sapiens
  misc_feature: GYAE6OF01CLY6M.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctgggctgctaatgctctgggtcccaggatttaggaggggatgctgtaatgactcagtctccactctccctcgcccgtcacccttggacagcccgcctccatctcctgctagttctagtcaaagcctcgtacatcatgatggcacacctattgtaatttggttcgctaggacggccaggccaatcctaccgaaggccgtaccttaaatttagtaaggtgtccgtaggaaccgacgggtaaccgttcccggggtacccaaggtacccgtaaggtaacttaccggaacggtccgggtacgtaacgggttcggggtaccacggggacctaacgttggttaacctttaccgaacgtaaccgtaagtaaaacgttacgaacgggaccggtaggggttacgggaacggtacggttagggtaagggttaggtttacggttttaacgggtttcggggttacctttacgtttaagtttacgttacggtacgtaacgttacgaacgtaacggtaccaaaccgtacgtacgtaccggtacccggttaaccgttaccggtttacgggacccggtaacggggacctaacggtcggtaggtaacgtacgtacggaaacggtaccggtaacgttgggcgtaccgg

SEQ ID NO: 36998 - DNA, 596 bp, Homo sapiens
  misc_feature: GYAE6OF01AX5EI.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggtttcggcagaggccaggccaatctccaaggcgcctaatttataattcgtttttacccggacttcgtggggtccccagacagtattcgagcggcaggtgggtcgaggcactgtactttcactatttagaaaattccaaccgtaggggtggtaacggcgtaggagggtagttggttagggtattttacgttacgtgctagtgacgtaagcctactagtttccgtaggtccttttcgtctttacggccccgttagggtaacctaaaggtcggtaactacccgtaagtacgaacgttagtcggtactcggacctaacgtacttcgttggttccc

SEQ ID NO: 36999 - DNA, 603 bp, Homo sapiens
  misc_feature: GYAE6OF01C184W.13.46.E02.1.454.CMB.1.raw
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcaccctggacagcccggcctccatctcctgctagttctagtcaaagcctcgtaacatcatgatggcactacctacttgaattggttcgnagngccaggccaattccacgaggcgtacctaatttagtaaggtgtactgacgagggaccgtccgggtaccagacagtattcgaggcggcgaggtcggtacaggcagtgtactttcacactagaaatcagcggagggtaggaggtacgtaggaggtagttggttaacgtggtacctttacgttatttagttgtactagtacgactaagacctaacaaccgtaccgtacggtaccgttaccgttacgttttccgggaaccggtaacgggaacccgtaaggtccgtaggaacgtacgtaacgtaaactaccggaacgttcggtacggtaccg

SEQ ID NO: 37000 - DNA, 464 bp, Homo sapiens
  misc_feature: GYAE6OF01C9M2I.13.46.E02.1.454.CMB.1.raw
  modified_base (332)..(332): a, c, t, g, unknown or other
  misc_feature (332)..(332): n is a, c, g, or t
  modified_base (347)..(347): a, c, t, g, unknown or other
  misc_feature (347)..(347): n is a, c, g, or t
  modified_base (452)..(464): a, c, t, g, unknown or other
  misc_feature (452)..(464): n is a, c, g, or t
tcagtcacgtactacacgaccggtgctcgattttagactcatctacagggaaaggggctggagtggttggcagtcatttcagatgatggcaatgataaaatattacgcacgctccgtgaagggccgattcgccatctccagagacaattccaggaacacgctgtacctggagatggacgcctgagacctgacgacacggcaatttatactgtgcgagggtttatgtgttggaacgtggtacaccggtaaactggttcgaccctggggccagggaaccctggtcgtccgtctcgtctcgcctccaccagggcccatccggtcttcccctggcnccctgctccaggacncacctccgagagccacgacgccggccctgggcctgccgtggtcaacgggactacttcctagtacgtgaaccgtgacggcgggctgggactaaggcgtcagtacgnnnnnnnnnnnnn

SEQ ID NO: 37001 - DNA, 509 bp, Homo sapiens
  misc_feature: GYAE6OF01B6HPU.13.46.E02.1.454.CMB.1.raw
  modified_base (493)..(509): a, c, t, g, unknown or other
  misc_feature (493)..(509): n is a, c, g, or t
tcagtcacgtactacacgaccggtgctcgatttagactcatctacagggaaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggcgtggggcgactttgactatttggggccaagggacactggtcaccgtctcccagcttccaccaggcccactcggtcttcccccgtggccgccctgcctccaggacgccacccgtcgtcggggggccacgacggccgggccccgtggggcctcgcccgtgggtaccgaagggtaccttaccgttcctaacggttacgttcggactggacggcggggcttcgggcgaacgggcgcgatacgnnnnnnnnnnnnnnnnn

SEQ ID NO: 37002 - DNA, 648 bp, Homo sapiens
  misc_feature: GYAE6OF01DO83I.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactcctccctgccccgtcacccttggacagcccggccctccatcctcctgctagtttctagtcaaagccctcgtacatcatgatggcacacctacttgtaattggttcgcagaggccaggccaatcctacgaacggctaccttaatttagtaaggtcgtactaggacgacgggaccgtcccggggtacccaggacagtacttcgaggcggacgtagggtcgggtacagggacctacgttgtacttttaccaactacgtaagaaacttcgacggacgtaggggtggaaggtcgtaggagggtagttaggtttagttgggtcttacttattagttgtactagtacgacgtaacgaccaacgtaaccgtacgtaccggtacccgttaaccgttaccggttttacggacccgggtaaacggggtaaccctaaggtccggtaggaagtaacgtaccgtaacgtacgtaacgtggtcggtaccg

SEQ ID NO: 37003 - DNA, 692 bp, Homo sapiens
  misc_feature: GYAE6OF01B1BYZ.13.46.E02.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (245)..(245): a, c, t, g, unknown or other
  misc_feature (245)..(245): n is a, c, g, or t
  modified_base (407)..(407): a, c, t, g, unknown or other
  misc_feature (407)..(407): n is a, c, g, or t
  modified_base (472)..(472): a, c, t, g, unknown or other
  misc_feature (472)..(472): n is a, c, g, or t
  modified_base (550)..(550): a, c, t, g, unknown or other
  misc_feature (550)..(550): n is a, c, g, or t
tcagtcacgtactacacgaccggtgctcgatttagactcatctacagggaaaggggtgatcaggactcctcagttcaccttctcacaatgaggctcctgctcagctccgtgggctgctaatgctgtggtccaggtatttaggagggatgctagtaatcgactcacgtctccactcctccgtcgcccgtctaccgtgacncgccgtcctacntcctctgctagttctagtacaacgtcctactacntacagtgagtcggacacctactagttagtaacgtttcggtacgacacgggcgaccgacggacctaaacgttcctaccgaacgggtaccttaactttaagttttaagtacggtacgtacgttacggaacggtacgggtaccggttaccgggacaaggacgtanacgttacgacgcggtacgtaaggtcggacgacgacgtacgtagttacttacgaacgtaacgtaanaaagtcgacggtacgggaggtaggagttaggaggtagttacggttaggttagtacggtactttaagttaacgtttacnggtaccgtagtacgaacctaacgtaccaacgtaccgtacgtccggtacccttagtaccggttaccgggacccggtaaaggggtaaccaacggttggaagtacgttaacgtaaactaaccggtagtacgtaggttccgaccgg

SEQ ID NO: 37004 - DNA, 461 bp, Homo sapiens
  misc_feature: GYAE6OF01AZCAC.13.46.E02.1.454.CMB.1.raw
  modified_base (275)..(275): a, c, t, g, unknown or other
  misc_feature (275)..(275): n is a, c, g, or t
  modified_base (340)..(340): a, c, t, g, unknown or other
  misc_feature (340)..(340): n is a, c, g, or t
  modified_base (425)..(425): a, c, t, g, unknown or other
  misc_feature (425)..(425): n is a, c, g, or t
  modified_base (442)..(446): a, c, t, g, unknown or other
  misc_feature (442)..(446): n is a, c, g, or t
  modified_base (448)..(461): a, c, t, g, unknown or other
  misc_feature (448)..(461): n is a, c, g, or t
tcagtcacgtactacacgaccggtgctcgatttagactcatctacagggaaaggggctggtgtgggtctcacggattgacaatgatgggagagacacaatccacgcggattctgtgaggggccgattcaccacatcgagagacaacgccaagaacacggtatatctgcaaatgaacagtctgagaggcgaagacacggcggtttactctgtgcaagaggtggctggtcgcattggttttgatctcgtggggccagggggacaagtggtaaccgtntcttcagcctccacgaaggcccatccggtccttcccccgtggccgtcccctgcctccgagggacnccaccctcccgagacgccacgagccggccctgggcctgcccgtggtacaacggtactaccttcctagtacgtgactgagccgggntggcagggcgcagtagnnnnncnnnnnnnnnnnnnn

SEQ ID NO: 37005 - DNA, 752 bp, Homo sapiens
  misc_feature: GYAE6OF01BYVP7.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggtatttaggaggggatgctgtaatgactcagtctccactctccctgcccgtcaccttggacagccgcctcatctcctgctagttctagtacaaagtccctcgtaacatcagtgagtgggccaaccgtaccttacgttagtaagtttcgggttcgacgaacggtacggacccgaggaccctaaacgttccgtaacccgaaggtccgtaacctttaaagttttaacgtaagggttcgtacgtacggaaccgtacggggtacccgtacccggggtaccaaggaccgtagtacttacgacggcggtacgtagggtcggtacgacggtcctaacgttacgttactttaccgaacctaacgttaacgtaaaattccgaaggtacggtaaggggtacggacgggtacgtagggaaggttagtttacgggtttaattcgggtacctttagttaagtttagttcgacttagtacgacgtaaagtacccaaacgacggttaccgtacggttaccccggtttaacgttccggttttaacgggacccggtaacggggtaacccaagggtccgttaagggaactacgttaaccgaacgttaaccggaaagttcgggtacgtacccgg

SEQ ID NO: 37006 - DNA, 759 bp, Homo sapiens
  misc_feature: GYAE6OF01B4VGQ.13.46.E02.1.454.CMB.1.raw
  modified_base (285)..(285): a, c, t, g, unknown or other
  misc_feature (285)..(285): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactcctccctcgcccgtcacccgttggacacgccggcctccatcctcctgctagttctagtacaaacgcctacgtacatacatgagtggacaactacctattgtaattggttcgngacggacggaccgaggaccctaaagtccgtaccgaacgggtccgtaaccctttaaagttttaacggtaagggttcgttacgtacggaaccggtacggggtaccgtaccggttaccggggtaccccaaaggaacgtagtaacgttacgaacgggtccggacgtagggtcgggtacgaaggacgtacgtggttaacttacaagttaacgttaacgaaaactcgaaccgggtaggggtaggaacgggtcgtaaggaagggttagttacgggtttaagggttactttttaacggtaacgttcgtaactagttacgaccgtaaacgtccttaacgttagtttaccgttaccggttccctttacgttaccggtttcccgggacccgttaacggggaaacctaagggttaacgtaaaccgttaaacctaacgttaaccgtaaccgttggttaccgtacgtacccgtaccgtaaccgttacg

SEQ ID NO: 37007 - DNA, 664 bp, Homo sapiens
  misc_feature: GYAE6OF01EKN1Q.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttaggaggggatgctgtaatgactcagtctccactctccctgcccgtcacccttgacagccgcctccatctcctgctagttctagtacaaacgcctcgtacatcatgagtggcacacctacttgtaagttggttcgcgagaggccaggcccaatcctaccgaaggccgtaccttaaagtttagtaaggttgtcgtagacgacgggaccgtcccggggtacccagaccgagacttcgagcggcaggtgggtacagggctacgtgtatttccgaactacgtaagtaaactcgaacggacggaggggtggacgggtacgtagggaacgggtagtttagggtttacgtttcgggtctttacgtttaagtttagtttagtaccgttaagtacggaacgtaacgacctaaacgaccgtaccggtcgggtacccgttaaccgttaccggttttacggacccggtaacggggtaaccaacggtcggtacgggaagacgttaccgtaagtaaccgtaacggttcggtggtaccg

SEQ ID NO: 37008 - DNA, 469 bp, Homo sapiens
  misc_feature: GYAE6OF01BOQUK.13.46.E02.1.454.CMB.1.raw
  modified_base (211)..(211): a, c, t, g, unknown or other
  misc_feature (211)..(211): n is a, c, g, or t
  modified_base (450)..(469): a, c, t, g, unknown or other
  misc_feature (450)..(469): n is a, c, g, or t
tcagtcacgtactacacgaccggtgctcgatttagactcatctacagggaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacgggccttgtattttcngtgcgaggttagcagtggctggtacttacgcaatggacgtctggggccaagggaccacggtcaccgtctcctcacgcctcccaccaaggggcccacgtccggtccttccccccgtggcccacccctcctccaacgacgcacctcgtcggggccacgacgccggcccgtgggccgtcgcctggtcaacggacttacttcctagtacgtgactgaggcgggcgtggcgaaggcgcagtagnnnnnnnnnnnnnnnnnnnn

SEQ ID NO: 37009 - DNA, 653 bp, Homo sapiens
  misc_feature: GYAE6OF01EV6PT.13.46.E02.1.454.CMB.1.raw
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtacaaagccctcgtacatcatgatggcacacctacttgtaattggttcgnaggngccaggccaatctccaaggcgacctaattagtaaggtgtctgacgagggaccgtccgggtcccagacgagtacttcgaggcggcgaaggtgggtcacgggctacgtgtaactttccaactacgtaagtaaaactcgagacgagggtggaggtcgtaggagggtattaggtttagttagggtcttacgttagtttagttcgtactagttacgacgtaaacgtaccaaaccaccgtaacgttcggtacccggtttaaccttaaccggttttaccgggacccgggtaaccggggtaacccgtaacgggtccggttaaggggtaacgtaacgtaaacgttaaccggttaaccggtaaccgtttgggtcggttacccgg

SEQ ID NO: 37010 - DNA, 744 bp, Homo sapiens
  misc_feature: GYAE6OF01D4VRK.13.46.E02.1.454.CMB.1.raw
  modified_base (345)..(345): a, c, t, g, unknown or other
  misc_feature (345)..(345): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggatttagaggggatgctgtaatgactcagtctccactctccctcgcccgtcacccgttggacagccggcctccactctcctgctagttctagtacaacgtcctcgtacatcatgagtcggcaacctaccttacttgtaagtttggtttcgcacggacggccgacggaccaatcctaccgaacggccgtacttaatttacgtaaggtntacgtagacggtacgggtaccgtcccggggtacccaagtacgtagtacttcgacggtccggtacggtagggttcggggtacgacgggtactacggttagttaacgttttaccaacgtaacgttaaaggtaaaacttcccggaagggtaccggggttaagggggttacggggaacgggttaccgttaaggggtaacgggttagttttacgggtttaacggtttgggttaacctttctttaagttttacgtagtactacgtgaacgtaaacgacctaacgtacctacggtccggtaacccgtttaactacccgggttttacgggaccggtaaacgggtaacccgaagggtccgtacggtaagaaccgttactaaacgtaccggtaacgtcgggtggtaccg

SEQ ID NO: 37011 - DNA, 470 bp, Homo sapiens
  misc_feature: GYAE6OF01ANFBW.13.46.E02.1.454.CMB.1.raw
  modified_base (346)..(346): a, c, t, g, unknown or other
  misc_feature (346)..(346): n is a, c, g, or t
  modified_base (445)..(446): a, c, t, g, unknown or other
  misc_feature (445)..(446): n is a, c, g, or t
  modified_base (448)..(470): a, c, t, g, unknown or other
  misc_feature (448)..(470): n is a, c, g, or t
tcagtcacgtactacacgaccggtgctcgatttagactcatctacagggaaaggtcctggagtgggtctcaggtatttatggtaacagtgaaagaatagggtatgcggactctgtgaagggccgattcaccatctccagagacaacgccaagactccctctttttgcaaatgaacagtctagaaaactgaggactcggccttatattactgtctacaaaagaaagtaataagtgggggtctcgactacgtggggccaggggacgccctggtccaccgtctcctcagccctccaccgaacgggcccattccggtccttcccccgtggccgtccctgctccgaggacncacctcggagacgcacgcgccggccgtgggctcgcctggacaacggtcttactcgtagtacgtgacgtgcggtacggcgtcggcgagggcgacagtagnngnnnnnnnnnnnnnnnnnnnnnnn

SEQ ID NO: 37012 - DNA, 747 bp, Homo sapiens
  misc_feature: GYAE6OF01CPEKC.13.46.E02.1.454.CMB.1.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
tcagtcacgtactacacgaccggtgctcgatttagactcatctacagggaaaggggtgatcaggactcctcagttcaccttctcacaatggaggctccctgctcagctccgtgggctgctaatgctcgtgggtcccaggtatttaggaggggatgctgtaatgactcagtctccactcctcccgtcgcccgtcacccttggaccagccgcctacatcctcctgactagttctagtacaaagcctcgtanatcagngagtggccaactaccctattagtaatttcgggttacggaccaggacggaccaggaccaattccaccgagaccgtaccttaaagtttagtaaggtcgtatacggaacgacgggtaccgttcccgggaccaagtacgagtaacgtcgacggcggacgtaggtcgggacaacgggcttaattacggtaactttaccaaccgtaagttaaggaaaacttcgaacggacgggttaaagggggcggtaacgggagtagggtaaggtaagtttacggtttaaggtcgggttacctttaacgtttaatttacggtacgtaagtaggttacgtaacaacggtaaccaaacctaacccgtaggttacccgggttaaccgtttaaccgttaccggttttaccgggaacccgggtaaaccggggaaccgtaaacggtacggtaaagggtacgtaaacgtaccgttaaaacggttaccggttaaaccgttgggtaccggttaccg

SEQ ID NO: 37013 - DNA, 689 bp, Homo sapiens
  misc_feature: GYAE6OF01EZWNN.13.46.E02.1.454.CMB.1.raw
  modified_base (222)..(222): a, c, t, g, unknown or other
  misc_feature (222)..(222): n is a, c, g, or t
  modified_base (607)..(607): a, c, t, g, unknown or other
  misc_feature (607)..(607): n is a, c, g, or t
  modified_base (654)..(654): a, c, t, g, unknown or other
  misc_feature (654)..(654): n is a, c, g, or t
  modified_base (668)..(668): a, c, t, g, unknown or other
  misc_feature (668)..(668): n is a, c, g, or t
  modified_base (672)..(672): a, c, t, g, unknown or other
  misc_feature (672)..(672): n is a, c, g, or t
  modified_base (680)..(680): a, c, t, g, unknown or other
  misc_feature (680)..(680): n is a, c, g, or t
  modified_base (684)..(684): a, c, t, g, unknown or other
  misc_feature (684)..(684): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctagaaaaatcgaaggacacgagcctatattactgtncagtgatgggccacgaccacgtacgttttggacgtggtgcgctcgaccccgtcgggcccgggaacccgtgtcaccgtctcctcacgcctccaccgaacgggcccactccggtccttcccccgtcggcctacccctcctacccaaacgacggtaccaccccgttacggtcggggggaccaaccgaacggcccgggcccccgtgggggccctcggtaccccgttggggtacccgaaaacggggtaaccctttaacccgttttaccccgttaaacgggttacccggttacggtaacccggtttacggggaaacggtcccggggggtaccgtttacggggaaccgtaaaacgggggggtacccgaccgggtaaaacttaaccggggaanacggtcgacgtacgacgagacgtacgacgagtacgacacgacgacgntgtgtgagacgtcncgtntacgacanagcngagtg

SEQ ID NO: 37014 - DNA, 461 bp, Homo sapiens
  misc_feature: GYAE6OF01A6K4J.13.46.E02.1.454.CMB.1.raw
  modified_base (443)..(443): a, c, t, g, unknown or other
  misc_feature (443)..(443): n is a, c, g, or t
  modified_base (449)..(461): a, c, t, g, unknown or other
  misc_feature (449)..(461): n is a, c, g, or t
tcagtcacgtactacacgaccggtgctcgatttagactcatctacagggaaaggggctggagtggttggcagtcatttcagatgatggcaatgataaatattacgcacgctccgtgaagggccaattcgccatctccagagacaattccaggaacacgctgtacctggagatggacggcctgagacctgacgacacggcaatttattactgtgcgagggtttatgtgttggaacgtggtacaccggaaaactggttcgacccctggggcccagggaaccctggtcgtcgtctcgtctgcctccaccaacgggcccatccggtccttcccccgtggccgccctgcctccgaggcgccacctccgagacgccacgagccggccctgggcctgcctggtcaacgcttactcctagtaccgtgactgacggcggtctggcgaaggcnaagtgnnnnnnnnnnnnn

SEQ ID NO: 37015 - DNA, 573 bp, Homo sapiens
  misc_feature: GYAE6OF01CQR30.13.46.E02.1.454.CMB.1.raw
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (377)..(377): a, c, t, g, unknown or other
  misc_feature (377)..(377): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttaggaggggatgctgtaatgactcagtctccactctccctgcccgtcacccgttggacagccggcctccatctcctgcagttctagtacaaacgcctcgtacatcatgatcgggcacactactgaattggttcgcagngcaggccaanctcaagcgacctaatttataaggtntntagacgacggacgtccgggtcccagacagattcagcgcgagtggcagcactgattcacatanaaatcgagacgagggtgaggcgtagaggtagtgtttagtggtctacttattagtgtactagttagactaaacgacaaacaaccgtacgtacggtacccgtacgttaccgttttacgggaccggtaacggggaacccgaacggtccgttagggactaacgtaccgtaaagtaacccggtaacgttgggtgggtaccg

SEQ ID NO: 37016 - DNA, 823 bp, Homo sapiens
  misc_feature: GYAE6OF01D6IMR.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacacgccgcctccactctcctgctagttctagtacaaaacgcctacgtacactcatgagtgggaccacaccttacttagtaatttggtttacgacgtacgacggaccgacggacccaatccgtaccgtaacgggcccgtaccttaaacgttttaagtaaacggttgtcgttacgacgtaacgggggtaccgttacccgggggttacccgagtaaccgtaacgtaacgttaccggaacggccgggtacggtaagggttcggggttaccgaacggggtacctaacggtttcgttaaaccggtttttaccaaaccgttaaaccgttaaacggtaaaaacgttaccggaaggtaccgggtaaggggttacgggacgggtacgttagggaagggtacggttttaggtttaagggtttccgggttacgtttacgttttaatttacgttacgtaccgtaagttcggaacctaacgggtaaccaaaccggttaccgacccggttacggttaacccgtttaaccggtttaccggttttaccggggaaaccggaaaccgggggtaaccctaacgggtacggtacgggaacgttaacgtaaccgttaacggtaacccggtaacggttgggtaccgtacgg

SEQ ID NO: 37017 - DNA, 758 bp, Homo sapiens
  misc_feature: GYAE6OF01EVEF4.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactcctccctcgcccgtcacccttggacacgccggcctccatccgtcctgctagttctagtacaaacgtcctacgtacatcatgatgggcaacctacctacgtagtaacgtttggttcgctaggacggtccacgggaccaactccgtaccgaacgggtccgtacctttaaagttttaagtaagggttcgttcgtacggaacgtacggggtaacccgttcccgggggtacccaaggtaaccgagtacttcgagggtaccggtcgtagggtcgggtacaacgggtctaacgtaggttaactttaccgaactaacgttaacgaaaaacttccgaagggtaccggtaggggttacgggacggtacggttagggaagggttatttacgggtttaggttacgggtctttaacggttttaagttacgttagtaccgtaagttacggaaccgtaacgaaccgtaacgtaaccgtaccggtacggtaacccgtttaccgttacggtttacgggaacccggaacggggtaacccaaagtccggtaagggtaagtaaccgtacggtaaacgttaccgggaacgttcggtcgggtaaccc

SEQ ID NO: 37018 - DNA, 808 bp, Homo sapiens
  misc_feature: GYAE6OF01EK0MV.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttaggaggggatgctgtaatgactcagtctccactctccctgcccgtcacccttggacagccggcctccatctcctgctagttctagtacaaacgcctacgtacatcatgagtggcactaccttattagaagtttcggttcgactaggacggccaacggaccaaattccgtaccgaaacggggtcccgtaccgtttaaagttttaagtaaacgggttgttactagggaaccgaacgggggtacctccccgggggtacccaaggaacctaggtacttacgacgggccgggtacgtaacggggtttcggggacaacggggtacctaacggtttaggtaaccttttaccgaaacgttaacgttaaacgggtaaaaacttcgaagggtaccggtaagggggttacgggaacgggtccgttaagggaacggttagtttacgggtttaaggtttcggggttacctttacgttttaagttttacggttacgggtactaacgggttacggaaccctaaacgggaaccctaaaacccgtacgtaaccggttccggggtaaccctttaacggttaccggttttaccgggacccgggtaagggggtaaccctaggtacccggtagggaacttaaccgttacggtaaacgtaccggttaaaccggtgggttaacggcccgg

SEQ ID NO: 37019 - DNA, 765 bp, Homo sapiens
  misc_feature: GYAE6OF01C2IT1.13.46.E02.1.454.CMB.1.raw
  modified_base (647)..(647): a, c, t, g, unknown or other
  misc_feature (647)..(647): n is a, c, g, or t
  modified_base (659)..(659): a, c, t, g, unknown or other
  misc_feature (659)..(659): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctcgggtcccaggatttagaggggatgctgtaatgactcagtctccactcctccctcgccccgtcctacccgttggacacgcccggcctccatctcctgctacgttctagtacaaacgcctcgtaaccatcagtcgagttcggggaccctaaccaaccctttaacgtttaggtaaacgtttttcggggtttaccggaccgaacgggtaacggcccgaacgggaccctaaactttcccgaaccgaacgggtccgtaccctttaaaagtttttacgtaaagggtttcgtaccgtaggtaacggacgggggtacccgttacccggggtaccctaaacggcctaaggtaacgtttccgaaacggtccggggtactacggggttcgggtaacgcgggtacctacggttacgttaacgtttaccaacgtaacgtaagtaaacgtaccgaggtaccgggagggtacggaggtacgagggtagtacgttaggttacgtcggtacttcttaagttacgttgactatcggtanaacgtacaaacnccgtacgttacggcccgttacgtaccggtttgggaccggtacgggaaccgaggtcggtaggtaacaacgtaacgaaccgttacggaaacgtcgggttacggtaccg

SEQ ID NO: 37020 - DNA, 488 bp, Homo sapiens
  misc_feature: GYAE6OF01EY7LM.13.46.E02.1.454.CMB.1.raw
  modified_base (217)..(217): a, c, t, g, unknown or other
  misc_feature (217)..(217): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (457)..(457): a, c, t, g, unknown or other
  misc_feature (457)..(457): n is a, c, g, or t
  modified_base (459)..(488): a, c, t, g, unknown or other
  misc_feature (459)..(488): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacaggcctatattacngtgcagtgatggccacgaccagacttttggagtggtgcgctccgcccgtggggcccggaaccctggtccaccgtctcctcagccctccaaccaggcccagtcgtcctcccctgccaccctcnccaagnccacctcgtggggcacagccggcccgtgggactcgcccgtaggtacaacggacttacttccgtacgtacgttgacgtggacggcggacgtggaccaaggccgagaattcagngnnnnnnnnnnnnnnnnnnnnnnnnnnnnnn

SEQ ID NO: 37021 - DNA, 580 bp, Homo sapiens
  misc_feature: GYAE6OF01CHKSM.13.46.E02.1.454.CMB.1.raw
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (553)..(553): a, c, t, g, unknown or other
  misc_feature (553)..(553): n is a, c, g, or t
  modified_base (556)..(557): a, c, t, g, unknown or other
  misc_feature (556)..(557): n is a, c, g, or t
  modified_base (559)..(563): a, c, t, g, unknown or other
  misc_feature (559)..(563): n is a, c, g, or t
  modified_base (565)..(572): a, c, t, g, unknown or other
  misc_feature (565)..(572): n is a, c, g, or t
  modified_base (574)..(574): a, c, t, g, unknown or other
  misc_feature (574)..(574): n is a, c, g, or t
  modified_base (576)..(578): a, c, t, g, unknown or other
  misc_feature (576)..(578): n is a, c, g, or t
  modified_base (580)..(580): a, c, t, g, unknown or other
  misc_feature (580)..(580): n is a, c, g, or t
tcagtcacgtactacacgaccggtgctcgatttagactcatctacaggggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacgaggcctaatattacgtgtgcaagtgaatcgggcccacggaaccacgtacgttttggagtggtgcgctccgtacccgtggggcccggtaacccgtggtccgaccgtcctcctcacgccctaccaccgaaggccccacgtccggtccttcccccgtggcctaccccgtcctaccaagtacgacccaccgtcggtcggggacacgacggcccggcccgtcgggcctacggccgtagggtaccaaacgggtcccttaaccgttaccgttaggtaccgtcgtaacgtcggtacggcgggtccgtagggtaccgaaacggccgtaccgaagttacgngtangcncgnagagcgcngannannnnngnnnnnnnnanannngn

SEQ ID NO: 37022 - DNA, 793 bp, Homo sapiens
  misc_feature: GYAE6OF01C7Z9U.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtgggctgctaatgctcgtcgggtccaggtatttaggagggatgctagtaatgactcacgtcctcctaccgtcctcccgtcgccccgtacctacccgttaggaccacggcccgcctccactcctcctgcttagttacctagtaccaaacgtcctacgtacattacagtgagtcggaccaacctaccttagttagtaagtttcggttaccgacgacggacggacgtaacggtacctaactccgtaacggtaacggtaccgttaacctttaaagtttacgtaaggttcgtacgtaggaacggtacgggtaaccgttcccgggacgtaagacgtagtacgtacgaggcggtagtacgggtacggacgtacgtacgtacgttgttaaacttacccaagtaacgtaaacgtaaacgtacgtagggtaacgggtagggtacggaacggttacggtagggtacgttaagtttaggtttacggttacggtaccttttaagttaacgttcggttacgtaacgttaggtacgaaaccgaacggtaacccctaaacggtaccgtaaccgggttaccggttacccggtttaaaccgtttacccgggttaccggggaaaccccggttaacggtaaccggaacggttacggaacgtaacgtaacgtaccgtaacggtacgtacgtgggtccgtaccgg

SEQ ID NO: 37023 - DNA, 802 bp, Homo sapiens
  misc_feature: GYAE6OF01A53TT.13.46.E02.1.454.CMB.1.raw
  modified_base (156)..(156): a, c, t, g, unknown or other
  misc_feature (156)..(156): n is a, c, g, or t
  modified_base (179)..(179): a, c, t, g, unknown or other
  misc_feature (179)..(179): n is a, c, g, or t
  modified_base (794)..(794): a, c, t, g, unknown or other
  misc_feature (794)..(794): n is a, c, g, or t
tcagtcacgtactacacgaccggtgctcgatttagactcatctacagggaaaggggtgatcaggacttcctcagttcacctttctcacaatgaggcctccctgctcagctccgtggggctgctaatgctcgtcgggtcccaggtatttaggagggntgctgtaatgactcagtcctccnctcctccctcgcccgtcctaccgttggaccacggcccgcctacctactcctcctgctagttctaacgtacgaacgtccctacgtacatcagtggacgtcggacctaacctacttacttaggtaagtttcggttacgagtacggacgaccgacggacctacgtccgtaccggacgtcgtacctttaagttacgtaggtcgtacgtcgaaccggagggtacccggtcccggtaccagtaaccgacggttagttcccgaaggtcccggacggtaggtccgggtactacgggacctacgtttaggtacttaacccgtaacgtacgttaaacgaaaccggtcgaagggtcggggttaaaggggtacgggtaacggtaccggttaggtaacggttgttttaagggtttccgggttcggttaatttacgtttaatttaccggtacgggtacttacgggtaacttaaccgaaacggtaaccctaaggtaaccccggttcggttaaccgggtttaaccccttaaccgggtttttaccgggtaaccgggacccggggtaaaccggttaccgaagggtttccggaaaggtacctaacggttacgtacgttaacggacggtttcggnggtacccg

SEQ ID NO: 37024 - DNA, 680 bp, Homo sapiens
  misc_feature: GYAE6OF01CVKR9.13.46.E02.1.454.CMB.1.raw
  modified_base (432)..(432): a, c, t, g, unknown or other
  misc_feature (432)..(432): n is a, c, g, or t
  modified_base (564)..(564): a, c, t, g, unknown or other
  misc_feature (564)..(564): n is a, c, g, or t
tcagtcacgtactacacgaccggtgctcgatttagactcatctacagggaaaggggtgatcaggactcctcagttcaccttctcacaatgaggctccctgctcagctccgtggggctgctaatcgctcgtcgggtcccaggtatttaggaggggactgctagtatgtactcgagtctccactcctccctcgcccgtcctacccgtggaccacggggcccgcctaccactcctacctgctagttctacgtacaacgtcctcgtacatcagtgacgtcggccaactaccgttacttagtaacgtttcggttcggacgaggacggccacggacctaactccgtaccgaacggtccttaaccttaaagtttagtaggttcgtactaggaccgacgggtacccgtcccgggaccagacgtagtactcggagtccggngtaggtcggtcgagtacctaggtctactacactaacgtaataacgtagtacggacgggtagggtagacgtcgtgggtacgttaggttcgtttacggcggttactttacaagtttgagactaggtcgaacggntaaaccactaccgagtacccggtacttaccgttacggttccgggaccgaaaacggttcccgtaggacggttacgaagtccgttaaacgaacgttccggtaagttcggtcgtaaccg

SEQ ID NO: 37025 - DNA, 745 bp, Homo sapiens
  misc_feature: GYAE6OF01DO4YZ.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctgggctgctaatgctcgtgggtcccaggtatttaggaggggatgctagtaatgactcagtctccactctcctcgcccgtctacctggacacgccgcctccatcctcctcgctacgttctagtcaaacgtcctaccgtacatcatcgaagtcggacacctacctacttagtagtttcgggtttacgacgtacggacggaccacggacctaactccgtacgaacggtaccgtactttaacgtttaacgtttaagtttaccgggtttttaaccggtcgttacggttaccggggtacctaagtactacgtacgttacggaacggtccggacgtagggtcgggtacggtacgtaccgtacgttagtactttaccgtaactagttaacgaaacgttccggtaacggtacggggttagggacgggtaggttacggaaggttagttaggtttaggtattttaagtaccgtagtcgtagacgtacaagtcgtaacttcgttacgttccgtcctttactaccgtttaccggcccgtaacgggttaccaaagggtttaccgaaacgtttaacccgtaagtttaaccggtacggtttcggtaacggttccgttactaccccggtaaagtccttttcgttcgtttaccc

SEQ ID NO: 37026 - DNA, 713 bp, Homo sapiens
  misc_feature: GYAE6OF01BZ3L3.13.46.E02.1.454.CMB.1.raw
  modified_base (203)..(203): a, c, t, g, unknown or other
  misc_feature (203)..(203): n is a, c, g, or t
  modified_base (700)..(700): a, c, t, g, unknown or other
  misc_feature (700)..(700): n is a, c, g, or t
tcagtcacgtactacacgaccggtgctcgatttagactcatctacagggaaaggggtgatcaggactcctcagttcaccttctcacaatgaggctcctgctcagctccgtggggctgctaatgctcgtgggtccaggatttaggaggggatgctgtaatgactcagtctccactcctccctcgcccgtctaccgttcggaacncggccggcctccacttcctccgtcgtcgtacgttacctaagtacgaaacgtccttacgtaactactacgtaagttacgacggtcggacctaaccgtaccgttacgtttaggtaacggtttcggttcgacgacggacggccgacggacctacgtccgtaacacggtacctactttaagtttacgtagtgttacgagaaccgggtacgggtaccggtcccgggtaaccaggtaacgtacgtacgttacgacgggtacgtacggacgggtcggaacggtacgtaccgtacgttacgtacttacgaaacgttagtaacgtaaacgtacgaggacggttagggacgtaggacggtaggagtagttcggtagttcgtagttacgttattacgtagacacgtcgaacgttaacgactaaaccggctacgtaccggtccgttaacgtccggttaacggaccgggacgtaacggataccgggtagaatacgtaacacgtacggtcncggtcggtaaccg

SEQ ID NO: 37027 - DNA, 727 bp, Homo sapiens
  misc_feature: GYAE6OF01BBCTU.13.46.E02.1.454.CMB.1.raw
  modified_base (256)..(256): a, c, t, g, unknown or other
  misc_feature (256)..(256): n is a, c, g, or t
  modified_base (679)..(679): a, c, t, g, unknown or other
  misc_feature (679)..(679): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggagtttaggagggatgctagtaatgactcagtctccactctccctgcccgtcacccgttggacacgccgcctccactcctcccgctagttctagtaccaagcctcgacatcagtgagnggccaactaccttacttacgtaagtttcggttcggacgaggacggtccaacggtacctaactccgtaccgaacgggtaccgtacctttaaagtttagtaaggttcgtcgtacggaaccgtacgggtacccggtaccgggtccgaacgtaccgagtacttacgacgcggtcgtacgggtggtacgaggtaccgtagtacggttactttaccgaacctaacgtaagaaacgtcgaacgggtacgggtagggggtaaggaccgtagggtagtaacgggtagtttacggtttaggtcggttacgtttatagtttaatcgtctaagtccgaagaaccgactaacccgtactaacgtcggttaaacccttcggttaaccggttacggaacccgggtaacgggtactaagggtaccgtacggggtaaacngttaaaaccgtaccgtttacggtaacccggtggtccggtcgtaacccg

SEQ ID NO: 37028 - DNA, 586 bp, Homo sapiens
  misc_feature: GYAE6OF01DBIJ8.13.46.E02.1.454.CMB.1.raw
  modified_base (327)..(327): a, c, t, g, unknown or other
  misc_feature (327)..(327): n is a, c, g, or t
  modified_base (559)..(586): a, c, t, g, unknown or other
  misc_feature (559)..(586): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctagaaaatcggaacggacacgacggtcctattaattactgtgacgtagtgagtcgggacccaacggaccctagttaccgttttaggaaggtggtcgcgtcttaccggacccggttcgggggaccccggaccgtcggtaccncggtcctcctcgcgtccctccaaccggaaccggcccacgttccgtcccgttaccccgtcggccctaccccgtccctaccgaacgtacgccctaccgttcggcgggggaccaccggaggccccggccgtcgggtcctacggtcccggtacggtaccggaaggtaaccttccgtaccgttaaggtacgcgacgttggaacggccggggtatcgggaacacgggcaaccagtcgnnnnnnnnnnnnnnnnnnnnnnnnnnnn

SEQ ID NO: 37029 - DNA, 803 bp, Homo sapiens
  misc_feature: GYAE6OF01B6852.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcacccttggacagccggcctccatctcctgcagttctagtcaaacgcctcgtacatcatgagtcggacaccaccttacttagtaagtttcgggtttcggacaggtaccggaccgacggacctaactccgtacccgtaaggaccgttaccgttaaagttttaacgttaagggttcgtaccgttacggaccggtaacggggtacccgttaccccgggggtaccctaacggacgtaacgtacgtttacgacggccggacggtacgggtacggggtaccgaagggtccgaacgttcggttaacgttttaccgaacgtaaccgttaaagaaaacgttaccaacggggtacggtaaggggggtcgggtaacgggtcggtagggtaagggttagtttacgggttttaaaggttttccggggtaccttttaccgtttaagtttacgtttacgacgttaagttacggacgtaaaccgtaacaaaccggtaaccgtaccggtaccgggtacccttacggttaccgttttaccgggaccgggtaaacggggtaccccaaagggtccggttaacgggaacctaacggttaaacccgtacgtaaacggttacggtacgggttacggtacccg

SEQ ID NO: 37030 - DNA, 1044 bp, Homo sapiens
  misc_feature: GYAE6OF01BJVM4.13.46.E02.1.454.CMB.1.raw
tcagtcacgtactacacgaccggtgctcgatttagactcatctacagggaaaggggtgatcaggactcctcagttcaccttctcacaatgaggcctccctgctcagctccgtgggctgctaatgctcgtcggtcccgaggtagtttaggagggtatgtcttagtaagtcgactcgacgttcctcctaccttccctcccgtccgtccccgttaccgtacccgttacggaccgccggtccccggtcctacctacttcctccgtagtccgtacgtttcgtaacgtaaccgaaccgttcccgttacgtactacgtacgtagtacggacggttccggaaccctaacccgttaacccgtttagttacggttaacgtttcgggttaccgacggtaacggaccggtaccgaacggtacctaaccgttccgaaccggtaacgtaccgttaacgtttaagtttaggtacgtttacgtaccggtacgggaacggttacccggggtacccgttacccgggaaccctaaggaccgttaagtaccgttacgggaccggtacggtacggtacggggttacggacccgggtaacggtacgttaccggttacgttaacccgtttacgaaacccgtttaacggaaacggtaaaccgtacggggtacgggtaaccgggggttagggtaacggtaacgggtacgggttaagggtaacgggtttacgttttagggggtttacgtttaccgggtaactttttacggttttaaacgtttcggtaacgttaccgttagggtaaacccgtacggttaaacccggtaaccgttaaaccggtacccggtttaacccgggtttaaccccggggttttaaaaccgtttaaccccccgggggtttttacgggttaaaccccccgggggtaccggggttaaaaaccgggggaaccccgttaaggggttaaacccgggttaaccgggttaaacccggttaaaaccttaaacccggggttttaaaccccgggtttaaaggggtccccgggtttttaccggaacccgggttaacccgg

SEQ ID NO: 37031 - DNA, 496 bp, Homo sapiens
  misc_feature: GYAE6OF01BKWES.13.46.E02.1.454.CMB.1.raw
  modified_base (335)..(335): a, c, t, g, unknown or other
  misc_feature (335)..(335): n is a, c, g, or t
  modified_base (479)..(496): a, c, t, g, unknown or other
  misc_feature (479)..(496): n is a, c, g, or t
tcagtcacgtactacacgaccggtgctcgatttagactcatctacagggaaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgactagttttccagacggcgactacgttgtcggctggggcgactttgacatttggggcaagggacactgtcaccgtctcccaagcttcaccaagggcccatcggtcttcccccnggccgccctgcctccaggcgcaccctcgtgggggcacgtagccgggcccgtcggggctgcccgtggtcgaacggtacctacgtttcctacggtaccgtagacgtgtaggaccggggctagggccaagggcccgacgataacggnnnnnnnnnnnnnnnnnn

SEQ ID NO: 37032 - DNA, 470 bp, Homo sapiens
  misc_feature: GYAE6OF01BK1SD.13.46.E02.1.454.CMB.1.raw
  modified_base (434)..(434): a, c, t, g, unknown or other
  misc_feature (434)..(434): n is a, c, g, or t
  modified_base (440)..(442): a, c, t, g, unknown or other
  misc_feature (440)..(442): n is a, c, g, or t
  modified_base (444)..(470): a, c, t, g, unknown or other
  misc_feature (444)..(470): n is a, c, g, or t
tcagtcacgtactacacgaccggtgctcgatttagactcatctacagggaaagggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaaatatggttcgagggtagttcgactacgtggggccagggaaccctggtcaccgtctcctcacgcctccaaccaagggcccatccggtccttccccccgtggccacccctcctccgaagacgccacctcgtcggggccacagccggccctggctgccgtggtcaaggacttaactcctagtcgtacgactgacgtcggcgtggacgaaggccganaatagnnncnnnnnnnnnnnnnnnnnnnnnnnnnnn

SEQ ID NO: 37033 - DNA, 729 bp, Homo sapiens
  misc_feature: GYAE6OF01BURAR.13.46.E02.1.454.CMB.1.raw
  modified_base (211)..(211): a, c, t, g, unknown or other
  misc_feature (211)..(211): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggtatttaggaggggatgctgtaatgactcgagtcctaccactcctcccgtcgcccgtcctacccgttggaccncggcccggcctccatcctccgtgctacgttctagtacaaacgccttacgatactcagttagagtcggacaaccgtaaccttacgttagtaacgttttcgggttacgacgtacggacggaccgaacggcctaaacgtccgtaaccgacggtaccgtaactttaaagtttaagtaacggtctacgtaggaccgtacgggaccgtccgggtaccaagacgtagtacttacggacggaccggtcgtaagggtcggtacgacggtacctacgttacgtacctttacgaactaacgtaacgtaaaacgtcgacggagggtagggtacggaggtacgtaggaggttagttacggttaggttcggttacttaagtttacgttagttcggacttaacgtacgaacgtaaccgaactaacgtacggacgttaccggtccgttaccgttagttacccgggaacgtaacgggtacctacggtcgacggtaaacgactaaccgtaacgacggttacgtcggtacggtaccg

SEQ ID NO: 37034 - DNA, 1014 bp, Homo sapiens
  misc_feature: GYAE6OF01A6R43.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtgggctgctatgctcgtgggtccaggtatttaggagggatgctagtaatgactcagtcctccactcctccctcgcccgtctacccgttggacacggcccggcctccacttcctcctgccttacgttactacgtactaaacgtccctacgtacatactagtcggtaacgtcgggacctaaccgttacgttacgttaggttaagtttcgggtttaccggacgtaaggaccggtaccgaacgggtaccctaaacgttccggtaacccggtaaacgggtaccgtttaacccgtttaaaagtttttaaccggtaaacggggttttcgttaccggttaacgggtaaacccgggtaacgggggttaaccccgggttccccgggggtaaccccaaaggggtaaaccgtaaccggttaacggtttacccgggaaacggggtccggtaacgggttacgggtttaacgggggtacccgaaaccggggttccttaaaccggttaagttaaacccgttttaacccgaaaaccggttaagttaaacggtaaaaacgtcccgggaaagggtacgggttaaacgggggtaacggggtaaccgggtccgggttaagtaaacggggtttaacgttttacgggtttaaacgggttcggtaaccccttttagggttttaaacgtttacccggtttagacccggtttaaaagtaccggtaacggttaaacccgaaccgttaaaaccgtccgggtttaaccgtaccccgggttaaaccgtttaaaccggtttaccggggttttaccccggggaaccggggtaaaacgggtacccctaaacgggggttaccggttaacgggttaaacctaacggttaacccgtaaaccggttaacggggaaccttttaaccggggcgggtttacccc

SEQ ID NO: 37035 - DNA, 780 bp, Homo sapiens
  misc_feature: GYAE6OF01EM4L7.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggatttaggaggggtatggctgtaatgactcagtctccactcctccctgaccccgtctaccccgttgggacctacggccccggcctccatcctcctggctaggttctagtacaacgtcccttagtatactcagtggtacgtgggaccaacctaccgttacgttagtaacgtttgggttccggactaaggaccggtccacgggaccctaattcccgtaccgaacgggtcccggtacctttaaagttttacgtaagggtcgttaccgtacgaacggtaccggggtacccgtcccgggggtaccctagaaccgtagtaccgttcgaacggtccgggtacgtaggggttacggcccgaacgggtcctaaccgttaggttaccctttaccgaaacgtagtaacgtaaaagtcccggtaagtacgggtaggggttacgggaggtacgttaagggacggttaggtttacggtttaggtaccgggtactttagtttaattcgtaggtccttagacggtactaacggacctaacgtaccggtcttacgggtaccttaccggttcggttaccgggccggaaacggtacgaacggttcggaacggtaactacgttaaccgtacggtaaccggtaacccgttgggtccgtaccgg

SEQ ID NO: 37036 - DNA, 840 bp, Homo sapiens
  misc_feature: GYAE6OF01AKYGP.13.46.E02.1.454.CMB.1.raw
tcagtcacgtactacacgaccggtgctcgatttagactcatctacagggaaagggtgatcaggactcctcagttcaccttctcacaatgaggctccctgctcagctcctggggctgctaatgctctgggtccagatttaggaggggatgctgtaatgactcagtctcctactctccctgcccgtcacccttggaccacgccggcctcactctcctgctagttctagtcaacgtcctacgtactagtacctagtcgacgtgggaccaacctaaccgttacgttaggttaacgttttcgggtttaccgggacgtaacgggaccgggtacccgaacggtacccgtaaaacgtttcccgtaaccgtaaaccggggtccgttaaacccgtttaaaagtttttaaacggtaaacgggttttcggttaccgttacgggtaaaccgggtacgggttaccccgggttaccccggggttacccgaacggtaacgtaacgtacgtttacgacggtaccgggtacggtaaggggttcgggtacgtaacgggtacgtaccggttagtaccgtttacgaaccgttacgttaaagtaaactcggtaacgggtacgggtaacggggttacgggtacgggtaccgttaagggggtaagttacggtttaacgggtttacggttcgggttaccttttaacggtttaagtttcgtttaacggtcttaacggtacggacgtaaccgtacccgaacgtaccgttaccgtacggtccgttacggtcggttaccgggaccggtacgggacctagggcgtacgggtaactacgtaccgaacgtttacggaacgttcggcggtccg

SEQ ID NO: 37037 - DNA, 599 bp, Homo sapiens
  misc_feature: GYAE6OF01C0FMC.13.46.E02.1.454.CMB.1.raw
  modified_base (552)..(552): a, c, t, g, unknown or other
  misc_feature (552)..(552): n is a, c, g, or t
  modified_base (555)..(556): a, c, t, g, unknown or other
  misc_feature (555)..(556): n is a, c, g, or t
  modified_base (566)..(566): a, c, t, g, unknown or other
  misc_feature (566)..(566): n is a, c, g, or t
  modified_base (570)..(573): a, c, t, g, unknown or other
  misc_feature (570)..(573): n is a, c, g, or t
  modified_base (575)..(580): a, c, t, g, unknown or other
  misc_feature (575)..(580): n is a, c, g, or t
  modified_base (582)..(582): a, c, t, g, unknown or other
  misc_feature (582)..(582): n is a, c, g, or t
  modified_base (585)..(591): a, c, t, g, unknown or other
  misc_feature (585)..(591): n is a, c, g, or t
  modified_base (593)..(593): a, c, t, g, unknown or other
  misc_feature (593)..(593): n is a, c, g, or t
  modified_base (595)..(599): a, c, t, g, unknown or other
  misc_feature (595)..(599): n is a, c, g, or t
tcagtcacgtactacacgaccggtgctcgatttagactcatctacagggaaagggggctggagtggattggggaaatctatcatagtgggccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcggcgggctacttttgatatcgtggggaccaagggtcgagtggtcatccgttcttcttcacgtccctacccaaccgaacggggcccctacggttcccggttcccctttccccccgtgggccccgtccccgttcgtacccgtacccggaacgggccgccctaaccccgtccggaaggaccgaccgaccggtaccgggcccgggtacccgtggggcctcggccgttacgggtacgaaacgggtacctttacctttaccggtaacgtacggtacgtacgtcgggtacgggcgggtcgtcggacgtaacgggcgtacgaagtcgncgnncagctgcgtnagcnnnngnnnnnngngcnnnnnnncncnnnnn

SEQ ID NO: 37038 - DNA, 916 bp, Homo sapiens
  misc_feature: GYAE6OF01CSOMN.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggtatttaggaggggatgctgtaatgactcagtctccactctccctcgcccgtcaccctggacacgccgcctcactctcctgctagttctagtacaaacgcctcgtacatcatgagtcggacactaccttacttaggtaagtttcggttcggcgaggacggaccgacggacctaacgtcctaccgacggccgtaccttaagttttagtaaggttcgtacgtaggaaccggacgggtacccggtacccggggtacccaaggacgaagtacgttacgacggtccggacggtaacggtcgggtacgacgggtacgaacgttacggttacttaccgaacgttaacgtaacgtaaaacgttaccgtaacgggtaacgggtaagggggtacggggtaacgggtaccgggttaacggggttaaaggggtttaaacgggtttacggggttttttaaacgggtttacccgggggttaccttttttaaacccgggtttttaaacggttttaaacggttttcggggtaacctttaaacggttaccgggtaaacccggaaaaccgtaacccgtaaaaccgttaaccccggtacccggttaaccggggttaccccgtttaaacccggtttaaaccggggtttttaccgggaacccccgggggttaaaccgggggttaaaccccgtaaacggggttaacccgggttaaacggggtaaaccggttaaaccttaaaccggttaaaacccggttacccggttaaaacggggttcggggttaaccggttaaccccgggg

SEQ ID NO: 37039 - DNA, 777 bp, Homo sapiens
  misc_feature: GYAE6OF01BWXA4.13.46.E02.1.454.CMB.1.raw
  modified_base (498)..(498): a, c, t, g, unknown or other
  misc_feature (498)..(498): n is a, c, g, or t
  modified_base (627)..(627): a, c, t, g, unknown or other
  misc_feature (627)..(627): n is a, c, g, or t
  modified_base (769)..(769): a, c, t, g, unknown or other
  misc_feature (769)..(769): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggtatttaggagggatgctagtaatgactcagtctccactcctccctcgtccccgtacacccgttggacaccgccggtcctaccatcctcctcgctagttactaacgttaacgcccgtactacactacgacgtaggacgtacggaccacctaaccttacgtttacggtaagttttcgggttaccgtacgaaggacggtaccgacggaaccctaactaccctaccggaacggtccgtacgtttaaagttttacgtaaggttcgtacgtacggacgggtaaccgggtcccggtccccggtaccgaaggaccgtaagtacgtacgtacgggcggtacggacgggttcgggacgtacggggtacncgttacgttacttaacgtaacccgtaagttaagaacgtcgtaaggacggtaaggggtagtaacgggtcgtaaggacggttagttacgggttttaggtacgggttattaccgttttagttacggttaacncggtaattaccgggaaacctacggaaaccctacgtaccgtaacgtcccgggttaacgtaccgttaccgggtttccgggaaccgggtaccggacggtaggtaccggaggtacacgtaacggacgtacggttagcgggttacgngttaaccg

SEQ ID NO: 37040 - DNA, 882 bp, Homo sapiens
  misc_feature: GYAE6OF01EV82R.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatgctctgggtcccaggatttaggaggggatgctgtaatgactcagtctccacttcctcccctcgccccgtccacccgttggaccacggcccggccctccacttcctcctgcctagttctacgtacaaacgtcccttacgtacattcatgacgtcgggacaacctaccttacgttagtaagtttcgggtttccggacgtaacggacgggacccgaacggtaccctaaacgtaccgtacccgaaacgggcccgttaacctttaaagtttaacgttagggtcgttcgtacggtaacgacggggtaccggttcccggggtacccaacggaaccgtaggtacttaccggacggtcgggtacgtacggggttcgggtacgacgggtcctaacggttggttacctttacgaaccgtaacgtaacgtaaaactccgaaggtccggggtaaggggtacggtacggggtacggtaagggtaacgggttaagtttagggtttaacgggttcgggttaacccttttcggtttaaagttttacgttaacgggtacgttaacggtacggtaaccgtaaacgtaacccgaaaaccgtaacccgtacccgggttaccgggtaacccccgtttaacgtttacccgggttttaccgggaaccccggggttaaaacgggggtaaccccaacggggttaccgggttaaacgggacgttaaaccggttaacccggtaaacgttaaccccgggttaaacggttcggggtccggtaaacccgg

SEQ ID NO: 37041 - DNA, 770 bp, Homo sapiens
  misc_feature: GYAE6OF01A9332.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggtatttaggaggggatgctgtaatgactcagtctccactcctccctcgcccgtctacccgttggaccacggcccggtcctccactcctccgtgctgttactagtacaaacgtccttacgtacatcatggatcgggccactaccttacgttagtaagtttcggttacggacgagacggaccgacggacctaacttccgaccgtaacggccgtaacctttaaagttttaacgtaacggtcgttacgtacggaaccggtacggggtacccgttaccccgggggtaccctaacggtaaccgtaggtaacgtttacggaaccggtccgggtacggtaacgggttaggggtacccgtacgggtacctaaccggttaggtaccttttaaccggaacttaaccgttaaaggtaaacgttacggtaacgggtacggggtaaggggtacgggaacgggtacgtaagggaggttaaggtttacggtttaggtttacggtacttacggtttaattaaccggttgtaccgtagttacgacgtaaacgacgtaacaccggtacgtacgtaccgttacgttacggtttacgaccggtacgggaacgtacggcgtaggacgtactacgtagtacgacgtgtcggtacg

SEQ ID NO: 37042 - DNA, 843 bp, Homo sapiens
  misc_feature: GYAE6OF01BGFN7.13.46.E02.1.454.CMB.1.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
tcagtcacgtactacacgaccggtgctcgatttagactcatctacagggaaaggggtgatcaggactcctcagttcaccttctcacaatgaggcctccctgctcagcctccgtgggctgctaatcgcttcgtcgggtaccctaggtagtttaggaggggatggtcttagtatacgactacactcctcccnctccctcccgtccgtccctacctaccgtggaccnccggcccncctacnctccgtctagctagttacgatacgaaccgtcctaccgtacacttacgagtagtacggcggacctaaccgttaccttagttacgttacggtttcggttacggcgtaacggaccggtacggaccgtaacccgtacgtaccgtaacccggacgggttacccttaaacgtttaaagtttagtaacggtgtacggtaacgtaccgggtaccgggtcccgggttacccgggaaccacggaaccgtaagtaaccgttcgggaccggttaccgtcggacggttacggaccggtacggtactacgttacgttacctacgtaacgtttaacgaaacggtaaccgtaggtaccggagggggtaacgggtaaaccgggtgtaacgggttgggtaaaggtttcggttacgggttacgtttacgggtacctttagtttaacggttcgtagttacgttaagtaaccggtaactaacggtaaaccagtaaccgttaaccggtacccgttacggttaccgttccggttaaccgggaacccggtaacgggttaccaggggttaacccgaggttaaaccggtacgtaaacccggtaacgtaggtcggtaccggtgtaccccggg

SEQ ID NO: 37043 - DNA, 761 bp, Homo sapiens
  misc_feature: GYAE6OF01BNYHC.13.46.E02.1.454.CMB.1.raw
tcagtcacgtactacacgaccggtgctcgatttagactcatctacagggaaagggtgatcaggactcctcagttcaccttctcacaatgaggctccctgctcagctccgtggggctgctaatcgctcgtcggtaccaggtagtttaggaggggatgcttagtaatcgtactctagtcctccacctcctccctcgcccgtccaccgttgacgcgcccgtcctcctactcctccgtgctagttctagtacaaccgtcctacgtacagtacagtaggacgtcggacctaacctaccttaacgttaggttaacggtttcgggttacggacgtaacggacggtccgaaccggacctaacgtcccgtaacgaacggtaccttaacgtttaaatttagtaggtcgttactacggacggacgggttaccggtaccgggaaccgtacggaactagtacgtacgacggacgagtagggtcggacgtagtcctagtacgttacttaccgaacgttaacgtaaagtaacctcgggtaacggtacgggtaacggggtacggagggttaacggtagggttaaccgggtaggtttacggtttcggttcccgggtttaattacgttttacggttacgtagaaccgtagtacgtaaccgacgtaacccacgtacctacggttaccgtaacccgttgttacggtaccgggaaccgacgggtaagacggttcggaagtactacggttaacctaagggttacctcgggttcggacgtcccg

SEQ ID NO: 37044 - DNA, 748 bp, Homo sapiens
  misc_feature: GYAE6OF01ACME5.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcacgtctccactcctccctcgcccgtcacccgttggacacgccggcctccactcctcctcgctacgttactagtaccaaacgccctacgtacatctagtgtagtcgggaccacctaccttactttaggtagtttcgggttcggacgacggccggaccgacggaccctaagtccgtacccgaacggtccgtaacctttaagttttaaaggtacggttcgttacgtacggaacggtacggggtaccgggtcccggggtaacccaaggaccgtaagtacgttcgacggcgggtacgacgggttacggtccgaacggtcctacgttacgtactttaccacgtaacgtaacgaaacgtcgaggaccggtaggggtacggacgggtcgtaaggtacgggtttaggttacggtttaggtacgggttctttacgtttaacgtttagttacgtagtaactcggaactaaacgtacctaacgaccgttacggtaccgggttaccctacggtttaccggttaccgggaacccggtacgggtaaccacgggtaccgttaggaaccgtactaacgtacctaggacgttgggcgtacccg

SEQ ID NO: 37045 - DNA, 753 bp, Homo sapiens
  misc_feature: GYAE6OF01B1KPW.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggtatttaggaggggatgtctgtaatgactcagtcctccactcctccctcgcccgtcaccgttggacacggccgcctccatctcctgcgagttcgtagtacaacgtccctacgtactatcagtaggacgtcgggccaaccgtacctttacgttagtaacgtttgggtttccggacgacggacgggtaccgaacggacctaactccgtaccgaacggaccgtaccttaagttttaagttaacgggttacgtacgtaggaaccggaggggtaccccggttccgggggtaccccgaagacgtaacggtacgttacggaaggccgggacgtaggggtcggtacgtacgggactacggtgtaccgttacacgtactaagaaacgttcgaacgtacgggaggggtcggagggtagtaagggtaggtacgtttaggttagtttcggtacttcgtttaactttagtcgtcgtagtacgtagaaccgtacaaaccgttagaccgttacggtaccgttaacggttacccgtttacggaaccgggtaacggggtaaccgaaccggtttcggacgtaaacggtacgtaactaacgggtaaccgttaacggttgggtccgttaacccgg

SEQ ID NO: 37046 - DNA, 562 bp, Homo sapiens
  misc_feature: GYAE6OF01BKPX6.13.46.E02.1.454.CMB.1.raw
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
  modified_base (525)..(526): a, c, t, g, unknown or other
  misc_feature (525)..(526): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(545): a, c, t, g, unknown or other
  misc_feature (540)..(545): n is a, c, g, or t
  modified_base (547)..(558): a, c, t, g, unknown or other
  misc_feature (547)..(558): n is a, c, g, or t
  modified_base (560)..(562): a, c, t, g, unknown or other
  misc_feature (560)..(562): n is a, c, g, or t
tcagtcacgtactacacgaccggtgctcgatttagactcatctacagggaaaggggctggagtggttggcagtcatttcagatgatggcaatgataaatattacgcacgctccgtgaagggccgattcgccatctccagagacaattcccaggaacacgctgtacctggagatcggacggcctgacgacctgacgaccacggctaaattttatactgtgcgtagggtttatgtgttaggaacgtggtaccaaccggtaaactggtccgacccgtgggccacgggaccctggtccgtcgtctcgtcgtcgcctaccaccgaacggccccaagttccggtcccttacccccgtggcccgccctgcctccgaggccgcctaccgtccgagacgcgacgcggccgccgtggctcgccgtggtacaacggtaccttacccgttacgtacggtacgttacgacgtcggacggtccgggtaccgtgggaaccgtaacggcccgaacgttaacggacgtnacgtgntacgcanncnganangcngngnnnnnngnnnnnnnnnnnncnnn

SEQ ID NO: 37047 - DNA, 869 bp, Homo sapiens
  misc_feature: GYAE6OF01A0Z6C.13.46.E02.1.454.CMB.1.raw
  modified_base (827)..(827): a, c, t, g, unknown or other
  misc_feature (827)..(827): n is a, c, g, or t
  modified_base (856)..(856): a, c, t, g, unknown or other
  misc_feature (856)..(856): n is a, c, g, or t
tcagtcacgtactacacgaccggtgctcgatttagactcatctacagggaaaggggtgatcaggactcctcagttcaccttctcacaatgaggctccctgctcagctccgtgggctcgctaatgcctcgtcgggtcccaggtatttaggagggatgctagtaatgactcgagtcctcctactcctccccgtcgtccccgtcctacccgtggaccgcggtccccggccctacctctcctaccgtgtctacgttctagtaaccgaacgtcccgttactacactcgatacggagtaccggacctaacctaaccgttacgttaggttaacgtttcggttaccggacgaggacccggtaccgaacggtaccctaacgtcccggtaaccgtaaccggaccgtttaaccttaaagtttacggtaacgggttcgtacgtaccggaacggtaaccggggtacccggtacccgggtacccgaaacgtaaccgtgtacgtacggaaccggtcggtacccggtagggtacggtaccaacgggtcccgtacgtttaacgttaaccttaacgtaaccgttaagtaacgtaaaacggccgtaaggttaccgggaggggtaacgggtaagggtaccggtaagggttaaggttaccggttttaggttacggtttaagggtccctttaaaggttaatttaccgggttacgagtaaccgttcgaaccgtaaccggtaacgtaaccccgttaaggttacccggtcgggttaacccttaacccggttttacgggaccgggtaaaccccggaaggtacccgtaaccgggtaacgtagaaaccccggttntaaaccccggttagaccggtttaaaccgngggttctacccgg

SEQ ID NO: 37048 - DNA, 873 bp, Homo sapiens
  misc_feature: GYAE6OF01EJCO4.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatgctcgtgggtacccaggtagtttaggagggtatgctagtaatgacctcgtacgtcctccacttcctcccgtcgccccgttcctaccgttcggaccgaccggtcccggtccctcctacttcccgtcctcgtcctaggtttacctagtaaccaaaccgtcccttacgtacaacttcgtaagtggtacgtcggacctaacctaccgtttacgttaggttaacggtttcgggttacgacgtaacgggtccgaccgtacggtacccttaacgtccgtaaccggtaaggtacccgttaacttttaaaagtttacggtacggttcgttccgaacggtaccgggtaaccggggttaccccggtacccggggtacccaacggtaaccgtaagttacgttaccgggacggtaccggtacggttaacgggggtacggtaccctaggggtacctaacgttacggttaacctttaccgaaaccgttaacgttaaagaaaaccgtcggtaaccgggaggggtaccgggggtagtaccgggtcggttaaggtaggggtttaattttagggtttaccggggtacttaccgttttaatttaggtttacgtacgacgtagttaccggaactaacgaccgtaaaccacggttaccgtaccggttaaccgttacggtttaccgttacggggaaacccggtagggtaaacccttggaacgggttacgtaacgtaaccttacgaaacgggttccgaaggttcggtcggtacc

SEQ ID NO: 37049 - DNA, 716 bp, Homo sapiens
  misc_feature: GYAE6OF01DCH3Q.13.46.E02.1.454.CMB.1.raw
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggatttaggaggggatgctgtaatgactcatctccactctcctgcccgtcaccttggacacgccggcctccattccnctgctagttacagtacaaacgcctactacatcgatggatggcaacnccgttactagtaatttcgggtttcgcgaggacggaccaggtacctaataccgtacgaacggtacgtaacctttaaaagtttagtaaacgggttgtacgtaggaaccgacggggtaccggtacccgggtacgacaacgagtaacgttacgacggcggtacgagggtaggtcgagggctacgtactagtttaacaactaacttaacgaaacgttaacgacggaacggtaggggtacgggtaaggtagtgggtaaggttaaggttacggtttaaagttcggggtactttacgttaagtttacgtgtaaccgtagttacgaacgtaacgtaacaacgtacgtacgtaggtaccctaccgtttacggttaccggtaaccggaacgggtaaacctacgggtacgtaacggggaacttaacggtaacgtaaacgttaccggtaaacgggtgtcggtaacccgg

SEQ ID NO: 37050 - DNA, 712 bp, Homo sapiens
  misc_feature: GYAE6OF01CWIYN.13.46.E02.1.454.CMB.1.raw
  modified_base (678)..(678): a, c, t, g, unknown or other
  misc_feature (678)..(678): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggtagtttaggaggggatgctgtaatgactcagtctccacttcctccctcgcccgtcctacccttggaccacgcccggtccctccacttcctcctgcgtacgtttcgtaacgtaccaaacgtcccttcgtacatacagtgagtacggaccaaccgtacctacgtttacggtaacgtttgggttacggacgtacggacggaccgacggaccctaacgtccgtaaccgaacggtccgttaaccttaaagttttacgtaaggttcgtacgtacgaaccggacgggtacccggtcccgggtaccaacgacgtacgtacgttcgacggcgacgtaggtcggtacgaggtcgacgttagtaacttacaacgtaacgtaagtaactacggacggtacggtaagggtcggaggtacgtaggagtacgttggttacggtcgtacttgttaagttcgtgacgtagtacgaacgtacactaaccacgtcgtacgtaccttacgttaccggttcggaacccgggtacgggaaccctagggtcgtacgggtaanacgtaaacgtaacgtggtaacgtggtacgtaccg

SEQ ID NO: 37051 - DNA, 572 bp, Homo sapiens
  misc_feature: GYAE6OF01EY8PU.13.46.E02.1.454.CMB.1.raw
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (546)..(547): a, c, t, g, unknown or other
  misc_feature (546)..(547): n is a, c, g, or t
  modified_base (550)..(552): a, c, t, g, unknown or other
  misc_feature (550)..(552): n is a, c, g, or t
  modified_base (554)..(556): a, c, t, g, unknown or other
  misc_feature (554)..(556): n is a, c, g, or t
  modified_base (558)..(562): a, c, t, g, unknown or other
  misc_feature (558)..(562): n is a, c, g, or t
  modified_base (564)..(565): a, c, t, g, unknown or other
  misc_feature (564)..(565): n is a, c, g, or t
  modified_base (567)..(572): a, c, t, g, unknown or other
  misc_feature (567)..(572): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacaggcctatattactgtgcagtgagtcgggcccacgaccacgtacgttttggagtggtgcgctcgaccccgtggggcccggacctggtccaccgtctcctcacgccctccaccgacgggcccacgtccggtccttcccccgtgggccgccctgcctccgaggacgccaccgtccgagacgcacgacgccggcccgtcgggcctcggcccgttgggtaccgaacggtaccctttacccgttccgtaagggttaccggtcggtaccgtcgggacgggtcccgggggtccttacggggaccggtaacggggcccgtacgtaaagtacggctagtcgancgngngngnncgnnngnnngnnnnngnncnnnnnn

SEQ ID NO: 37052 - DNA, 610 bp, Homo sapiens
  misc_feature: GYAE6OF01BUNJ3.13.46.E02.1.454.CMB.1.raw
  modified_base (178)..(178): a, c, t, g, unknown or other
  misc_feature (178)..(178): n is a, c, g, or t
  modified_base (565)..(565): a, c, t, g, unknown or other
  misc_feature (565)..(565): n is a, c, g, or t
  modified_base (577)..(577): a, c, t, g, unknown or other
  misc_feature (577)..(577): n is a, c, g, or t
  modified_base (582)..(582): a, c, t, g, unknown or other
  misc_feature (582)..(582): n is a, c, g, or t
  modified_base (585)..(588): a, c, t, g, unknown or other
  misc_feature (585)..(588): n is a, c, g, or t
  modified_base (590)..(610): a, c, t, g, unknown or other
  misc_feature (590)..(610): n is a, c, g, or t
tcagtcacgtactacacgaccggtgctcgatttagactcatctacagggaaagggctggagtggattggccatattaaggacagacctaatggcgcgacagcacactaccttgaatccgtcaaagacagattcatcatctcgagaggtgattccgacaacacggtgtctctccattangacgcagtcctagaaaagtcgagacacgagtcctaattattaacgtgtcgacgagtcgagtcgggaccaaccgtaccacgttacgttttggaggttcggtcgccgtccgtacccggaccccggttccgggggaccccggtacccgtggtaccctacccggtccttacccgcgaccgtccccaccgaaccgaccggccctacgtccgttaccctccccgtcgcccctaccctccacgacgctccgtaccgtccgggtacgggccaacgccggtcccggtccgtacgggtccttaccggacggttaccggtacgtaaccggtaccgtttccttacccggtaggtttaccccgagtacggtacggacgggtcggacgtggacgtaccggngtaacgtgacgntgcancgnnnncnnnnnnnnnnnnnnnnnnnnn

SEQ ID NO: 37053 - DNA, 808 bp, Homo sapiens
  misc_feature: GYAE6OF01DHO45.13.46.E02.1.454.CMB.1.raw
  modified_base (290)..(290): a, c, t, g, unknown or other
  misc_feature (290)..(290): n is a, c, g, or t
  modified_base (777)..(777): a, c, t, g, unknown or other
  misc_feature (777)..(777): n is a, c, g, or t
  modified_base (799)..(799): a, c, t, g, unknown or other
  misc_feature (799)..(799): n is a, c, g, or t
tcagtcacgtactacacgaccggtgctcgatttagactcatctacagggaaaggggtgatcaggactcctcagttcaccttctcacaatgaggctccctgctcagctccgtgggctgctaatgctcgtcgggtcccagggtatttaggaggggtatgcttaggtaatgactctacgtcctcctacctcctccctcgccccgtactacccgtggacacggtcccggcccttccattcctccgtgtccgtacgtttaccctaagttaccgaaaaccgtccttaccggtaacnctacgtagtcgtaacgtcgggacctaacctaccgttaacttaggtaacggttttcgggttaccggaccgaagggaccgggaccccgaacggtacccctaaagtttccccgaaccgggtaacggggtacccttaaacccttttaaaggttttaagggttaaacgggtcggttacgtaacgggaaccggtacggggtaaccccgtcccggggttaccaacggtacgtaaccgtgttacccggagggttaccggagtaccggggtggtacgacgtactacgtagttaaccttacggaacctaacgtaaagtaactaacgacggtacggtaggggtacggaggtacggtagggtaagtcgttagggtttacgttcggtactttacgtagtttagtcgtacgtaacgtacggtataacgacaaccgtaccgtacggtcggtaacccgttacgtcggtttaccgaccggtaagggacctaggtacgacggtanacgtactaacggtacgtaacgnggtctaccg

SEQ ID NO: 37054 - DNA, 810 bp, Homo sapiens
  misc_feature: GYAE6OF01AWKLD.13.46.E02.1.454.CMB.1.raw
  modified_base (654)..(654): a, c, t, g, unknown or other
  misc_feature (654)..(654): n is a, c, g, or t
tcagtcacgtactacacgaccggtgctcgatttagactcatctacagggaaaggggtgatcaggactcctcagttccaccttctcacaatgaggctccctgctcagcctccgtggggctgctaatgctcgtcgggtcccaggatttaggaggggatggctgtaatgactcagtctccactcctccctcgacccgtccaccgttgacacggcccggcctccacttcctcctagtctacgttctacgtacaaaccgtcctacgtacagtctagtggtatacgggaccacctaaccttacgttacggttaacggtttcgggtttacggaccgaacgggtaccgggaaccccgtaacggtaaccctaaacgtacccgtaacccgggtaacggtacccgttaaccgttttaaagttttaaacggttaacggggttccttaacggtacgggtaaccgggtaacgggggtaccccgggttacccggggtaacccaaggtaaccgtacggtaacgttacggacgggtacggacggtacgggtacgggtacgtacgggactacgttagtacttaccgaactacggtaaacgacgtaggagacggggtagggtacggagttacgagggtagtagttggttacgtggtacttaagttattcggtntacgtagcgtaaacgacgtaaacccgtataccgtacggttaaccggtaccggtttaacgttccgggttaaccggggaaccgggtaacgggtaacccgaggtcgggtaacgaacggttactaacgtaacggtacccgggttagtccggttgaaccgg

SEQ ID NO: 37055 - DNA, 684 bp, Homo sapiens
  misc_feature: GYAE6OF01D0HTH.13.46.E02.1.454.CMB.1.raw
  modified_base (564)..(564): a, c, t, g, unknown or other
  misc_feature (564)..(564): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgctctgggtcccaggatttaggaggggatgctagtaatgactcagtctccactctccctcgcccgtcacccttggacacgcccggcctccactcctcctgctacgtttctagtacaaacgtccctacgtacatcatgagtcggcaacctaccttacgttgtaagtttgggttcgacgagacgccaggaccaatcctacgaacggccgtacttaattagtaaggtctctagacggtcgggtacccgtcccggggtaccaagacgtaagtacgttcgagggccggtacggtacgggttggggtaccgacggtaccctagttacgtaacttttaccaactaacgtaaacggtaaactacgacggagggtaggggtgggaaggtaggtaggtagggtgtttaggtttggtcgggttacttagttatttagtcgtaatagtacganaaccgacaaccgacgaccgttccggtacccgttacgttccggtttaaccgggaccgggtaacgggaaccgtacggtacggtaggaagtacgtacgaacgttacggtagtcggtgtaccgg

SEQ ID NO: 37056 - DNA, 583 bp, Homo sapiens
  misc_feature: GYAE6OF01A73T7.13.46.E02.1.454.CMB.1.raw
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (540)..(541): a, c, t, g, unknown or other
  misc_feature (540)..(541): n is a, c, g, or t
  modified_base (546)..(546): a, c, t, g, unknown or other
  misc_feature (546)..(546): n is a, c, g, or t
  modified_base (549)..(549): a, c, t, g, unknown or other
  misc_feature (549)..(549): n is a, c, g, or t
  modified_base (551)..(552): a, c, t, g, unknown or other
  misc_feature (551)..(552): n is a, c, g, or t
  modified_base (554)..(554): a, c, t, g, unknown or other
  misc_feature (554)..(554): n is a, c, g, or t
  modified_base (557)..(557): a, c, t, g, unknown or other
  misc_feature (557)..(557): n is a, c, g, or t
  modified_base (560)..(561): a, c, t, g, unknown or other
  misc_feature (560)..(561): n is a, c, g, or t
  modified_base (564)..(566): a, c, t, g, unknown or other
  misc_feature (564)..(566): n is a, c, g, or t
  modified_base (568)..(575): a, c, t, g, unknown or other
  misc_feature (568)..(575): n is a, c, g, or t
  modified_base (577)..(579): a, c, t, g, unknown or other
  misc_feature (577)..(579): n is a, c, g, or t
  modified_base (581)..(583): a, c, t, g, unknown or other
  misc_feature (581)..(583): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacgacggtgtctctccatagtgancagcctagaaatcgaggacanaggcctattatactgtgcagtgagtcggccacgaccacgtgtttggagtgngcgcctcgacccgtcggggcccggtaccgngtccncgtcctcctcgactcccnccgaaccgaccggccctacgtccggttcccttacccccgtcgtccccaccctccctaccgaccgcgtaccctaccgtcggtcgggggacctacgggaccggcccggcccggtcgggacgtcccggtaccggtcgggttacgaaccggttccgttacccgttccggttaccggtaacgtcgtacggtacgggacgggtcgggtaccggtcggacgtacgggcgaccgagttgnncgacngcngnngngcngcnngcnnncnnnnnnnncnnncnnn

SEQ ID NO: 37057 - DNA, 873 bp, Homo sapiens
  misc_feature: GYAE6OF01CW5WX.13.46.E02.1.454.CMB.1.raw
  modified_base (701)..(701): a, c, t, g, unknown or other
  misc_feature (701)..(701): n is a, c, g, or t
tcagtcacgtactacacgaccggtgctcgatttagactcatctacagggaaaggggtgatcaggactcctcagttcaccttctcacaatgaggctccctgctcagctccgtgggctgctaatgctcgtcggtcccaggtatttaggaggggatgcgttagtaatgactcagtcctccacctcctccctcgtcccgtcctacccgttggaccacggcccggcctaccactccgtccgtcggctagttctaacgtaccgaaacgtcccttacgtactactaccagttcggagtcgggacctaaccgtaaccgttaaccgtttaggtaacgttttcggggtttaccggaccgtaacgggaccgggacccgtaaaccgggtaccctaaaccgtacccggtaacccgtaaccgggtacccgttaaccgtttaaaagttttaccggtaaagggttcgttaaccgtacgggttaaccggaccgggggtaccccggttaccccgggggacctaacggtacgtacggtacttacggacgtcgggtacgtacggggtacggtaccggaggtacctacgttacggttacgttaaccgacgtaaacgtaaggttaaaaccgggtaacggcggtaaggggtcggaacggtcggtaggtaacgttaggtttacgtttaggtcggttacctttagttaacgtttcgtacgtaaacnggttaaccgacggtaaacgtccgtaaaaccgtcggttacccggtccgggtaaaccctttacggttacccggtttacggggaacccggtaaacggggtaacccctagggtacgggtacggaaacgttcgttaaacccgaacggttacccgttaaggttccgggtccgtaaccg

SEQ ID NO: 37058 - DNA, 949 bp, Homo sapiens
  misc_feature: GYAE6OF01E2H55.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtgggctgctaatgctcgtcggtacccaggtactttaggagggtatgctagtaatgactcgtagttcctacccgtaccttcccgtcccgtcccgtccccttaccgtaccggttagaccgcccggtccccgtaccctcccgtacttccgtccgtcgtaccgttacgttaccgtaccgtaacccgtaaccgttccccgttaacgtaacctctacgtaggtacggtaacgggtccgtaaccctaacccggtttaccttttaacggttacggtttacggtttccggtacggacgtaccggaccgtaccggaccctacgtaccgtaccgactaacggttacccttaagtttaacgttacggtgttaccgtaccgtacggaaccgggtaccgggtcccccggttaccgggaacctaggaccttacgtacgtacggacggtacggtaccggtagggttccgaacgtacgtccgttaacgtatttaacccggtaccaaccgtttaacgaacgttaaccggtcggtaacgggtaccgggtagggtaaccggtaacggttcggtaaggttacggtttaagggtttaccggtttaccggttaaccgttacgttttaacgtttaggtaccgtttacggtaaaccgtaacgttaacccggtagtaaacccgtaaacccggtacccggtaacccggtttaccgtaaccccgggtttaaaggttacccccggttttagggaaacccgggtaccggggtaaacccggtaacggttaccggtaaggttaacccggtaaaccgttaccggtaacttaaccggttaacccggttcggtaccgggtcctttaaccccggg

SEQ ID NO: 37059 - DNA, 477 bp, Homo sapiens
  misc_feature: GYAE6OF02GYU25.13.46.E02.1.454.CMB.1.raw
  modified_base (313)..(313): a, c, t, g, unknown or other
  misc_feature (313)..(313): n is a, c, g, or t
tcagtcacgtactacacgaccggtgctcgatttagactcatctacagggaaagggtgatcaggactcctcagttcaccttctcacaatgaggctccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattaaattggtatcagcagaaaccaggtaaagcccctaagctcctgatctacgatgcatccaatttggaaacngggtcccatcaaggttcagtggaagtggatctgggacagtattttactttcaccatcagcagcctgcagcctgaagattattgacaacattattactgtcagcagtatgataatctccgatcacttcggccaaggacacgactggagattaacgatggtgctgc

SEQ ID NO: 37060 - DNA, 520 bp, Homo sapiens
  misc_feature: GYAE6OF02HG8FZ.13.46.E02.1.454.CMB.1.raw
tcagtcacgtactacacgaccggtgctcgatttagactcatctacagggaaagggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatcctcctgcagttctagtcaaagcctcgtacatcatgatgggcacacctacttgaattggtttcgcagaggccaggccaatctccaaggcgcctaatttataaggtgtctgacagggactccggggtcccagacagattcagcggcaggtgggtcaggcactgattttcacactagaaaatcagcgagggtggaggctgaggattgttattgggctctattattgcatgacaagcaaacacactggccgttactaccgttttggacccgtaggggaccaagcgtggagactacaagtcgaacgttggtggtcg

SEQ ID NO: 37061 - DNA, 498 bp, Homo sapiens
  misc_feature: GYAE6OF02I5Y4S.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtgaggctgaggatgttattgggctctattattgcatgacaagcaacacactgccgtacactttggccgagggaccaagctggagatacgaatcgaactgtgtcg

SEQ ID NO: 37062 - DNA, 500 bp, Homo sapiens
  misc_feature: GYAE6OF02I6O77.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaaatctccaaggcgccctaatttataaaggtgtctgacagggactccggggtcccagacagattcagcggcagtgggtcaggcactgatttcacactgaaaatcagcagggtggaggctgaggatgttattgggctctattattgcatgcaagcaacacactgccgtacacttttggccaggggaccaagctggagatcaatcgaactgtgtcg

SEQ ID NO: 37063 - DNA, 553 bp, Homo sapiens
  misc_feature: GYAE6OF02GEK2U.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgacctaatttataaggtgtctgacagggactccggggtccagacagattcagcggcagtgggtcaggcactgatttcacactagaaaatcagcagggtggaggctgaggatgttagttgggctctattattgacattgacaagcaaacacacgtggacccgttaactacgttttcgggaccgtaagggggaacccaaaggtccgttagggaacgtacgttaccgaaacgttccggaaacgttcggtacggtaccg

SEQ ID NO: 37064 - DNA, 507 bp, Homo sapiens
  misc_feature: GYAE6OF02FGB75.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactcggggtcccagacagattcagcggcagtgggtcaggcacgtgatttcacactgaaaatcagcgagggtggaggctgaggattgtattgggctcttattattgcatgacaagcaacacactgccgtactactttcggccgaaggggaccaaggctaggagatcaagtcgaactgtggtcg

SEQ ID NO: 37065 - DNA, 497 bp, Homo sapiens
  misc_feature: GYAE6OF02JCN2X.13.46.E02.1.454.CMB.1.raw
tcagtcacgtactacacgaccggtgctcgatttagactcatctacagggaaagggtgatcaggactcctcagttcaccttctcacaatgaggctccctgctcagctcctgggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtccagacagattcagcggcagtggtcaggcactgatttcacactgaaatcagcaggtggaggctgaggatgttattgggctctattattgcatgcaagcaaacacactggccgtacacttttggccgaggggaccaaggctggagatcaatcgaactgtggtccg

SEQ ID NO: 37066 - DNA, 492 bp, Homo sapiens
  misc_feature: GYAE6OF02GJ4SV.13.46.E02.1.454.CMB.1.raw
  modified_base (471)..(471): a, c, t, g, unknown or other
  misc_feature (471)..(471): n is a, c, g, or t
tcagtcacgtactacacgaccggtgctcgatttagactcatctacagggaaaggggtgatcaggactcctcagttcaccttctcacaatgaggctccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatcaatttggaaacagggtcccatcaaggttcagtggaagtggatctgggacagtattttactttcacctatcagcagccctgcagcctagaagtataattgcaaacatatttactgtcagcagtatgaattaactctccgatcaccttcggacaagggacacgactggaanacttaacgactgcggctgacc

SEQ ID NO: 37067 - DNA, 523 bp, Homo sapiens
  misc_feature: GYAE6OF02HS81S.13.46.E02.1.454.CMB.1.raw
  modified_base (435)..(435): a, c, t, g, unknown or other
  misc_feature (435)..(435): n is a, c, g, or t
  modified_base (452)..(452): a, c, t, g, unknown or other
  misc_feature (452)..(452): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctactgaattggtttcggcagaggccaggccaatctccaaggcgcctaatttataaggtgtctgacagggactccggggtccagacagattcagcggcagtgggtcaggcactgatttcacactagaaaatcagcagggtggaggctggaggagttgtttagttgggtctctatttattgntatgcaagcaacacacnggccgtactacgttttggaccgtaaggggacccaaggccgtaggagtagtacaagtcgaacgtgtggtacg

SEQ ID NO: 37068 - DNA, 538 bp, Homo sapiens
  misc_feature: GYAE6OF02I3WEZ.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagagggatgctgtaatgactcagtctccactctccctgcccgtcacccttggacagccggcctccatctcctgcagttctagtcaaagcctcgtacatcatgatgggcacacctacttgaattggtttcggcagaggccaggcccaatcctccaaggcgcctaatttataaggtgtctgacagggactccggggtccagacagattcagcggcagtgggtcaggcactgatttcacactgaaaactcagcagggtgaggcaggagattgttagttgggctctattagttgcgattgacgaagaccaacaacgactacggccgtaactacgttttggacccggtaaggggtacccaaggcgtacggagaacttcgaaacgttcgaacgttgaggtaccg

SEQ ID NO: 37069 - DNA, 503 bp, Homo sapiens
  misc_feature: GYAE6OF02F6LS9.13.46.E02.1.454.CMB.1.raw
tcagtcacgtactacacgaccggtgctcgatttagactcatctacagggaaaggggtgatcaggactcctcagttcaccttctcacaatgaggctcccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaatcagcagggtggaggctgaggatgttattgggctctattattgcatgcaagcaacacactgccgtactacttttggaccgaggggaccaaggctggagatcgaatcgaactgtgtacg

SEQ ID NO: 37070 - DNA, 505 bp, Homo sapiens
  misc_feature: GYAE6OF02HJRF7.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaatcagcagggtgaggctgaggattgttagttgggcttctattattgcatgacagcaacacactgccgtactacgttttggccgaagggaccaaggctggagactacgaatcgaactgtgtcg

SEQ ID NO: 37071 - DNA, 619 bp, Homo sapiens
  misc_feature: GYAE6OF02JY92Y.13.46.E02.1.454.CMB.1.raw
  modified_base (253)..(253): a, c, t, g, unknown or other
  misc_feature (253)..(253): n is a, c, g, or t
tcagtcacgtactacacgaccggtgctcgatttagactcatctacagggaaagggtgatcaggactcctcagttcaccttctcacaatgaggctccctgctcagctcctgggctgctaatgctctgggtcccaggatttagaggggatgctgtaatgactcagtctccactctccctgcccgtcacccttggacacgccggcctccatcctcctgcagttcctagtcaaagcctcgtacatcatgatggcacncctactgaattggttcgctagagccaggccaatctccaaggccgcctaatttataaggtgtctgactagggactccggggtccagacaggacttcagcggcaggtgggtccaaggcacgtgaagtttcacaccgtagaaaatcagccgaaggggttggaacggtcgtaggaaggagttggtttaagttcggggtaccttagttagtttagttggtctaagttggtacaaagggccaaacgaccgaacttcgggacccgttacgtacctttttggggacccgttaacgggggtaccccaaggtaccggttaccgggtaaggtaacgtaccggtaaacgttccggtaaacgttcggtaagggtcccgg

SEQ ID NO: 37072 - DNA, 511 bp, Homo sapiens
  misc_feature: GYAE6OF02GMLRE.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtccagacagattcagcggcagtgggtcaggcactgatttcacactagaaaatcgagcgagggtggaggctggagattgttagttgggctctattattgcatgacaagcaacacactggccgtacacttttggaccgaggggacctaaggctaggagatcgaatcgaactgtggtacg

SEQ ID NO: 37073 - DNA, 512 bp, Homo sapiens
  misc_feature: GYAE6OF02FMEI6.13.46.E02.1.454.CMB.1.raw
  modified_base (419)..(419): a, c, t, g, unknown or other
  misc_feature (419)..(419): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgattttcacactgaaaatcagcagggtggaggctgaggatgttattgggntctattattgcatgcaagtcaacacactggccgtacacgttttaggccgtaacggggaccaagcttggagagtccaatcgaactggtggtacg

SEQ ID NO: 37074 - DNA, 502 bp, Homo sapiens
  misc_feature: GYAE6OF02IBEI9.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaaagcctcgtacatcatgatgggcacacctacttgaattggtttcggcagaggccaggccaaatctccaaggcgcctaatttataaggtgtctgacagggactcggggtcccagacagattcagcgcagtgggtcaggcactgattttcacactgaaaatcagcagggtggaggctgaggatgttattgggctctatattgcatgcaagcaaacacactgaccgtacacttttggccaaggggtaccaagctggagatcaatcgaactgtggtcg

SEQ ID NO: 37075 - DNA, 417 bp, Homo sapiens
  misc_feature: GYAE6OF02HOL2J.13.46.E02.1.454.CMB.1.raw
  modified_base (413)..(417): a, c, t, g, unknown or other
  misc_feature (413)..(417): n is a, c, g, or t
tcagtcacgtactacacgaccggtgctcgatttagactcatctacagggaaaggggctggtgtgggtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaagaggtggctggtcgcatggttttgatctcgtggggccaggggacaatggtaaccgtctcttcagcctccaccaagggcccatcggtcttcccctggcgccctgcctccaggagcacctccgagagcacagcggccctgggctgcctggtcaaggctacttcctagtacgtgactgagcgggctggcaggcgcatagnnnnn

SEQ ID NO: 37076 - DNA, 657 bp, Homo sapiens
  misc_feature: GYAE6OF02HX2A4.13.46.E02.1.454.CMB.1.raw
  modified_base (272)..(272): a, c, t, g, unknown or other
  misc_feature (272)..(272): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctactgaattggttcggnagaggccaggccaatctccaaggcgacctaatttataaggtgtctgacagggactccgggtaccagacagattcagcggcgagtgggtcgagacgactggtatttaccgtacaactacgaaaatcgagacgaagggtagggacggacgttggaagggattaggttttaagttgggtaccgttacgtttaagttaaagttttcgacgttaacgttggaaccaaacggtaccaaaacaaccgaaacctaccggggttacccggtaacctttaaccgtttttcgggtaccccggtaaggggggtaacccccgtaaaggtaccccggtttaaggaaccggttagtaaacccgtaaagttacccggtaaacgttccgggttaggtaccgg

SEQ ID NO: 37077 - DNA, 600 bp, Homo sapiens
  misc_feature: GYAE6OF02J1J6Y.13.46.E02.1.454.CMB.1.raw
  modified_base (273)..(273): a, c, t, g, unknown or other
  misc_feature (273)..(273): n is a, c, g, or t
  modified_base (320)..(320): a, c, t, g, unknown or other
  misc_feature (320)..(320): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatcctcctgctagttctagtcaaagcctcgtacatcatgagtggcacacctactgaattggttcgnagacggcaggccaatcgtaccaaggcgaccttaatttacgtaaggtntcgtgacgagggtaccgtccggggtccagacagtacttcgacggcggcgaggtcggtcacggcactgtactttcactacgtagaaactcgagcgtagggtcggagcgtaggaggtagttggttagttcgggcttacttagttagttgacgtagtacgacaacgaccgaactacgtacgtcggtaccgttacttacgtttcggaccggtaacggggaaccctaggtaccgtagggtaacgaacgttacgtaaacggtacccgtaagttacggtcggtaccg

SEQ ID NO: 37078 - DNA, 506 bp, Homo sapiens
  misc_feature: GYAE6OF02HTMPK.13.46.E02.1.454.CMB.1.raw
  modified_base (396)..(396): a, c, t, g, unknown or other
  misc_feature (396)..(396): n is a, c, g, or t
tcagtcacgtactacacgaccggtgctcgatttagactcatctacagggaaagggtgatcaggactcctcagttcaccttctcacaatgaggctccctgctcagctcctgggctgctaatgctctgggtcccaggatttagaggggatgctgtaatgactcagtctccactctccctgcccgtcacccttggacagccggcctccatctcctgcagttctagtcaaaagcctcgtacatcatgatggcacacctactgaattgtttcggcagaggccaggccaatctccaaaggcgcctaatttataaggtgtctgacagggactccggggtccagacagattcagcggcagtggtcaggcactgatttcacactgaaaatcagcgaggtggaggntcgaggatgtttatgggctctatttattgcatgacagtacaaacacaactggacccgtactacgttttggccgtaagggaccagcgtgagatacaatcgaactgtggacg

SEQ ID NO: 37079 - DNA, 511 bp, Homo sapiens
  misc_feature: GYAE6OF02JAKN3.13.46.E02.1.454.CMB.1.raw
  modified_base (402)..(402): a, c, t, g, unknown or other
  misc_feature (402)..(402): n is a, c, g, or t
tcagtcacgtactacacgaccggtgctcgatttagactcatctacagggaaagggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcagttcagtcaaagcctcgtacatcatgatggcacacctacttgaattggtttcggcagaggccaggcccaatctccaaggcgcctaatttataaggtgtcctgacagggacctccgggtcccagacagattcagcgcagtgggtcaggcactgatttcacatagaaatcagcaggtggagctgaggntgttatgggctctatattgcatgctaagcaacactacgtcgaccgtactacgtttaggacccgtaggggacccaaggccgtaggagactacgaatacggtactgtacgg

SEQ ID NO: 37080 - DNA, 560 bp, Homo sapiens
  misc_feature: GYAE6OF02HV85G.13.46.E02.1.454.CMB.1.raw
  modified_base (462)..(462): a, c, t, g, unknown or other
  misc_feature (462)..(462): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcgcagaggccaggccaatctaccaaggcgtaccttaatttataaggtgtctgacagggaccgtccggggtcccagacagattcagcggcgagtgggtcaggcactgatttcactattagaaatcgaccgagggtggaggcgtggaaggagttggttagggtattttagttacgtgctagtgacaagctactnttcgtgtcctttcacgtttcgcccttagggaccaaaggtcggtaactacctaagtaccgaacgttcggttcgggaccttacgaccctaccgtattccg

SEQ ID NO: 37081 - DNA, 423 bp, Homo sapiens
  misc_feature: GYAE6OF02HIIWQ.13.46.E02.1.454.CMB.1.raw
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (417)..(423): a, c, t, g, unknown or other
  misc_feature (417)..(423): n is a, c, g, or t
tcagtcacgtactacacgaccggtgctcgatttagactcatctacagggaaaggggctggtgtgggtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaagaggtggctggtcgcatggttttgatctctggggccaggggacaatggtaaccgtctcttcagcctccaccaaggcccatcggtccttccccctggccgccctgcctccaggacgcacctccgagacgcacagccggcctgggctgcctggtcaaggactacttcctagtacgtgactgagcgggctggcaaggcncangnnnnnnn

SEQ ID NO: 37082 - DNA, 462 bp, Homo sapiens
  misc_feature: GYAE6OF02IIK0K.13.46.E02.1.454.CMB.1.raw
  modified_base (442)..(462): a, c, t, g, unknown or other
  misc_feature (442)..(462): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacgaggcctatattactgtgcagtgatgggccacgacacgacttttggagtggtgcgctcgacccctggggccccgggaaccctggtcaccgtcgtcctcagcctccaccaaagggcccatcggtccttcccctggccacccctctccaacgagcacctctcggggcaccagcggtcctcgggctgcctggtcaaggactactctagtacgtgactgagcgggctggcaaggcgacatacgnnnnnnnnnnnnnnnnnnnnn

SEQ ID NO: 37083 - DNA, 507 bp, Homo sapiens
  misc_feature: GYAE6OF02IU8PK.13.46.E02.1.454.CMB.1.raw
  modified_base (486)..(488): a, c, t, g, unknown or other
  misc_feature (486)..(488): n is a, c, g, or t
  modified_base (490)..(490): a, c, t, g, unknown or other
  misc_feature (490)..(490): n is a, c, g, or t
  modified_base (493)..(507): a, c, t, g, unknown or other
  misc_feature (493)..(507): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggccccgggaaccctggtcaccgtctccctcagccctccaccaacgggccccagtccggtccttccccccgtcgggccacccctccctccaacgacgccaccctcgtcggggggccaccgacggccggccctggggcctcgcccgtgggtccaacgggaccttaccgttcccttaggtaccgtgacctggagccgggctggcgaacggcgcagtagnnngncgnnnnnnnnnnnnnnn

SEQ ID NO: 37084 - DNA, 447 bp, Homo sapiens
  misc_feature: GYAE6OF02IR6JL.13.46.E02.1.454.CMB.1.raw
  modified_base (437)..(447): a, c, t, g, unknown or other
  misc_feature (437)..(447): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggccccgggaaccctggtcaccgtctcctcagcctccaccaagggcccatccggtcttccccctggcaccctcctccaagagcacctctgggggcacagcggccctgggctgcctggtcaaggactacttcctagtacgtgactgagcgggctggcaaggcgcatagnnnnnnnnnnn

SEQ ID NO: 37085 - DNA, 672 bp, Homo sapiens
  misc_feature: GYAE6OF02IIK7Y.13.46.E02.1.454.CMB.1.raw
tcagtcacgtactacacgaccggtgctcgatttagactcatctacagggaaaggggtagatcaggactcctcagttcaccttctcacaatgaggctccctgctcagctcctgggctgctaatgctctgggtcccaggatttagaggggatgctgtgatgactcagtctccactcctccctgcccgtccacccttggacagccggccctccatcctcctgcagttctagtcaaagcctcgtacatcatgatggcacactacttgaattggtttcgcaggacggccaggaccctaatcctaccgaaggcctaccttaaatttagtaaggttctacgttagacgaggggtaccgtccggggttacccaagaacctagaacgttcaacggccggcgtaaggtcgggggtacacggggactacgttggtacttttacgaactaacgtaagtaaaactacgaagtcggaagggtacgggacggagtaggaaggtagttaggttaaggtttcgggtaccttagtttaacgtttacgttggtaccgtagttacgaaccgtaaggaacaaaccgaactaaccgtaggtaacccgttacgtaccgttttacgggaccggttaacggggaacctaacggcgttaaggacggtaacgtacgtaagtaccgtaacgttaggtcgg

SEQ ID NO: 37086 - DNA, 513 bp, Homo sapiens
  misc_feature: GYAE6OF02G25YT.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtccagacagattcagcgcagtgggtcaggcactgatttcacactagaaaatcagcagggtgaggctgaggatgttagtgggctctattattgctatgcaagcaacacactggaccgtactacttttggaccgaacggggaccaaggcttaggagtatacgaatacggaactggtgtacg

SEQ ID NO: 37087 - DNA, 500 bp, Homo sapiens
  misc_feature: GYAE6OF02JCKUJ.13.46.E02.1.454.CMB.1.raw
  modified_base (450)..(450): a, c, t, g, unknown or other
  misc_feature (450)..(450): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcgcagtggtcaggcactgatttcacactagaaatcagcagggtgaggctgaggatgtattgggctctattattgcatgcaagcaacacactggccgtacncttttggcctaggggaccaagcgtggagagtacaatcgaactggtgtacg

SEQ ID NO: 37088 - DNA, 537 bp, Homo sapiens
  misc_feature: GYAE6OF02GDR7T.13.46.E02.1.454.CMB.1.raw
tcagtcacgtactacacgaccggtgctcgatttagactcatctacagggaaaggggtgatcaggactcctcagttcaccttctcacaatgaggctccctgctcagctcccggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggtttcgcagaggccaggccaatctccaaggcgcctaattataaggtgtctgacagggactccgggggtcccagacagattcagcgcagtgggtcaggcactgattcacactagaaaatcagcgagggtgaggctaggaggagttgttagtgggtcttagtattatgtcatgacaagcaacacactcggaccgtactacgttttggaccgtaacggggaacccaaggcgtaggaacgtatacgtaacgtacggtaactcgggttagcgtacgg

SEQ ID NO: 37089 - DNA, 533 bp, Homo sapiens
  misc_feature: GYAE6OF02HW9CD.13.46.E02.1.454.CMB.1.raw
  modified_base (160)..(160): a, c, t, g, unknown or other
  misc_feature (160)..(160): n is a, c, g, or t
  modified_base (301)..(301): a, c, t, g, unknown or other
  misc_feature (301)..(301): n is a, c, g, or t
tcagtcacgtactacacgaccggtgctcgatttagactcatctacagggaaagggtgatcaggactcctcagttcaccttctcacaatgaggctccctgctcagctcctgggctgctaatgctctgggtcccaggatttagagggatgctgtaatgactnagtctccactctccctgcccgtcacccttggacagccggcctccatctcctgcagttctagtcaaagcctcgtacatcatgatggcacacctactgaattggtttcgcagagccagccaatctccaaggcacctaatttanaaggtgtctgacagggactccggggtccagacagattcagcggcagtcgggtcaggcacgtgatttcacatagaaatcagcagggtgagctagaggtatgtttagttggcttactattattgctatgacagtacaacgacacgtcggtaccttacgtacgttttcggaccgtaaggggacctaggaccgttaggagtactaccgaagttaccggtaacgttcggtagtaccg

SEQ ID NO: 37090 - DNA, 841 bp, Homo sapiens
  misc_feature: GYAE6OF02IF3Z6.13.46.E02.1.454.CMB.1.raw
tcagtcacgtactacacgaccggtgctcgatttagactcatctacagggaaagggggtgatcaggactcctcagttcaccttctcacaatgaggctccctgctcagctcctggggctgctaatgctctgggtcccaggatttaggagggatgctgtaatgactcagtctccactcctccctgcccgtcacccttggacagccggcctccatctcctgctagttctagtacaaacgccctacgtacatccaatgagtcgggactaacgacctaacttagtaagtttaggtttccggcaggtaggcccgacggtaccaactccttacccgaaggccgccgttaaatttaagtaaggttgtctgacgacgggtaccgtcccgggggtccctacgacgtacggactttaccgacggtcgggaccgtaaggtcggggttacgacgggtactacgttacgtaattttaccgaaccttaaccgttaacggtaaaaacgttacccgaagtacccgggtaaagggggttagggtaacggggtaccggttagggtaacggggttaaggtttgggttttaaacggtttcggggtaaccgtttaccgtttaaacggttttaacgtttacggtaccgttaaacggttcgaaacccgtaaacggtaaccgtaaacccgaacccgtaccggttaccgggtacccgtttaaccgtttaccgttttttacccgggaaccccggttaaccgggggtaaccccgtaaacgggttaccccggttaacgggaaaccggttaccggttaaaccgtaaaccggttccccgggtaaaaccgtttcgggttaaccgggtaccccgg

SEQ ID NO: 37091 - DNA, 553 bp, Homo sapiens
  misc_feature: GYAE6OF02F10WH.13.46.E02.1.454.CMB.1.raw
  modified_base (409)..(409): a, c, t, g, unknown or other
  misc_feature (409)..(409): n is a, c, g, or t
  modified_base (449)..(449): a, c, t, g, unknown or other
  misc_feature (449)..(449): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggtttcggcagaggccaggccaatctccaaggccgctaatttataaggtgtctgacagggactccggggtaccagacagacttcgagcggacagtgggtcaggcactgtatttcacactagaaaactcgagcgagggtggaggcnggaggtatgttagttgggcttcgtatttagtgcagtcganaacgacaacgactacggtacgtaccgtacgttacgtttcggaccggtaacgggaccgtaagtcggtaggaactacgtacgtaagttcgaacgtggtacgtacgg

SEQ ID NO: 37092 - DNA, 517 bp, Homo sapiens
  misc_feature: GYAE6OF02I03ZQ.13.46.E02.1.454.CMB.1.raw
  modified_base (403)..(403): a, c, t, g, unknown or other
  misc_feature (403)..(403): n is a, c, g, or t
  modified_base (439)..(439): a, c, t, g, unknown or other
  misc_feature (439)..(439): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcacccttggacagccggcctccatctcctgccagttctagtcaaagcctcgtacatcatgatggcacacctacttgaattggtttcgcagagcaggccaatctccaaggcgacctaatttataaggtgtctgacagggtactccggggtccagtacagtattcagtcgacaggtggtcaggcactgatttcacactagaaatcagcaggtgagctgagntagttatggcttactattatgctatgacaagacaanacactcgacgtactactttaggaccgtagggaaccagtacgtggagtactacgtacgtacgtaacgtggtaggtaccg

SEQ ID NO: 37093 - DNA, 432 bp, Homo sapiens
  misc_feature: GYAE6OF02JK6GD.13.46.E02.1.454.CMB.1.raw
  modified_base (331)..(331): a, c, t, g, unknown or other
  misc_feature (331)..(331): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
  modified_base (422)..(432): a, c, t, g, unknown or other
  misc_feature (422)..(432): n is a, c, g, or t
tcagtcacgtactacacgaccggtgctcgatttagactcatctacagggaaagggactggtgtgggtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaagaggtggctggtcgcatggttttgatctctggggccaggggacaatggtaaccgtctcttcagcctccaccaagggcccatcggtcttccccctggcgccctgcctccagggacncaccctccgagacgccacagcggccctggggctgccctggtcaaggctaccttcctagtacgtgactgacgcgggntggcaggcncatagnnnnnnnnnnn

SEQ ID NO: 37094 - DNA, 524 bp, Homo sapiens
  misc_feature: GYAE6OF02GH78J.13.46.E02.1.454.CMB.1.raw
  modified_base (462)..(462): a, c, t, g, unknown or other
  misc_feature (462)..(462): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttcagtcaaagcctcgtacatcatgatgggcacacctacttgaattggtttcggcagaggccaggccaatctccaaggcgcctaatttataaggtgtctgacagggactccggggtccagacagattcagcggcagtgggtcaggcactgatttcacactagaaaatcagcgagggtgaggctaggaggtatgttagttgggcttcgtattattgctagtgcaagcaacacaccgtgccgttanaccgtttggaccgtacggggaccaaggcgtggaagactacgaagtcgaacgttgtggtaccg

SEQ ID NO: 37095 - DNA, 544 bp, Homo sapiens
  misc_feature: GYAE6OF02ICV0N.13.46.E02.1.454.CMB.1.raw
  modified_base (314)..(314): a, c, t, g, unknown or other
  misc_feature (314)..(314): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctactgaattggttcggcagaggcaggccaatctccaaggcgacctaatttataaggtgtntgacagggactccggggtcccagacagattcagcgcagtgggtcagcacgtgatttcacactagaaatcagcgagggtggaggcgtgaggattagttagtggtctactagttattgcagtgacgaacgacaaacaccgactcggaccgtacgtacgttttcggacccggtaagggacccaaggtccgtaggtacgtacgtacgtaacgtacggtaacgtggtaggtaccg

SEQ ID NO: 37096 - DNA, 642 bp, Homo sapiens
  misc_feature: GYAE6OF02IYQRK.13.46.E02.1.454.CMB.1.raw
  modified_base (270)..(270): a, c, t, g, unknown or other
  misc_feature (270)..(270): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcaccttggacagccgcctccatctcctgcagttcctagtacaaacgcctcgtacatcatgatggcacacctattgaattggttcgnagaggccagccaatccgtaccaaggtccgaccttaatttacgaaggttgtacgtagacgtacgggtacgtccggggtccagtaccagtacttcgaggacggtacaggtggtacgaggcacgtgtactttcgaacacgtaacgtaaaactcgaaggtacgaggggttacggacggtagtacggaaggtagttagggttttaaggttcgggtacttagttaacgtttagttacgtacctagtacgagtaacgtacctaaagccgaacgttcgtacccgttacttaccggttttacggaccggtaaccggggaacctaacggtacgtaggaacgtacgtaccgtaaacgtacggtaaaccgtggttcggaaccgg

SEQ ID NO: 37097 - DNA, 523 bp, Homo sapiens
  misc_feature: GYAE6OF02GLDB9.13.46.E02.1.454.CMB.1.raw
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
tcagtcacgtactacacgaccggtgctcgatttagactcatctacagggaaaggggtgatcaggactcctcagttcaccttctcacaatgaggctcccctgctcagctcctggggctgctaatgctctgggtccccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactagaaaatcagcagggtggaggntggaggattgttagttgggctntattattgcgatganaagacaacacactggccgtactaccgttttggccgaacggggaccaagcgtggagacgtcaagttcgaacttggtggtaccg

SEQ ID NO: 37098 - DNA, 537 bp, Homo sapiens
  misc_feature: GYAE6OF02HQLUB.13.46.E02.1.454.CMB.1.raw
  modified_base (286)..(286): a, c, t, g, unknown or other
  misc_feature (286)..(286): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaaagcctcgtacatcatgatggcacactacttgaattggttcgcagagccaggcaatcncaaggcgctaatttataaggtgtctgacagggactccggggtccagacagattcagcggcaggtgggtcaggcacgtgatttcacactagaaaatcgagcgagggtaggaggctgaggatgttattggtctcttattattgctatgacaagacaaacacactaggtaccgtactacgttttacggaccggtaacggggaacccaaaggcgtagggagtacgtacgaaagttaccgaacgttgtaggtaccg

SEQ ID NO: 37099 - DNA, 512 bp, Homo sapiens
  misc_feature: GYAE6OF02FWR74.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgccccgtcacccttggacagccggcctccatctcctgcagttctagtcaaagcctcgtacatcatgatgggcacacctacttgaattggtttcggctagaggccaggccaatctccaaggcgcctaatttataaggtgtctgacagggactccggggtcccagacagattcagcggcaggtgggtcaggcactgatttcactactagaaaatcagcgagggtggagctgaggatgttagttggctctattattgcatgacaagcaacacactgccgtacactttcggccgtaggggaccaaggctggagactacaagtacgaacgtgtggtcg

SEQ ID NO: 37100 - DNA, 544 bp, Homo sapiens
  misc_feature: GYAE6OF02FZRRG.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaatttggttcggcagaggccaggccaatctccaaggcgaccttaatttataaggtgtctgacgagggactccggggtcccagaccagattcagcggcaggtgggtcaggcacgtgtatttcacactagaaatcagcgagggtggaggcgtggaggtagttgtttagttgggtcttacgttatttagttgtactatgacaagacaacacacgtcggaccgtactacgtttcggaccgtaacggggaccaagtcgtaggagacgtacaatacgaacgtgtggtacg

SEQ ID NO: 37101 - DNA, 528 bp, Homo sapiens
  misc_feature: GYAE6OF02F3KI7.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgccccgtcacccttggacagccggcctccatctcctgcagttctagtcaaagcctcgtacatcatgatgggcacacctacttgaatttggtttcggcagaggccaggccaatctaccaaggcgcctaatttataaggtgtctgacagggctccggggtcccagacagatcagcggcagtgggtcaggcactgtatttcacactagaaatcagcagggtgagctgagattgttatggtctctattattgcatgacaagctaacacactgccgtactactttcgggaccgaacggggtaccaacggtcgtacggaagtacgtactaagtaccggtaacgtggtaggtaccg

SEQ ID NO: 37102 - DNA, 569 bp, Homo sapiens
  misc_feature: GYAE6OF02HXV9J.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggattttagaggggatgctgtaatgactcagtctccactctcccctgccccgtcacccttggaccagcccggcctccatctcctgcagttctagtcaaagccctcgtacatcatgatgggcacacctacttgaattggtttcggcagaggccaggccaatctccaaggcgcctaatttagtaaggtgtctgacagggactccgggtcccagacagattcagcggcaggtgggtcaggcactgattttcacactagaaaatcagcagggtgaggcgtggaggattggtttagttgggcttacttattagttgctagtgacgaagcaaacaccactcggaccgttaacgtaccgttttcgggacccggtaacggggaccctaaggccgtaggaacgtactaccgtaaacgtacggtaaacgttcggtacggtaccg

SEQ ID NO: 37103 - DNA, 678 bp, Homo sapiens
  misc_feature: GYAE6OF02FQYJ4.13.46.E02.1.454.CMB.1.raw
tcagtcacgtactacacgaccggtgctcgatttagactcatctacagggaaagggggtgatcaggactcctcagttcaccttctcacaatgaggctcccttgctcaggctccgtggggctgctaatgctctgggtcccaggatttagaggggatgctgtaatgactcagtctccactctccctgcccgtccacccttggacagccggcctccatctcctgcagttctagtcaaagcctcgtacatcatgatggcacacctacttgaatttggttcgcagaggccaggccaatcctacccaacggccgtaccttaaagtttagttaaggtcgtcctaggaccgaggggtaccgtcccgggtcccagacgaggtacttcgaggtcgggacgagggtcgggtacgaggccaccgtggtactttcgactacgtagaaaactcgaggtcggaagggtggaggtcgtaggaggttagttacggtagttcggggtacttagtttactttattgtacctagtccgactaaaggtccaaacgtaccgtacgttcgggtacccgttacgttacgttttaccggggacccggtaaacgggggtaacccctaaaggggttcccgttaaggggtaacggtaaccgttaccggtaaaccggttaccccgtaaggttcgggtacggtacccgg

SEQ ID NO: 37104 - DNA, 671 bp, Homo sapiens
  misc_feature: GYAE6OF02JGEAF.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctgggctgctaatgctctggtcccaggatttagagggatgctgtaatgactcagtctccactctccctgcccgtcacccttggacagccgcctccatctcctgcagttctagtcaaagcctcgtacatcatcgagtggcacaccttactgtaattggttcgcagacgcctaggaccaatcctacgacgcgtacctaatttagtaaggtacgtcgtacgacgacgggtaccgtccgggtacccaagtaccgtaagtacgtttacgacggtcggacgtaacggtgggtaccaaggtccaacgttaggtactttctaacgtacctaaggtaaaactccgaacggtcgaaggggttacggaggtcgtaggagtacgttgttacggttcggtcttacgtttatacgttgaccgtagtacgccgtaaacggtctaaaccgtaccgtacgtacgggtaacccgtttaaccgttaccggttttaacggccggtaaccgggtacctaaacgggtcgtaacgggtaacgtataaccggtaaccgttacgggaacctttgggtacggtaaccgg

SEQ ID NO: 37105 - DNA, 525 bp, Homo sapiens
  misc_feature: GYAE6OF02H8ZZW.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggcaatctccaaggcgcctaatttataaggtgtctgacagggactccggggtcccagacagattcagcggcaggtgggtcaggcactgattttcacactagaaaatcagcgagggtggaggcgtggaggagttggttagttgggtcttcgttatttattgtctagtgctaagacaacacactagccgtactacttttcggaccgacggggaccaaggcgtggagatcgaatacgactgtgtcg

SEQ ID NO: 37106 - DNA, 537 bp, Homo sapiens
  misc_feature: GYAE6OF02FYDXD.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcaggtctagtcaaagcctcgtatacagtgatggaaagacctacttgaattggttcagcagaggccaggccagtctccaaggcgcctaatttataaggtgtctgacagggactccggggtcccagacagattcagcggcaggtggtcaggcacgtgtatttcacactagaaaatcagcgagggtggaggcgtgaggatgttatgggtctctattattgacatgacgaagacaacacaaccgtcggaccgttactacgttttcggacccgaggggaacccaaggcgtaggacgagtacaacgtaccgtaacgtgtcggctacgg

SEQ ID NO: 37107 - DNA, 548 bp, Homo sapiens
  misc_feature: GYAE6OF02GTESS.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggccgaccttaatttataaggtgtctgacagggactccggggtccagacagacttcagcggcaggtgggtcaggcacgtgtactttcacactagaaatcgagcgagggtggaggctggagagttgttagttggctctattatgctagtgacaagacaacacacgtcggccgtactacgtttcggaccgtaacggggaacccaaggtccgtaggtaacgtacgtacgaaagttaccgaacgttggtagtaccgg

SEQ ID NO: 37108 - DNA, 519 bp, Homo sapiens
  misc_feature: GYAE6OF02G78LJ.13.46.E02.1.454.CMB.1.raw
  modified_base (303)..(303): a, c, t, g, unknown or other
  misc_feature (303)..(303): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgcagagcaggccaatctcaaggcgacctaatttanaagtgtctgacagggactccgggtccagacagatcagcggcagtggtcaggcactgatttcacactagaaatcagcgaggtggagctgagattggttagttgggctactattagttgctatgacaagtacaacacacgtcggaccgtactacgttttcggaccgaaggggaccaaggcgtacggagtactacgaataccggtaacgtgtcggtacg

SEQ ID NO: 37109 - DNA, 569 bp, Homo sapiens
  misc_feature: GYAE6OF02FOOBL.13.46.E02.1.454.CMB.1.raw
  modified_base (349)..(349): a, c, t, g, unknown or other
  misc_feature (349)..(349): n is a, c, g, or t
  modified_base (399)..(399): a, c, t, g, unknown or other
  misc_feature (399)..(399): n is a, c, g, or t
tcagtcacgtactacacgaccggtgctcgatttagactcatctacagggaaaggggtgatcaggactcctcagttcaccttctcacaatgaggctcccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgcagaggccaggccaatctccgaaggcgcctaatttataagtgtctgacagggactccgggtccagacagatcagcggnagtcggcaggcactgtactttcacactagaaaatcagcgagggtggagcngaggattgttagttcggacttcgttattagttgactagttcgactaagactaacgactaccgtagggtcccgtacgttacgtttcgggacccgtaagggggaaccctaaacggtaccgttaggaacgtaacgtaccggaaaggtacccggtaacgttacggtaggtcccg

SEQ ID NO: 37110 - DNA, 718 bp, Homo sapiens
  misc_feature: GYAE6OF02IWWXF.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctgggactcctgctgctctggctctcaggtgccagatgtgacatccagatgacccagtctccatcctccctgtctgcatctgtaggagacagagtcaccatcgacttgccaggcgagtcaggacaattaacaacttaatttaaattggtatacagacaagaaaccgaggtaaacgacccctaagcctacctgatctaacgatcgactatacctaagtttacggaaacgacggggtacccaagttaccgaaaggtttaccgaaggttaggaaggtaggtaagttccgtaaggggtaactaaggtttaacttttttaaccttttaccgaacctaacttaccgaaggacccgtaaggtccccgtaggaccaacgggtccgttaaggaaacggttaattacgtttacgaactaaaccttagtttaaacttttaccgtagttacgaacgtaccgtaaaggtttaactaggtaaactttaaccggttacccgtaacccttaacgttaccccttaacccgggtttaccgggaacccggtaaaggggtaaccctacggtaaccgtaaggtaacgtaaacgtttaaacccggagttacgggtacggtacctggtaaccc

SEQ ID NO: 37111 - DNA, 596 bp, Homo sapiens
  misc_feature: GYAE6OF02IY04K.13.46.E02.1.454.CMB.1.raw
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcaccttggacagccgcctccatctcctgcagttctagtcaaagcctcgtacatcatgatgggcacacctacttgaattggttcgcagagccaggccaatctaccaaggcgaccttaatttacgtaaggtcgtactgaacgagggtaccgtccggggtcccaggacagattcgagtccggnaggtgggcagggcactgatttcanactagaaaatcagcgagggtggacggtcgtaggaggtagttaggttagtttcgggacttagttaactttagttagtcgtagtcgacgaacgacaaccacgtacgtacggtaccgtaccttacgtttcggaccgaacggggaacccgtaaggtccgtagggtaacgtacgtaccgaaagttacccggaaacgttcggtacgtacccgg

SEQ ID NO: 37112 - DNA, 452 bp, Homo sapiens
  misc_feature: GYAE6OF02F707Z.13.46.E02.1.454.CMB.1.raw
  modified_base (442)..(452): a, c, t, g, unknown or other
  misc_feature (442)..(452): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtccttccccctggccacccctcctccaagacgccaccctctgggggcacgagcggccctgggctgcctggtcaaggactacttcctagtacgtgactgagcgggctggcaaggcgcatagnnnnnnnnnnn

SEQ ID NO: 37113 - DNA, 533 bp, Homo sapiens
  misc_feature: GYAE6OF02GOLFR.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcaggtgggtcaggcacgtgatttcacactagaaatcagcgagggtggaggcgtagaggtagttgttagttgggcttacttatttattgctatgacaagacaacacacgtcggaccgttactacgtttcggaccgtaggggaccaggtcgtaggagatcgaagtacgtaacgtgtagtacg

SEQ ID NO: 37114 - DNA, 522 bp, Homo sapiens
  misc_feature: GYAE6OF02G9Y5J.13.46.E02.1.454.CMB.1.raw
  modified_base (309)..(309): a, c, t, g, unknown or other
  misc_feature (309)..(309): n is a, c, g, or t
  modified_base (430)..(430): a, c, t, g, unknown or other
  misc_feature (430)..(430): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagagggatgctgtaatgactcagtctccactctccctgcccgtcacccttggacagccggcctccatctcctgcagttctagtcaaagcctcgtacatcatgatggcacacctacttgaattgttcgcagaggccaggccaatctccaaggcgcctaatttataaggtntctgacagggactccggggtccagacagattcagcggcagtggtcaggcactgatttcacactagaaatcagcgagggtggaggctaggaggtatgtttagttgggctacgttattattgntatgacaagacaacacactggtccgtactacgttttacggaccgtaacgggaccaacggcgtggagtactacgtaatcgaactggtgtaccg

SEQ ID NO: 37115 - DNA, 574 bp, Homo sapiens
  misc_feature: GYAE6OF02GUX5W.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccgaaggccgccttaaatttactaattcgttttaacccgggactcgtggggtcccagacagattcagcggcaggtggcaggcacgtgatttcactattagaaatcaccgaggggtggaggtctagaggtattggttagggtatttagtactgctagtcgacaagctactattcgtggtcctttacgtaccgtttccggacccgttagggaacctaaggtcggtaacttaaccgaaattccgaacgttcggtggtctacggaccaacctacgttccgtgttacc

SEQ ID NO: 37116 - DNA, 661 bp, Homo sapiens
  misc_feature: GYAE6OF02JKR6T.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttaggaggggatgctgtaatgactcagtctccactctccctgcccgtcacccttggacagccggcctccatcctcctgctagttctagtacaaacgcctcgtacatcatgagtcggaccacaccttacttagtaacgtttcggttcgcgacggacggccgaggacctaactcctaccgaaggccgtaccttaaagtttagtaacggtgtctacggacgcgggtaccgtccgggtaccagacagtacttacgcgacggcgtacggtggtacgaggctactcgttacgtttacaccgtacgtaagtaaaactcgaacgacggtaggggttaggacggtacggtaggaagggtagttacggttttaggttcgggttaccttagtttagtttacttaggtactagtcgaactaacgacaacctacgtacgtacgtaccgttaccttacggtttacggaaccgggtacgggtaaccacgggttacgaggtaagtactaacgaacgttacgtaacggtggtacggtcg

SEQ ID NO: 37117 - DNA, 648 bp, Homo sapiens
  misc_feature: GYAE6OF02I8FEE.13.46.E02.1.454.CMB.1.raw
  modified_base (288)..(288): a, c, t, g, unknown or other
  misc_feature (288)..(288): n is a, c, g, or t
  modified_base (355)..(355): a, c, t, g, unknown or other
  misc_feature (355)..(355): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggtttcgcagaggccaggccaatcnccaggcaccttaatttataaggtgtctagacgagggtacgtccgggtaccagacagattcgagcggngaggtggtcaggctactgtactttcactacgtagaaaactcgagtcgagggtaggaggtcgtaggaggtagttaggtttagttcgggtacttacgtttaagtttagtttcgtacgtaagttcgtaaccgaagtacccgtaaaccgtaaccgtaccggttaccgggtaacccgtttaaccgttaccggttttaccgggaaccccggtaacgggggtaaccctaagggtaccgtacgggtaacgttacggttaaccgtaaaccgttaccggtaaaccgttcgggtggtaaccccg

SEQ ID NO: 37118 - DNA, 604 bp, Homo sapiens
  misc_feature: GYAE6OF02FK5ZC.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcacccttggacagccgcctccatctcctgcagttctagtcaaacgcctcgtacatcatgagtggcacacctacttgaattggttcgcagaggccaggccaatcctaccaaggccgtaccttaagtttacgtaaggttgtactgacgaggtaccgtccggggtcccagacagtacttcgagccggcaggtcgggtacgacggctactgtactttccactacgtagaaaactcgagcgtagggtaggaggacgtggaggtattggtagttcggcttcgttatttagtcgtactagtacgacgtaagtacaaacgtacgtacgtacggtccgttaacgttaccgtttaggacccggtaagggaacccgtaacgtacgttacggaagtacgtacctaaagtaccggtaacgttggtcggtaccg

SEQ ID NO: 37119 - DNA, 751 bp, Homo sapiens
  misc_feature: GYAE6OF02IAQEA.13.46.E02.1.454.CMB.1.raw
  modified_base (233)..(233): a, c, t, g, unknown or other
  misc_feature (233)..(233): n is a, c, g, or t
  modified_base (484)..(484): a, c, t, g, unknown or other
  misc_feature (484)..(484): n is a, c, g, or t
  modified_base (745)..(745): a, c, t, g, unknown or other
  misc_feature (745)..(745): n is a, c, g, or t
tcagtcacgtactacacgaccggtgctcgatttagactcatctacagggaaaggggtgatcaggactcctcagttcaccttctcgaccaatgaggcctccctggctcagctcctggggctgctaatgctgtgggtcccaggtatttaggacggggatgcctagtaatcgacctcacgttcctccactctccctcgcccgtctacccgttggacagcccggcctccatcctccngcctacgttctagtcaaaagtcctacgtacactctatagagtcggccaactacctaacgttagtaacgtttacggtttccgacgtacggacggcctaacggtactaacgttcctaccgtaacgggtccgttaacctttaaaagttttaacggtaacggggttctacgtacggaacgggtacgggtaccggtcccggggttaccacggaactacggtaagttaccaacggtccggactacgggtcggtaccngtacctacgttggtaactttaccgaacgtaacgtaacgtaaaacttccgaagggtacggtaaggggttacggtacggtacgtagggtaacgtagtttacggtttagttcgggtaacctttctttaaagtttcgttgacctaaggtcgaagaacgtacctaaacacgacgtaacggtaccgttacttaccggttacgggaccggtaacgggaacctaagtccggttaagacggtactaccggtaactaccggtaactccggngtaccg

SEQ ID NO: 37120 - DNA, 685 bp, Homo sapiens
  misc_feature: GYAE6OF02G81XB.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatcctcctgcctagttctagtcaaacgcctcgtacatcatgatgggcactacctacttagtaatttggtttcgcagaggccaggccaatcctaccaaggcctaccttaatttagtaaggtgtcgtgacgacgggacgtcccggggtaccagacgagattcgaggcggacaggtgggtacagggctacgtgtactttacactacgtaagaaaacgtcgaacggacgagggtggaacggtcgtagggaaggtagttaggtttaaggttcgggtactttacgttaatttacgttacgacttaaggtacgtaacgtaacggtaaccctaaaccgtaaccgtaccgttaccgggtacccggtttaacgttaccggtttttaccgggaaccccgggtaacgggggtaacccgtaacgggtaccggtacgggtaagaacgttaccgtaaaccgttacggtaaaccggttgggtaccgttacccgg

SEQ ID NO: 37121 - DNA, 532 bp, Homo sapiens
  misc_feature: GYAE6OF02FKFI2.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacacgccggcctccatctcctgcagttctagtcaagcctcgtacatcatgatgggcaccacctacttgaattggttcgcagaggccagccaatctccaaggcgcctaatttactaaggtgtctagactagggaccgtccggggtccccagaacgagattcaggcgggcaggtgggtacagggcacgtgatttcacactgaaatcagcaggtggaggtctgacggattcgttagttcgggcttctatttatgctatgtacaagcaacacacgtgaccgtactacgtttacgccgtaagggaccaagcgtaggagactcgaagtcgaacgtcgtgtaccg

SEQ ID NO: 37122 - DNA, 572 bp, Homo sapiens
  misc_feature: GYAE6OF02IA2UZ.13.46.E02.1.454.CMB.1.raw
  modified_base (241)..(241): a, c, t, g, unknown or other
  misc_feature (241)..(241): n is a, c, g, or t
  modified_base (566)..(566): a, c, t, g, unknown or other
  misc_feature (566)..(566): n is a, c, g, or t
tcagtcacgtactacacgaccggtgctcgatttagactcatctacagggaaaggggtgatcaggactcctcagttcaccttctcacaatgaggctccctgctcagctcccggggctgctaatgctctgggtcccaggatttagaggggatgctgtaatgactcagtctccactctccctgcccgtcacccttggacagcccggcctccatcctcctgcagttctagtcaaagcctcgtacntcatgatggcacacctactgaattggttcgcagaggccaggccaatcctaccaaggcgtacctaatttataaggtgtactgacgagggaccgtccggggtcccagacagacttcaggcgcaggtgggtcaggcactgatttcactactagaaatcgagcgagggtggagcgtagaggtattgttagttggtacttcttagtttattgacgagttacgactaaacgcaaacaccgtacgtcggtaccgtacctacgttttacgggaccgtaggggaacccaaggtcgtaggaagtacgtacgaacgtaccgtaacgtggtacggtntaccgg

SEQ ID NO: 37123 - DNA, 726 bp, Homo sapiens
  misc_feature: GYAE6OF02IBTPX.13.46.E02.1.454.CMB.1.raw
  modified_base (171)..(171): a, c, t, g, unknown or other
  misc_feature (171)..(171): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
tcagtcacgtactacacgaccggtgctcgatttagactcatctacagggaaaggggtgatcaggactcctcagttcaccttctcacaatgaggctccctgctcagctctggggctgctaatgctcgtgggtccaggatttaggaggggatgctgtaatgactcagtctccnctcctccctgcccgtcacccttggacacgccgcctcatcctcctgactagttctagtcaacggcctcgtaacatcagtgatcgggcacacctatgtaattggttcgnagagcaggcaatcncgagcgacttaattanagtgtcngacgtagggaccgttccgggccaagacagtacttacgaggccggtacgaggtcggggtacaacgggtctaacggtgttactttaccgaacgacgtaagtaaaacgttcgtaacggacggtaaggggtcgggtaaccgggtacgtaagggtaagggttaaggttacggtttttaaacgggtcgggttacccgttaagttttaacgtttacgttacgtcgtaaagttcgtaacgaaacgtaaaccgtaacgtaaccgacggttaccggtaccgtttaacccttaaccgggtttttaccgggaaccgggtaaacccggggtaaccggtaaaccggttaccgggtaagggaaccggttaacgttacggtaaaaccggttaccgggtaacgtttacgggtacccgggttaacccgg

SEQ ID NO: 37124 - DNA, 536 bp, Homo sapiens
  misc_feature: GYAE6OF02FZRB3.13.46.E02.1.454.CMB.1.raw
  modified_base (426)..(426): a, c, t, g, unknown or other
  misc_feature (426)..(426): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtcaaagcctcgtacatcatgatggcacacctacttgaatttggttcgcagaggccaggccaatctaccgaaggcgaccttaatttataaggtgtctgacagggacctccgggtccagacagatcgagcggcaggtggtcaggcactgtactttcacatagaaatcagcgagggtggaggctggagtatgttagttgggctnttattagtgatagtgacaagacaacacagtcgaccgttactacgtttcggaccggaacgggtaccaaggtcgtaggagtactaccgtaagtacgtaacgtcggtgtaccg

SEQ ID NO: 37125 - DNA, 506 bp, Homo sapiens
  misc_feature: GYAE6OF02FKSOF.13.46.E02.1.454.CMB.1.raw
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
  modified_base (444)..(444): a, c, t, g, unknown or other
  misc_feature (444)..(444): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacactacttgaattggtttcggcagaggccaggcccaatctccaaggcgcctaattataaggtgtctgacagggactccggggtccagacagattcagcggcagtgggtcaggcactgactttcacactgaaaatcagcagggnggaggctgaggtagtgttattgggctntattagttgcatgacaagcaacncactgccgtactctttggccgtacggggaccaaggcttggagactcaactcgactgtagtcg

SEQ ID NO: 37126 - DNA, 466 bp, Homo sapiens
  misc_feature: GYAE6OF02FYPEE.13.46.E02.1.454.CMB.1.raw
  modified_base (442)..(466): a, c, t, g, unknown or other
  misc_feature (442)..(466): n is a, c, g, or t
tcagtcacgtactacacgaccggtgctcgatttagactcatctacagggaaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtctgggccaagggaccacggtcaccgtctcctcagcctccaccaagggccccatccggtccttcccccgtggccacccctcctccaacgacgccaccttcgtcgggggcaccgaggccggccctcgggctcgcctggtcaaggacctacttcctagtacgtgacctgacggcgggctggcgaaggcgcactgnnnnnnnnnnnnnnnnnnnnnnnnn

SEQ ID NO: 37127 - DNA, 878 bp, Homo sapiens
  misc_feature: GYAE6OF02ICH5W.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctcgtgggtcccaggatttaggaggggatgctgtaatgactcagtctccactctccctgcccgtcacccttggacacgcccggcctccattcctcctgacctagttcctagtaccaaacgccctcgtaacactacatggagtcggactacctaaccttacttaggtaagttcgggtttcggcgtaacggcggtaccgaacggtaccaacttcccgtaccgaagggtccgaaccctttaagttttaagtaacgggttcgttacgtaggtaacggtaaccgggtaccggtacccggggtaccccgaaggaaccgtaggaactttacgaagggtccggacgtaacggttacgggtaccgaacgggtacgtaaccgttacggtaactttttaccgaacctaacgttaaacgtaaaaacgttcccgaaacgggtaccggtaaaggggttacgggtaacgggtaaccggttaggggtaaacgggttaagttttacgggtttacgggtttaacgggggtccttttaacgtttaacgttttaacggttacgttacggtaacgttacgggtaacgtaaaccggtaccgaaaaccttaaaccggtaccggtaacccgggttaccgttaacccgttttacgggtttttaccccggggacggtaaacccggggtaccccgttaaacgggtaaccggtttacggggaaccttaacccggtaacggttaaccggttaaccggaacgggttttccggacggttaacccgg

SEQ ID NO: 37128 - DNA, 831 bp, Homo sapiens
  misc_feature: GYAE6OF02GT96L.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggtatttaggaggggatgctgtaatgactcagtctccactcctccctcgcccgtcacccgttggacacgcccggcctccacttctcctgctagtttctagtacgaaacgccttcgtacatcagtgagtcggccaacctaccttacgttagttaacgttttcgggtttcggacgtaacgggacgggtacccgaacgggtaccctaaagttcccctaacccggaaacgggtacccgttaaccctttaaaaggttttaacggtaaacgggttcgttacgtacggaacgggtaccgggggttaaccccggttcccgggggtaacccaagggaacgtaaggtacgtttccgggaacggaccgggtacgtacggggtacgggtaccgaacgggtcctaacggttgtaacttttaccgaaacgtaacgtaagtaaaacttcggaacggtacgggtaaggggttacggaagggttccgtagggtaacgttaacggtttaggttacggtttcgggtacctttagtttaacgtttacgacgtacgtagtacgtaaccgtaagtaaccctaaagtcccggtacggttaaccgggtacccgtttaaccgtttacggggtttaccggaaacccgggttaacgggaaaccgtacggtaccggttaaggaccgtaactaacggtaacgtcggtaacggttgtacggtcg

SEQ ID NO: 37129 - DNA, 430 bp, Homo sapiens
  misc_feature: GYAE6OF02GNZE0.13.46.E02.1.454.CMB.1.raw
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (370)..(370): a, c, t, g, unknown or other
  misc_feature (370)..(370): n is a, c, g, or t
  modified_base (404)..(430): a, c, t, g, unknown or other
  misc_feature (404)..(430): n is a, c, g, or t
tcagtcacgtactacacgaccggtgctcgatttagactcatctacagggaaaggggctggtgtgggtctcacggattgacaatgatgggagagacacaatccacgcggattctgtgaggggccgattcaccacatcgagagacaacgccaagaacacggtatatctgcaaaatgaacagtctgagaggcgaagacacggcggtttacttctgtgcaagaggtggctggtcgcatggttttgatctcgtgggggccaggggacaagtggtaaccgtctcttcagcctccacaaggccatcggtctcccctgcgccctgctcagncactcagncncngcgcctggctgccgtgcaagctactctagtacgtnactgacgcgggctcggcaaggcgacgatagcagnnnnnnnnnnnnnnnnnnnnnnnnnnn

SEQ ID NO: 37130 - DNA, 595 bp, Homo sapiens
  misc_feature: GYAE6OF02G3FT9.13.46.E02.1.454.CMB.1.raw
  modified_base (283)..(283): a, c, t, g, unknown or other
  misc_feature (283)..(283): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatggcacacctacttgaattggttcgcagagcagcaanctcagcgcctaattataaggtgtctgacgagggactccgggtccagacagacttcaggcgcgaggtgggtcaggacactgtactttcactactagaaaatcgaagcgaaggggtggagggctaggaaggattacggtttagttacgggacttacgttaatttacgttgactagtacgacaaagaccaaacgaacgtacgtacggtaccgtaaccgttaccgttttacgggaccggtaacggggaacccgtaaggtccggtacggtaacgtaacgttaccgtaaacgtacggaacgttcgggtacggttaccg

SEQ ID NO: 37131 - DNA, 619 bp, Homo sapiens
  misc_feature: GYAE6OF02FJ8OG.13.46.E02.1.454.CMB.1.raw
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagagggatgctgtaatgactcatctccactctccctgccctcaccgttgacncgccgtctccatctccagcngttctacgtcaacnccttctaacnctacagtagagtcgaccaccgtacctagttagtacgtttcggtacgacgtacggaccgccgtacgacctaactccgtacgtaacgtcctacttaatagtacgtctacgcgaacgtacggtacccgtccggacaacgtacgtacgtcgtacgacggcgtagtacgtcgtcgacgtacgtacgtacgtacgtacgtacgtacgtacgtacgtacgacgtacgtacgtacgtacgtagtacgtagtagtagtacgtcgtacgtacgtctctacgtacgtacgacgtacgactactactacgtacgtacgtacgtacgtacgtacgtacggtacgacgtacgtacgtacgtacgtacgtacgtaccgtacgtacgtacgtacgtacg

SEQ ID NO: 37132 - DNA, 501 bp, Homo sapiens
  misc_feature: GYAE6OF02FO1M0.13.46.E02.1.454.CMB.1.raw
  modified_base (224)..(224): a, c, t, g, unknown or other
  misc_feature (224)..(224): n is a, c, g, or t
  modified_base (473)..(473): a, c, t, g, unknown or other
  misc_feature (473)..(473): n is a, c, g, or t
  modified_base (477)..(501): a, c, t, g, unknown or other
  misc_feature (477)..(501): n is a, c, g, or t
tcagtcacgtactacacgaccggtgctcgatttagactcatctacagggaaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttatactgtgcgtagggtttangtgttggaacgtggtacaccggaaaactggttccgaccccgtggggccaggggaacccctggtcgtcgtctcgtctcgcctccaccgaagggcccagtccggttccttccccctgggcccgccccgtgcctccacggacgccacccgtccgagacgccacacggccggcccgtcggggctcggccgtgggtcaaacgggcctacttccgtagtacgtgaccgtgacggcgggctgggcgaaggcgacanagcnnnnnnnnnnnnnnnnnnnnnnnnn

SEQ ID NO: 37133 - DNA, 719 bp, Homo sapiens
  misc_feature: GYAE6OF02IDHN8.13.46.E02.1.454.CMB.1.raw
  modified_base (678)..(678): a, c, t, g, unknown or other
  misc_feature (678)..(678): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgctcgtgggtccaggtatttaggaggggatgctagtaatgactcagtctccactctccctgcccgtacaccgttggacacgccggcctcactctcctgactagttcacgtacaaacgtcctacgtacactcagttaggacgtcggaccaactaccttaacgttaggtaagtttcgggttaccggaacgaaaaccggccgaacggaccctaaactccgttaccggaacggtccgttaaccttaaaagttttaacgtaaggttcgtacgttacgaaccggtacgggtaccgtccccggggtaccaagactagtacttacgacggacggactaggttcgggacacggctaacttggtaactttcgaactagtaacgaaactcgaagtcggaggggttcgaggtgaggagtagttgtaacgtggtcttacgtagttaagtcgagtacgttacgaacgtaaacgtaacctaaacgccgttaaccggtagggtacccttaacggtttaaccgttcgggaaccggtaacgggggaacctaacggtacgttaagggaacgtanaccggtaactacccggtaagtcggtaccggtagtaacccgg

SEQ ID NO: 37134 - DNA, 528 bp, Homo sapiens
  misc_feature: GYAE6OF02H4FO3.13.46.E02.1.454.CMB.1.raw
  modified_base (328)..(328): a, c, t, g, unknown or other
  misc_feature (328)..(328): n is a, c, g, or t
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (503)..(504): a, c, t, g, unknown or other
  misc_feature (503)..(504): n is a, c, g, or t
  modified_base (506)..(508): a, c, t, g, unknown or other
  misc_feature (506)..(508): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (514)..(528): a, c, t, g, unknown or other
  misc_feature (514)..(528): n is a, c, g, or t
tcagtcacgtactacacgaccggtgctcgatttagactcatctacagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcagtcggcgggctactttgatatcgtgggccaagggtcagtggtcagtcgtcttctcagccctccaccgaaggcccatccggttccttcccccgtggccncccgtgcctccgaggacgcctaccgtccgagacgacacgacggccggcccgtgggctcggccgttggtacaaggtcttaccgtccgttaacgttacgtacgacgttcggacgggtcgggctacgggacgaacgggcacgtaacgttgacgtncgtcngcngntcngactcgangnngnnnancngnnnnnnnnnnnnnnn

SEQ ID NO: 37135 - DNA, 771 bp, Homo sapiens
  misc_feature: GYAE6OF02J1XEM.13.46.E02.1.454.CMB.1.raw
  modified_base (264)..(264): a, c, t, g, unknown or other
  misc_feature (264)..(264): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcacccttggacacgccggcctccatctcctgctagttctagtcaaacgcctcgtacactcattgatcggcacacctactnagtttcgttcggctagaggccaggtaccaatctaccgaacggcgtaccttaattttagtaaggtcgtctagacgtacgggtacgttcccggggtacccaagaccgaaggtactttcgacgtaccgggacaagggttggggtactacgggacgtaccgttacgtagtttttaccgacgtaacgttaacgaaaacgttacgaacggtaccggtagggggtaacgggtaaacggggtccgttagggtaacggttacggtttaagggtttaagtttaacggggggttcccttaacgggtttaagtttaaacgtttggttaccggtaaagttcgggtaaccaaaggtacccgtaaacaaccgtaaccgtaccgggttaccgttaacccgtaccgtttttaccgggaacccggtaacccgggggtaaaccgttaaccgggtacggtaaccggttaaggtaacgttaaccgttaaaggtacccggtttaaaccggttacggttcggtaacccgg

SEQ ID NO: 37136 - DNA, 723 bp, Homo sapiens
  misc_feature: GYAE6OF02IGZ3V.13.46.E02.1.454.CMB.1.raw
  modified_base (592)..(592): a, c, t, g, unknown or other
  misc_feature (592)..(592): n is a, c, g, or t
tcagtcacgtactacacgaccggtgctcgatttagactcatctacagggaaaggggtgatcaggactcctcagttcaccttctcacaatgaggctccctgctcagctccgtgggctgctaatgctcgtcgggtcccaggtatttaggaggggatgctagtaatgactcagtctccactcctccctcgcccgtcctacccgtggaccacgcccggcctccactcctcctgctagttcctagtacaaacgcctacgtacatcagtcgagcggacctacaccttaattaggtaagtttcgggttacggacctaggacggaccaggacctaacgttcaccgaaaccggtcctaaccttaaattttacgtaaaggtcgttaccgtacggacgaaccggggtacccgttcccggggacccaaggtaccaggtactacgacggcgacgtaggtacggccagggcctagttacgtactttcaaaccgtacgtaagtaaactacgtacggacggtgggtaggtacgggagtaggaggttagttacgtttagttcgggtaccttagttaacgttagttaccggatagttaccgaaccgaaanaccgtaaactaccggtaacgtacccgtaccgtttaaccgttacccggtttagggaccccggtaaaggggaccctaaacggtcgttaacggacgaacgtactaaaccgtaccggtacgtagggtagtacccg

SEQ ID NO: 37137 - DNA, 499 bp, Homo sapiens
  misc_feature: GYAE6OF02H2O0F.13.46.E02.1.454.CMB.1.raw
  modified_base (134)..(134): a, c, t, g, unknown or other
  misc_feature (134)..(134): n is a, c, g, or t
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (418)..(418): a, c, t, g, unknown or other
  misc_feature (418)..(418): n is a, c, g, or t
  modified_base (468)..(499): a, c, t, g, unknown or other
  misc_feature (468)..(499): n is a, c, g, or t
tcagtcacgtactacacgaccggtgctcgatttagactcatctacagggaaaggggctgcagtgggtctctggtataaactggaatggtgccagcacaacttatgcagactctgtgaagggccattcaccatcnccagagacagtgccgagaactccgtacatctgacaaatgaacagtcctaggagtcgaggacaacgggcttgtatttcngtgcgtaggttagcaggtggctggtacttacgcaaagnggtacgtcgtggggaccaagggtacacggtcactcgtcctcacgctccaacgaacggcccatccggtcctaccccgtggccaccctcctacctaacgacgcctaccgtcgcggggcacacgcggcccgtggctgccgtggtacgacgtactacgttctaacgtacgtnaacggtgacggttcgggcgttcgggcgtaaacggcgtacgacgtaagcgnnnnnnnnnnnnnnnnnnnnnnnnnnnnnnnn

SEQ ID NO: 37138 - DNA, 864 bp, Homo sapiens
  misc_feature: GYAE6OF02HFPFS.13.46.E02.1.454.CMB.1.raw
tcagtcacgtactacacgaccggtgctcgatttagactcatctacagggaaaggggtgatcaggactcctcagttcaccttctcacaatgagctccctgctcagctcctggggctgctaatgctctgggtcccaggatttagagggatgctgtaatgactcagtctccactcctccctcgccccgtctacccgttggaccacggcccggcctccactcctcctgctagttctagtcaaacgtcctacgtacatcatgagtcggaccaacctaccgttacttagtaagttttcgggtttaccggacgtaacgggacggacccgtaacgggaccctaaaccgttaccgtaccccggaaaacgggtcccgttaaccctttaaaggttttaacggttaacgggttacggttaccgtaacgggaacgtaaccgggggtaccccggttccccgggggttaacccaaggtaccgtaacgttaacggttaccgacggtacccggggacgtacggggttacgggtaccgacggggtacctaacgttcggtaacgtttttaccaaccgtaaccgtaaacggtaaaacgttacggaacggtacgggtaacgggggtacgggtaacgggtacggtaagggtaacgggttagtttacgggtttaacgggttcgggttaccgtttacgtttaagtttacgttacggtacgtaacgtacgtaacgtaaacgtaccgtaaaccgtaccgtaccgttaccgggtaccgtttaccgttaccgttttaccggaccgggtaaccgggtaaccggtaacggtaccggtacgggtaacgtaacgtacggttaaacgtaccggtaacggttacggtacggtacccgg

SEQ ID NO: 37139 - DNA, 436 bp, Homo sapiens
  misc_feature: GYAE6OF02GWN0U.13.46.E02.1.454.CMB.1.raw
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (433)..(436): a, c, t, g, unknown or other
  misc_feature (433)..(436): n is a, c, g, or t
tcagtcacgtactacacgaccggtgctcgatttagactcatctacagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcggcggggctacttttgatatcgtgggggccaaaggggtcgagtggtcatcgtctcttcagcctccaccaagggcccagtcggtccttcccccgnggcgcccctgcctccaggnccacctccgagncacagcggccctgggctcgccgtggtcaacggcttacttcctaagtcgtgactgnggcggctggcaggcnganagnnnn

SEQ ID NO: 37140 - DNA, 544 bp, Homo sapiens
  misc_feature: GYAE6OF02FWVZA.13.46.E02.1.454.CMB.1.raw
  modified_base (518)..(544): a, c, t, g, unknown or other
  misc_feature (518)..(544): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgaccccgtcggggccccgggaaccctggtcaccggtctcctcacgccctccaccaacggcccacgtccggtccttcccccgtggcctacccctccctccaacgacgcctaccctcgtgggggtccaacgacggacccggcccgtggggtccgtcggtcccgttcgggtaccgaaaggacccttaacctttccgtaacggttaccgtacgtacgttacggacgggtccggggctcgggacgaacgggccgcagtagcgnnnnnnnnnnnnnnnnnnnnnnnnnnn

SEQ ID NO: 37141 - DNA, 695 bp, Homo sapiens
  misc_feature: GYAE6OF02HO490.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtacaaacgcctacgtacatcatgagtcggcactacctacttgtaagtttggttcggcaggacggccgacggcctaactcctaccgaagggtccgtacctttaaagtttaacgttaacggtgttcgtagacgacgggtaccgtaccggggtccacgacgagtacttcgacggcggacgtaggtacgggtacgaggaccgtacgtacgtaactttcgaactaacgtaacgtaaaactcgaagtacggtaggggtaggacggtcgtaggaggtagttacggtttagttcgggttaccttagtttaacgtttagttacgtacgtagtcgtaacgaagtaccgaactaccgtaacgtcgggttaaccgttacgttacggttttaccggaaccggtaaccggggtaacctaacggtacggtaacggaacggttacgttaaccgtaacgttaccgggtaacgttcgggtagtacccg

SEQ ID NO: 37142 - DNA, 472 bp, Homo sapiens
  misc_feature: GYAE6OF02F547H.13.46.E02.1.454.CMB.1.raw
  modified_base (257)..(257): a, c, t, g, unknown or other
  misc_feature (257)..(257): n is a, c, g, or t
  modified_base (339)..(339): a, c, t, g, unknown or other
  misc_feature (339)..(339): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (448)..(472): a, c, t, g, unknown or other
  misc_feature (448)..(472): n is a, c, g, or t
tcagtcacgtactacacgaccggtgctcgatttagactcatctacaggggaaagggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgacccaagacttttggagtggngcgctcgaccccgtggggccccgggaaccctggtaccaccgtctcctcagcctccaccaacggccatccgtctcccctgccnccctcctccaagcgccacctcgtgggggcacagccggcccgtgggctcgcctggtcaaggactacttccgtatacgtgactggngcgggtcnggcaacggcacgatagnnnnnnnnnnnnnnnnnnnnnnnnn

SEQ ID NO: 37143 - DNA, 570 bp, Homo sapiens
  misc_feature: GYAE6OF02HGGKB.13.46.E02.1.454.CMB.1.raw
  modified_base (538)..(538): a, c, t, g, unknown or other
  misc_feature (538)..(538): n is a, c, g, or t
  modified_base (544)..(548): a, c, t, g, unknown or other
  misc_feature (544)..(548): n is a, c, g, or t
  modified_base (550)..(570): a, c, t, g, unknown or other
  misc_feature (550)..(570): n is a, c, g, or t
tcagtcacgtactacacgaccggtgctcgatttagactcatctacagggaaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgactagttttccagacggcgtactacgttgtcggcgtggggcgtactttgactagtttgggggccaagggacacgtcggtcaccgtctcccaacgccttccaccgaacgggccccacgttccggtcccttcccccgtcggcccgcccctcgcctccgaggcgccaccgtccgtgggggaccacgacgccgggcccgtcgggcctcgtcccgtggtaccgaaacggtacctttaccttaccgttaaggttaccggttagtaccgttgggacgggtcccggggtcggtacgggtacgaacggggtccgacgacgtacgnacgtgnnnnngnnnnnnnnnnnnnnnnnnnnn

SEQ ID NO: 37144 - DNA, 495 bp, Homo sapiens
  misc_feature: GYAE6OF02FF6D0.13.46.E02.1.454.CMB.1.raw
  modified_base (331)..(331): a, c, t, g, unknown or other
  misc_feature (331)..(331): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (459)..(462): a, c, t, g, unknown or other
  misc_feature (459)..(462): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (469)..(471): a, c, t, g, unknown or other
  misc_feature (469)..(471): n is a, c, g, or t
  modified_base (473)..(476): a, c, t, g, unknown or other
  misc_feature (473)..(476): n is a, c, g, or t
  modified_base (478)..(479): a, c, t, g, unknown or other
  misc_feature (478)..(479): n is a, c, g, or t
  modified_base (482)..(482): a, c, t, g, unknown or other
  misc_feature (482)..(482): n is a, c, g, or t
  modified_base (484)..(486): a, c, t, g, unknown or other
  misc_feature (484)..(486): n is a, c, g, or t
  modified_base (488)..(489): a, c, t, g, unknown or other
  misc_feature (488)..(489): n is a, c, g, or t
  modified_base (492)..(494): a, c, t, g, unknown or other
  misc_feature (492)..(494): n is a, c, g, or t
tcagtcacgtactacacgaccggtgctcgatttagactcatctacagggaaagggggctggagtggattggggaaatctatcatagtgggaccacctactacagcccgtccctcaatagtcgcgtcaccatgtcagtggacgagcccaagaccagttctccctgagcctgacctctgtgaccgccgaacggactcggccctatacttctgtgcgagagatcgagatgtgtcatcgcggggctacttttgatatctggggccaagggtcgatggtcatcgtctcttcagcctccacagggcccatcgtcttcccctgcgcctgctccaggancaccgtccgagagcacagtccggcccgtagggctcgcgtggacacgggactacgttcctagtaccgtgactggaacggccgggtcgtggcgtaacgggccgtacgagttacggntcgagngctcncannnngancngnnntnnnngnncgnannnanngcnnnc

SEQ ID NO: 37145 - DNA, 729 bp, Homo sapiens
  misc_feature: GYAE6OF02H0Y8W.13.46.E02.1.454.CMB.1.raw
  modified_base (542)..(542): a, c, t, g, unknown or other
  misc_feature (542)..(542): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgctcgtcgggtcccagggtgccagatgtgccatccagatcgacccagtcctccactccctccctgtctgcatcgtggtaggagacagtagtccaccatcacgttcggcccgggacaaggtcgacgggactaagttaagaaattgtagtttaggcgtaggttactacgaagaccaaacggaaaaccggaacggggaaaccgtacccccgtaaagtccttacgttaggtaacttccgtaagttcggtcgactacgttaaccgtaaaggtttaaacgggtcgggtaccctaagtacgtaacggtcgacggccggtagtaggtacggtacgtcgtacggacctacgtaacgtaccttactctttacctaccaaccataccgagaccgtacgaccgtacgccaacggtcctaggttaacgtttntttaccgaactttaaacgtttactaccgttacgttaacctaacgtaacgtacttacgtaacttaacgtttaccgtccgggttacgggtaccgttaccggaccggtaacgggtaccgtaaacgggtaacgaactaaccggtaaaccggtacggttacggcggtacaccgtacctaccgttagttaccg

SEQ ID NO: 37146 - DNA, 708 bp, Homo sapiens
  misc_feature: GYAE6OF02HQJAB.13.46.E02.1.454.CMB.1.raw
  modified_base (564)..(564): a, c, t, g, unknown or other
  misc_feature (564)..(564): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccattctcctgctagttctagtcaaacgtccctcgtaactatcatgatgggcactacctagttagtaactttggttcgcgtaggacggccgacggacctaatcctaccggaacggtccgtaaccttaagtttacgtaacgggttgttacctaggtaacgacggggtaccgttcccgggggtaccctaaggaacctacggtactttaccggacggcggtacggtagggtacgggtacgacgggactacgtcggttactttacgacctaacgtaacggtaaaactccgtaacggtaaggggtggaacggtacgtggaacggtacgttagggttaggtttatttagttaccgtgtacttagnggtactaagtactaacgttacgttccgtacgttccgtttactaaccgtttcccgggaccgttacgggtaactaagggtacgtaactaaccgtaaactcggtaaacgttggtaccggtactaccggtaacctaccgtacttaccg

SEQ ID NO: 37147 - DNA, 553 bp, Homo sapiens
  misc_feature: GYAE6OF02IWK02.13.46.E02.1.454.CMB.1.raw
  modified_base (522)..(522): a, c, t, g, unknown or other
  misc_feature (522)..(522): n is a, c, g, or t
  modified_base (526)..(538): a, c, t, g, unknown or other
  misc_feature (526)..(538): n is a, c, g, or t
  modified_base (540)..(553): a, c, t, g, unknown or other
  misc_feature (540)..(553): n is a, c, g, or t
tcagtcacgtactacacgaccggtgctcgatttagactcatctacagggaaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctaacattattattgtgcgagaattgactagtttccagacggcgactacgttgtcggcgtggggcgtacgtttgactagtttgggggcccgaagggacctacgtggttccacccggtcctcccgaagtccttcccgacccgaaacgggccccacttccggtccctttcccccgtggccgcccctgcctccgacggacgcctacccgtcggtacggggctaacgacggcccggcccgtggggcctcgcccgtggtacccgaaggtcctacgttccgtagtacgtcgacgtcggacggcggtcgtcggacgacggcgacacgtagnacgnnnnnnnnnnnnngnnnnnnnnnnnnnn

SEQ ID NO: 37148 - DNA, 628 bp, Homo sapiens
  misc_feature: GYAE6OF02GH2QW.13.46.E02.1.454.CMB.1.raw
  modified_base (280)..(280): a, c, t, g, unknown or other
  misc_feature (280)..(280): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctccctgcccgtcacccttggacagccggcctccatcctcctgctagttctagtacaaacgtcctcgtacatcatgagtcggcactacctacttgaagtttggttcgnagaggccaggaccaatccgtacgaaggccgtaccttaatttacgtaaggtgtactagacgacgggtaccgtcccgggacctagaacgagtacttcgacggacggcgtaggtgggtaccgtagggcctacgtagtacgtttacaactaacgtaagaaaatccgaaggtacgagggtaggacgggagtacggaaggttagttaggttaggttggtacttacgttatttagttgtactagttcgacgaagtaccaaacgactacgtacggaccgttactacgtttaccgggacgtaacggggaaccaacggtctagggatacgaacgtaagtacgtacgtacggtggtacg

SEQ ID NO: 37149 - DNA, 712 bp, Homo sapiens
  misc_feature: GYAE6OF02HGK8H.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacacgccggcctccatctcctgctagttctagtacaaacgcctcgtacatcatgagtcggacacaccttattagtaagtttcggttacggctaggacggaccaggacctaatcctaccgaaggccgtaccttaaagttttaagtaaggttcgttacgtacgaaccggtacgggtacccggtcccggggtaccaaggaccgagtacgttacgacggccggtacgtacggtgggtacgacggctacgtacggtactttaccgaactaacgtagaaaacgtcgaacggcgggtacggggtaggacggtcgtaagggtaacggtagtttagggtttaggttacgggtccttaacgtttaagttcgttagacgttagtcgtaacgaaaggtacccaagtaccgtacggttaccggtaccgtttaacgttcggtttaccggaccgggtaacggtaacccgtaaggtacggtacgggaacgtaacgttaaccgtaacgttaccggtaacgttcggtaccgtacgg

SEQ ID NO: 37150 - DNA, 857 bp, Homo sapiens
  misc_feature: GYAE6OF02ISLOY.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatgctctgggtcccagatttagaggggatgctgtaatgactcagtcctccatcctccctcgcccgtccaccgtgaccacgccggccctcctacttcctcctcgccgtacgttccgtacgtacaaaacgtccctaccgttacacttacctagttcggacgttcgggaacctacccgtaacccgttacgtttaacggtaagttttccgggtttaccggacgtacggtaccggcccgaggtaacccgtaacttaccgtaccgaacggtccgtaaccgtttaatttaacggtaaagggtcgttaccggtacgaacggtaacggtcccgggtacccgggtcccggaacggaaccgtacgttacgttaccgtacgggaccggtacgtacggggttacgggtacgaacggtacctacgttagtacgttttacacgtaaacgtacgtaaaacgtcgtacggtaacgggttacggggtaaacgggtacgtacgggtaagggtacggttaggtttaaccgggtttaggttaccgggtaccgttacgtttagttacggttagtaccgttaaccggtagtaaaccgtaacgaaccgtaaaccgtaaccgtaccggttaaccggtaacccgtttaccgggttacgtttaccggtacccggggtaaacgggtaaccgttaccgggaacggttacggttacgtaacgttaccggtaaacgttaccgggtacgtaccgggttaagtcccggg

SEQ ID NO: 37151 - DNA, 646 bp, Homo sapiens
  misc_feature: GYAE6OF02JGUL0.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacacggccggcctccatcctcctgcagttctagtcaaacgcctcgtacatcatgatggcacactacttgaattggttcggcagacggccgaggaccaatcctaccgaacggaccgtaccttaaatttataagggttctcgtagacgagggtaccgtcccgggggtacccaggacagtacgttcgacgtacggctaggtcgggtacgtaggacctacgtggtacttttaccactacgtaagtaaaactcgtacggacggtaagggtgggaacggcggtagagggtattcgggtttaagttcggggtacttacgtttaagtagtttacgtacgtacgtagtaacaacggtacctaacgacctacgtacggtccgtaacgttacggtttcggacggtaacgggaaccaggtacgtacggaatacgtacgtaacgttacgaacgttggtacgtacg

SEQ ID NO: 37152 - DNA, 729 bp, Homo sapiens
  misc_feature: GYAE6OF02GL2CC.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagaggggatgctgtaatgactcagtctccactctcctgcccgtcacccgttgacagccgcctccatctctgctagttctatacaaacgcctcgtacatcatgatggcactactacttgtaatttggttcgactaggacggccgaggacctaatccgtaccgaaggtccgtacctttaagtttaacgtaaggttcgtactaggacggtaacggggtaccgtcccggggtaccaagaccgagtacgttcgaggtccggactagggtcggggtacacgggctacgttgtaacttttccgaactacgtaacgaaatccgaggtacggaggggtaggaacggtcgaaggtaggtacgtttaggtttacggttggttaccgttaagttacgttttagttacgtcgttagtaccgaaccgtaaacgtaccgtaaacccgtacgtaacccggttaccggtaacccgtttaaccgttaccggtttttcccgggaaccgggttaaccgggggtaacccgttaaacggtacggttaaccgggtaagtaccggttaactaaaccgggttacccgttaaccggttacgggttacccgtacgg

SEQ ID NO: 37153 - DNA, 1037 bp, Homo sapiens
  misc_feature: GYAE6OF02H8LCL.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctcgtgggtcccaggtatttaggaggggatgctgtaatgactcagtctccactcctccctgcccgtcacccttggacacgcccggcctaccatcctcctgactagttctagtacaaacgcctacgtacatacatgacgtcggaccactaccttacgttagtaagtttcgggttcgacgacggacggaccgtaacggacctaaacttcccgtaaccgtaacgggtacccgtaacgttttaaattttacggtaaagggttcgttacgtaaccggaacggaaccggggttacccggttcccgggggtaacccaaggaaccgtaggttaaccggttaccggaagggtcccggtacggtaacgggggttacgggtaccggtaacggtaacccgtaacggtttaccggttaacgtttaccccgtaaaccgtaaaccggttaaacgttaaaaacccggttaccggtaaacggggtaacccggggttaaaggggggtttaccggggaaacgggttaacgggtaacggggttaaaaggggttaccggtttaacggggtttttaacggggtttacggggtttaacccgttttaaacgggttttaaacgttttaaccgggttttaaccgggttaaaccggtttaacggttaaaccgggtaaaacccgtttaaaaccgggtaaaccccttaaaaaccgggttaacccccgttaaacggggtttaaccccgggtttaaacccccgggtttaacccggttttttaaacccccgggtttttaacccgggggaccccgggttaaacccgggggttaaaccccggttaacggggttaacccggttaaacgggtaacgttaaccggttaaccggttaaacccggtttaaccggggtaaaccggttttaccggggtcccggtttaaaccccgg

SEQ ID NO: 37154 - DNA, 687 bp, Homo sapiens
  misc_feature: GYAE6OF02H6SS2.13.46.E02.1.454.CMB.1.raw
  modified_base (285)..(285): a, c, t, g, unknown or other
  misc_feature (285)..(285): n is a, c, g, or t
  modified_base (384)..(384): a, c, t, g, unknown or other
  misc_feature (384)..(384): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacacgccggcctccatctcctagcagtttctagtacaaagcctcgtacatcatgagtggcacaccttacttagtaattggttcggctaggngccgacggaccaactctaccgaaggccgaccttaatttataagtttcggttttacccggacttcggtcgggtaccagacagtacgttacaggtcgacgnggtcggcgaggctactagtctttacactagttaagaaactcgtagacggtagggtagggaggtcgtaggaggtacgttaggtttaacgttcgggttaccttacgtttaagtttcgttacggtactagttaccgtaacggtaagacctaacgacccgttaacgttccgggtaacccgtttaaccgttaccggtttttaccgggacccggtaccggggtaacccgtaacgggtacggttaacggggtacgttaactacgttaacggtacggtaaccgttgggttacggtaccgtaccgtaacccg

SEQ ID NO: 37155 - DNA, 865 bp, Homo sapiens
  misc_feature: GYAE6OF02GJT1L.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctgggctgctaatgctctgggtcccaggatttagagggatgctgtaatgactcagtctccactcctccctgcccgtcacccttggacagcccggcctccatctcctgcagttctagtacaaacgcctacgtacatacatagagtcgggaccaacctaaccttacgtttagtaaacgttttcgggtttacggacgacggacggtaccgacgggacccaaacgttacccgtaaccgaacgggacccgtaaccctttaaaagttttaactttaaacggttttaccgggtttttttaaacccccggggtaaccgtttaccccgggtttaccgggggttacccccgtaacggtaaccgtaacggttaaccgtttaccgtacgggtaccgggtaccgtaacggggtttcggggtaccgacggggtacctaacgttcgttaacttttaccgaaccttaagtttaaacgtaaaactacccggtaaacccggtagggggttacgggacggttcgtagggtaaggttaaggtttgggttacgggttttaattttaacggtttacgttacggaccgttagtacggtaacgaacgttaccgttaaccgttacgtttcccgttacggtttccccttttacgttaacccggtttcccggtaacccgggttaacggtaaacccggtaacggttaaccgtaacgttaaaccgtaacggttaacgtaacgttcggtacggtactcggaccttaaccgtacttccgtagtttacc

SEQ ID NO: 37156 - DNA, 506 bp, Homo sapiens
  misc_feature: GYAE6OF02F47W9.13.46.E02.1.454.CMB.1.raw
  modified_base (484)..(506): a, c, t, g, unknown or other
  misc_feature (484)..(506): n is a, c, g, or t
tcagtcacgtactacacgaccggtgctcgatttagactcatctacagggaaagggggctggagtgggtaggtttcattaggagcaattctcatgatgggacaacagaatacgccgcgtctgtaaaaggcagattcaaccatctcaagagatgagtccagaagcatcgccttttctgcagatgagtagcctgaacgaccgaggacacagccatctattactgtgctagagagtattgcagtcctacgacctgctagtggggccttggtggccacgtggggccagggccacccgtggtccaccgtctccgcagccctccaccaacgggcccactcggtccttcccccgtggccaccctcctaccaagacgccaccctcgtcgggggcacgacggccggcccgtgggcctggacgtcggtaccaacggaccttaccttccgtaagttacgtacgactgaggcggcgtggaccgaggccgacatgagnnnnnnnnnnnnnnnnnnnnnnn

SEQ ID NO: 37157 - DNA, 722 bp, Homo sapiens
  misc_feature: GYAE6OF02GGNL5.13.46.E02.1.454.CMB.1.raw
  modified_base (125)..(125): a, c, t, g, unknown or other
  misc_feature (125)..(125): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctntgggtcccaggatttagaggggatgctgtaatgactcagtctccactctccctcgcccgtcacccttggacacgccggccctccactctcctgctagttctagtacaaacgccctacgtacatacagtgtagtcgggacaaccgtaccttagttagtaacgttttcgggtttccggacgaagggacggtacccggaacggtaccctaacgttacctaaccggaaccgggtccgtaacctttaaagtttaacgttaaagggttcttacgtacgacggtaacgggtaccggtcccgggtaccagacgagtactacgaggcgacgaggtcggtcgaggtacagtacgtacttcgactacgtaagaactacgaggtacggtagggtgggacggtcgtagggagttagtttacggttagttcgggtaccttagttacgtttagtacgtactaacggtcgaacgaaacgtacccgtaaacgaccgtacggttcgaacccggtttacgtacggtttaccggaccggtaaccggggaacctagggaccggttaagaacgtacgttaccgtaaacggttaccggttaacgttccgggacttaccgg

SEQ ID NO: 37158 - DNA, 842 bp, Homo sapiens
  misc_feature: GYAE6OF02JTXEE.13.46.E02.1.454.CMB.1.raw
  modified_base (533)..(533): a, c, t, g, unknown or other
  misc_feature (533)..(533): n is a, c, g, or t
  modified_base (729)..(729): a, c, t, g, unknown or other
  misc_feature (729)..(729): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctcgtgggtcccaggtatttaggaggggatgacgtgtaaactggactagtacgtctccactcctcccgtcgtcccgtcacccgttggacacggcccggtcctaccacttccgtccctgacctagttttccgaagtaaccaaacggtcccttaccggtaacctacttacgtaagtcgtaaggttacgggacctaaaccgtacccttaacgttaggttaacggttttccgggtttacgggacgtaacggacgggcccaacgggacctaaagtcccgttaccgtaaacgggaccgtaacctttaaaagtttaccgttaagggttcgtaccgttacggaaccggttaacggggtacccggttacccgggggtacccctaagaaccggtagtaacgttccgacggtaccgggtanaaccgggttggtacgaaggacccgtaagtcgtaacttacaaccggttaacctaaaggtaaaactcgggtaaacggtacgggtacggggtaggaacgggtacgtaagggtaacggtaggttggttttaaagcgggtactttaacgttaaatttgttacggaacgttactacgggtaaataccggaaccgtttaaacncggtaaaccgttcgggtaacccgtttaagttcgtttacggggaaccggtaacggggtaacctagggtctaacgggactaacgtataaccggtacctaggttaccgcggtaacg

SEQ ID NO: 37159 - DNA, 707 bp, Homo sapiens
  misc_feature: GYAE6OF02IAAXO.13.46.E02.1.454.CMB.1.raw
  modified_base (604)..(604): a, c, t, g, unknown or other
  misc_feature (604)..(604): n is a, c, g, or t
  modified_base (608)..(608): a, c, t, g, unknown or other
  misc_feature (608)..(608): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggtatttaggaggggatgctagtaatgactcagtctccactcctccctcgtcccgtcctcccgttaggaccacggtcccggcctaccacttcctcctggtctagtttctaagtacaaacgtcctacgtacactactatgtaagtcgggaccaaccgtaaccttaacgttcggttaagtttcggtttcggacgtaggacggccgaacgtaccaacttccgtacgaacggtccgttaaacccgtttaagtttacggttaacgggttcgttaccgtaggtaacggtaacggggttacccgttccggggtaccctaacggactaacgttacgttacgaacgggcggtacgtacgggtgggaccgtaacggactacggtacgttactttaccgaactactaacgtaaactcgaaggcgtaagggtggagtcggagtacggtagttggtttagtagtcttacgtaacttgttacngtanacgaccgtaagacaaacgcgtacgtacgtaccgttacttacgggttcgacggtaacggactaacggtcaggacgtagactacgtagtacgtgtgtaccg

SEQ ID NO: 37160 - DNA, 563 bp, Homo sapiens
  misc_feature: GYAE6OF02GVE0K.13.46.E02.1.454.CMB.1.raw
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
  modified_base (343)..(343): a, c, t, g, unknown or other
  misc_feature (343)..(343): n is a, c, g, or t
  modified_base (387)..(387): a, c, t, g, unknown or other
  misc_feature (387)..(387): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
  modified_base (531)..(532): a, c, t, g, unknown or other
  misc_feature (531)..(532): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (541)..(543): a, c, t, g, unknown or other
  misc_feature (541)..(543): n is a, c, g, or t
  modified_base (546)..(551): a, c, t, g, unknown or other
  misc_feature (546)..(551): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (557)..(558): a, c, t, g, unknown or other
  misc_feature (557)..(558): n is a, c, g, or t
  modified_base (560)..(562): a, c, t, g, unknown or other
  misc_feature (560)..(562): n is a, c, g, or t
tcagtcacgtactacacgaccggtgctcgatttagactcatctacagggaaaggggctgcagtgggtctctggtataaactggaatggtgccagcacaacttatgcagactctgtgaagggccattcacatctccagagcagtcgccgagactccgtacatctgacaaatgaaactgtctcggagtcgaagcaacggtcttgttactttcngnggcgtaggttncaggtcggctaggttacttacggcaaggtcggacgtcgtgggaccgaacggaccgacgtcgaccgtctccncgtacgcctacccgaccgaacggcctacgtccggttcccttaccccgnggcccctacccgtcctacgaagcgacctaccgtcggacggaccncgacgcccggccggtcggcctcggccgttacggaccgtaacgtaccttaccgttaccgtacggtaacgtcgtacgtacggacgtccgggtcgtacggacggtaacgcggactaagcgttacngtcancganctgcngnacntgnngtnangctnnngcnnnnnncncncnncnnng

SEQ ID NO: 37161 - DNA, 900 bp, Homo sapiens
  misc_feature: GYAE6OF02F2LCM.13.46.E02.1.454.CMB.1.raw
  modified_base (173)..(173): a, c, t, g, unknown or other
  misc_feature (173)..(173): n is a, c, g, or t
  modified_base (783)..(783): a, c, t, g, unknown or other
  misc_feature (783)..(783): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgcctcgtcgggtcccaggtagtttaggaggggatgcgttgtaagtgactntagtactccacctcctcccgtcgtaccccgtctacccttaggacacggccgtccctaccgatccgtctcggctagttcctagtacaacgtcctcgtacatccagtgtagtcggaccaacctaccgttaactttgaacgttttcggttcgacgtagtacggaccacgggtaacctaactcccgggtaaccgtaaccgggtaccttaaccgtttaaaacgttttaacgggttaaacggggttcgttaaccggtaggtaaaccgggtaccggggtacccccggtaaccccgggggttaccccaaacggtaccgttaaagggtaccgtttaacccggacgggaaccccgggttgggttacggggttaacggggtaaccgtaacggggtcccttaaccggtttaggttaaacccgttttccaaaaccccggtaaaggttttaaacggaaaaacgtttcccgaaacggggtaaccgggtaacgggggttaccgggtaacgggtttaacgggaacgggtaaacggtttaggttttaacggtttaacgggtttcgggtaacctttacgtttaaacgttttcgtacggtaacgtacggttaaaccgacggttaaaaccnccgtaaacgtacccgtaacggttaccgtaaccgtttaccggttacggtaccggtacggtaccgggaactacggcggttagtaacgtacgtacgaacgttacgtacgttccggagtcc

SEQ ID NO: 37162 - DNA, 437 bp, Homo sapiens
  misc_feature: GYAE6OF02FQFWM.13.46.E02.1.454.CMB.1.raw
  modified_base (251)..(251): a, c, t, g, unknown or other
  misc_feature (251)..(251): n is a, c, g, or t
  modified_base (426)..(437): a, c, t, g, unknown or other
  misc_feature (426)..(437): n is a, c, g, or t
tcagtcacgtactacacgaccggtgctcgatttagactcatctacagggaaaggggctggagtgggtggccaacataaaggaagatggaagtgaaagatactatgtggactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtntggggccaagggaccacggtcaccgtctcctcagcctccaccaagggcccatcggtcttccccctggccaccctcctccaacgacgcacctcgtgggggcacgagcggccctgggctgccgtggtcaaggactacttctagtcgtgactgaggcgggctggcaaggcgacatagnnnnnnnnnnnn

SEQ ID NO: 37163 - DNA, 689 bp, Homo sapiens
  misc_feature: GYAE6OF02HDOI5.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtgggctgctaatgctcgtcgggtcccaggtattaggaggggatgctgtaatgactcagtctcctactctccctcgcccgtctacccgttggaccacgccgcctccactctccgtgctacgttctacgtacaaacgtcctacgtactactcagtgtacgtcgggaccactaccgttacttagttaacgttcgggtttccgacgacggtacggaccgacggaccaacttaccgaccgaacgggtacctaccgtttaagtttaacgtaaggtcgttacgtacggtaacgacggggtacccggtccgggtaccgagacctaggtacgtccgacggcgggacgtgggttacgggtacacggtacctgtacgttagtttaccacgtaacgagtaaaacgtcgaacgtaggtacgggtaggacggtcgtaggacggtagttcggttagtcggtattctagttatgagtcgtagactaacgtacacgtactaccggtacgtacgttacgttacggttcgaccgggttaacggaccgtaggcgttacggaagtacctacggttaacgaccgtacgtggtaccgtacgg

SEQ ID NO: 37164 - DNA, 909 bp, Homo sapiens
  misc_feature: GYAE6OF02H8VOF.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatcgctcgtcgggtcccgaggtatttagggaggggtatgcttagtaatagtacctcgtacgtcctccacctccttcccctcgtccccgtcctacccgttacggaccaccggtccccggtccctaccaccttccttcctacgtcttacgttccgtacgtacaaacgtcctacgtacatacagtgtaggtcggacctaaccgtaccttacgttaggttacgtttcgggttacggactacggtaccgaccggtaccggtacctaaccgttaccgtaacccggtaacggtacccggtaaacgtttaaacgttttaaacggtaacgggtttccgttaccggtaacggtaaccgggtaccggggtacccggtaccccggggtaacctaacggtaaccgtaacggttaacgttcgacggggaccggttacggtacggggttaccggggtccggtaacggtacccgtacgttaacggtttaacgttttacccgaaccgttaaacggtaaacggtttaaaaccgacggttaacgggacggggtacgggggttacgggacgggttagggtaacggttaaggtttgggtttacggttttaacgggttcggtttacgttaaccgtttagtttccggttacgtaacggttacacgtaacgtaacgtaccgaaaccgtacggtacggtaccggttaccgttacggttaaccggttccgggtaaccggtaacgggtaaccgacggtaacggtacgtaaaccgtcgtaaaccgtaacgtaccggtttaacgttccggagtcccg

SEQ ID NO: 37165 - DNA, 780 bp, Homo sapiens
  misc_feature: GYAE6OF02H0SN0.13.46.E02.1.454.CMB.1.raw
  modified_base (224)..(224): a, c, t, g, unknown or other
  misc_feature (224)..(224): n is a, c, g, or t
tcagtcacgtactacacgaccggtgctcgatttagactcatctacagggaaaggggtgatcaggactcctcagttcaccttctcaacaatgaggctccctgctcagctccgtgggctgctaatgctcgtcgggtcccaggtatttaggaggggatgctagtaatgacttcagtctccactctcctcgcccgtcacccgttggacacgccggcctcattcctctncgtagtttctagtacaacgtcctacgtacatcatgagtcggacactacctacgtagttacgttcggttcgacgtaggcgaccgtacggacctaacttccgtaaccggaacgggtccgttaacgttaacgttttaacgtaacgggtttccgtacgtaccggtaacggtaccgggtaaccccggttacccggggtacccaaggtaaccgtacggtacttaccggaggtccggtacggtcggtacgggtacgacggtactacggttacgtacgtttaaccgtaaccgtaacgtaacgtaaacttacgaacggtacgggtagggtacgggtaaccggtacggtaagggtaaggttacgttacgggttttaacgtcgggttacttacggttaatttcggtttacgactagtacgtaacaacgtaaccgaaccgtaccgtaggccgttaaccgttcgtttaacggtttccgggaaacccggtcgggttaaacccgtaggtaccggtaaggtaaccgtactaacccggttaggtaacccggttaagttcgggtaacgtcccgg

SEQ ID NO: 37166 - DNA, 954 bp, Homo sapiens
  misc_feature: GYAE6OF02FHG1X.13.46.E02.1.454.CMB.1.raw
  modified_base (161)..(161): a, c, t, g, unknown or other
  misc_feature (161)..(161): n is a, c, g, or t
tcagtcacgtactacacgaccggtgctcgatttagactcatctacagggaaagggtgatcaggactcctcagttcaccttctcacaatgaggctccctgctcagctcctggggctgctaatgctctgggtcccaggatttagagggatgctgtaatgactnagtctccactctccctgcccgtcacccttggacagccggcctcatcctcctgctagttctagtcaacgcctgtaccatcatgagtcggcactacctacttgatttcggttcgacgtacggacggccgtacggacctaacgtccgtaccaacgggtcctaccgttaattacgtaaggttcgtacgtcgacgtacgggtaccgttccggggtacccaggtaccgtagtaccgtttacgacgggtacccggtacgtacggggtaccgggttaccgtaaggggtcccgtaacgtttacggggttaacttttaccgtaaccggtaaaccgttaacgggtaaaactttccggaaacgggttacccggtacggggggttaaacggggtaccggttaacgtacggggttaacgggttaacggttttaccgggtttaacgggttttaaccggggtaccccgtttttacgggttttaaaacgttttaccgggttttaccggtaacgtttaaccgggtttccgggttaaaccgggttaacggtaaacccgtttaaaaccggttaccccgtttaaaacccgggggttaccgggttaaaccccgttttaaacccggtttaccgggtttttaccccggggtaaccccggggttaaacccgggggggtttaaccccgtaaaccggggtttacccgggtttaaaccgggtaaaaccgggttaccccggttttaaccccggtttaaaaaccgggtttacccccgggggtttaaaacgttttaccggggggttaccccggtttaacccggg

SEQ ID NO: 37167 - DNA, 776 bp, Homo sapiens
  misc_feature: GYAE6OF02IABOO.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtggggctgctaatgctcgtgggtcccaggtatttaggagggatgctgtaatgactcagtctccactctccctgccccgtcacccttggacacggcccggccctccacttcctcctagtctagtttcctaagtaccaaacgccttacgtacatacagtggagtcggacctacctaccttacgttagtaagtttcgggttccggacgacggacgggtccacggtacctacgtcctaccggtaacggtcctaacccgtttaaattttacggtaaggttcgtaccggtaggtaacggtacggggtacccgtcccggggtacccaaggtacgagtacgttcgacggtcggacgtagggttcgggtacacggtaccgttacgtacggttactttaccgaacgttaacgtaacgtaaaaacgtccggaacgggtacgggttaacgggggttagggaaccggtacggtagggtacgggttacgtttagggttttacgggtacgggttacctttacgtttaagttaccggttcggttaaacgtagttaccggtaaccgtaacggtaaccaacccgttaccgacggttaaccggtacccgtttacgttaccggtttacggaccggtaacgggtacgatcggaggactcgtagtaaccgtcctaggttacgtcgtcg

SEQ ID NO: 37168 - DNA, 783 bp, Homo sapiens
  misc_feature: GYAE6OF02F651X.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctctgggtcccaggatttaggaggggatgctgtaatgactcagtctccactctccctgcccgtcacccttggacacgccggcctccactcctctgctagttctagtcaaagcctcgtacatcatgatggacaccaccttattagtaatttcggttcgcaggacgtccgaggaccaattccacggaacggccgtaaccttaatttaacgtaaggttcgtacgtacgacgagggtaccggtcccggggtacccaggaccgagtctttacgacgggcgcgtaacgggttgggacgtaacggacctaccgttaggttaccttttaccaaccgtaacgtaaacgtaaaaacttccgaaacggggtacgaagggggttacgggtacgggtaccggttaaggtaacgggttaacggttttagggtttaagggtttacggggttccttttaaccgtttaagttttacgttacggaacttacgtacgggtactaaaccgggtactaaaaccgtacccgttaaaccggttcggtaaccccgggttaacgtttacccggttttacggggaaccgtaacccgggggtaaacctaacggggtacccgtagggtaacggttaaccgttacgtaaaccggtttccggtaaacggtttcgggttaccggtacccgg

SEQ ID NO: 37169 - DNA, 920 bp, Homo sapiens
  misc_feature: GYAE6OF02FPH15.13.46.E02.1.454.CMB.1.raw
  modified_base (194)..(194): a, c, t, g, unknown or other
  misc_feature (194)..(194): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctcgggtccaggattaggaggggatgctgtaatgactcagtctccactctcctgccgtctacctggacncgccgcctccatcctcctgctagttctagtacaaacgcctcgtaacatacatgagtcggacctactaccttaacgttagttaagttttcgggttcgtacgaaggacggaccgtacgaccctaagtccgtaccgaacggtaccgtaacctttaaagttttaacgtaagggttcgttaccgtacggtaacggacggggtacccgtacccgggggttacccaaacgggtaaccgtaagtaaccgttacgaaccggtaccggggtacgtaacgggttcgggtaaccgggaacgggtacctaacccggttacggtttaaccttttaaccgtaaccgttaaaccggttaaaaggtaaaaaacgtaccgggtaacgggtaacggggtaacggggggttaacggggtaaccgggtacgttaacgggggaacgggtttaaggtttttaaccgggtttaagggttttacggggtacccgttttaaacgttaacggtttttactttaacgggtacgttaacggtaccggtaaacgtaaacccggtaactaaacccgggttaaaccgtacggttacccgggtttaaacccgttaaccggttttaacccggtttacccggggggaaacccggtaaccgggggtaaacccgtacggggttaaccggtaacggtaaccggtaacgtttaacccggttaaaggttaaccccgggttaaccggttcgggtaaccggttacccg

SEQ ID NO: 37170 - DNA, 711 bp, Homo sapiens
  misc_feature: GYAE6OF02JBQKY.13.46.E02.1.454.CMB.1.raw
  modified_base (110)..(110): a, c, t, g, unknown or other
  misc_feature (110)..(110): n is a, c, g, or t
  modified_base (217)..(217): a, c, t, g, unknown or other
  misc_feature (217)..(217): n is a, c, g, or t
  modified_base (598)..(598): a, c, t, g, unknown or other
  misc_feature (598)..(598): n is a, c, g, or t
  modified_base (610)..(610): a, c, t, g, unknown or other
  misc_feature (610)..(610): n is a, c, g, or t
  modified_base (617)..(617): a, c, t, g, unknown or other
  misc_feature (617)..(617): n is a, c, g, or t
  modified_base (628)..(628): a, c, t, g, unknown or other
  misc_feature (628)..(628): n is a, c, g, or t
tcagtcacgtactacacgaccggtgctcgatttagactcatctacagggaaagggctgcagtgggtctctggtataactggaatggtgccagcacaacttatgcagactntgtagaggccattccacatctcgagagacagtcgaccgagtaacctccgtacatcctgacaaatgaactgtcgacggagtcgacggtacgccgtcttgtactttcgnggtcgtacgtaggttacgctagggtcgaccgttaggtaccttaacggctaaggttcggaccgttcggtacgggaccgtaacgggtacctaaccgggtcctaccggttacctccgtacgaccgtacccgtacccgaaccggtacggaccccgttacggttcccggttaaccccctttcccccggaggtacccccgttaccccgtccccgtaacgtaaacgtccgacccgttacccggtcgggttaaccgggaccgaaccgtcccgggttaccgcccggttcggacctacgtcccggtaggtacgaacgttactaccgtttacgacgttaccgtagtccgtacggacggccggttcgtacgaacgacggtcgtcgaagtcgancgtagcgacgtnataccgngtcacgtgacncgtctacgtcgtacgtacgagtacgacgtagacgcgtacgtacgtacgacgtacgtacgacgacgtacgacgtacgtactacg

SEQ ID NO: 37171 - DNA, 960 bp, Homo sapiens
  misc_feature: GYAE6OF02IUJI7.13.46.E02.1.454.CMB.1.raw
  modified_base (166)..(166): a, c, t, g, unknown or other
  misc_feature (166)..(166): n is a, c, g, or t
  modified_base (172)..(172): a, c, t, g, unknown or other
  misc_feature (172)..(172): n is a, c, g, or t
  modified_base (206)..(206): a, c, t, g, unknown or other
  misc_feature (206)..(206): n is a, c, g, or t
tcagtcacgtactacacgaccggtgctcgatttagactcatctacagggaaagggggtgatcaggactcctcagttcaccttctcacaatgaggctcctgctcagctcgtgggctgctaatgtcctgtcggtaccgaggtatttaggacggggtatgacttgtaangtactnactctccactcctcctcgccctcgaccgtggacncgtccggccttccactctccgtgctacgttactacgtacaaacgtccgtactactaactcgtatacggtagtaccggcctaaccgtaccttaacgttaggttaaccggttttgggttaccaccggaacggtaccgggtaccgtaccgggtaccaaacttcccggttaccggaaaaccgggtccttaacgttttaaacttttaacggttaaccgttttacccggggttttaaccccgggactttccccggggttccggttaaccccggtaaagttaaccggaggtttaaccttaccgggaacggtccccgggtagggtaccggtttcggggaaaaccgtaccggtacgtaacgtttaccggttaataccggttaacttacggttaaacgttaaacccgtccggggttaaaggtaaacccgggggttaggtaccggttaggtaaacgggtaacggggttttacgtacggggttttaaggtttaacgttttaaccgtacgttaccgggtagttaaccgtacgggtaacgttaacttaaccgggtaccgtttaaccttttccgggacccggttttaacccgttttaccggggttacccgttttaccccggggacgttttaaaacccggggaccggtttaaaccgggttaacgttaacccggtaaaccgtttaaaccggggccgttttaaacgttccggggctttacccgggttaccggacgtttaacccggttctttaacccgttccgggttttaacc

SEQ ID NO: 37172 - DNA, 859 bp, Homo sapiens
  misc_feature: GYAE6OF02F631Y.13.46.E02.1.454.CMB.1.raw
tcagtcacgtactacacgaccggtgctcgatttagactcatctacagggaaaggggtgatcaggactcctcagttcaccttctcacaatgaggctccctgctcagctcctggggctgctaatgctcgtgggtcccaggatttagaggggatgctgtaatgactcagtctccactctccctgcccgtcacccgttggacacgccggcctccatcctcctgctagttctagtacaaagtccctcgtacatcatcgagtcggcaaccaccttacttagtaacgtttggttcggacgtaggacggtaccacgggtaccctaagtcccgtaccgaacgggtcccgtaaccgtttaaagttttaagtaaagggttcgttacggtacgaacggtaccggggtaccggtccccggggtaaccaacggtaccgtaagttaccgtttacgacgggtacccggggtacgtacggggttacgggtaccgaagggtacccttaacggttacggtacttttaacccgaacttaaccgtaaacgaaaacgttacggaaaggtcgggtaagggggtacgggtaacgggtaccggttaagggtacgggttaacgtttacggtttaaaggtttccggggttacctttaaccgtttaagtttaggttaccgttacgtagttaaccggtaaacgtaaaccggtaaccgtaaacccgtaaccgtaaaccggtttaccggggtaacccgtttaaccgtttacccggttttaacccggggaacccggttaaaccgggggaaacccttaacgggtaccggtaagggtaaccggtacgtaaccggtaaaccggtaccggtacggtttacgggtcgttaacccgg

SEQ ID NO: 37173 - DNA, 886 bp, Homo sapiens
  misc_feature: GYAE6OF02JU6RS.13.46.E02.1.454.CMB.1.raw
  modified_base (460)..(460): a, c, t, g, unknown or other
  misc_feature (460)..(460): n is a, c, g, or t
  modified_base (502)..(502): a, c, t, g, unknown or other
  misc_feature (502)..(502): n is a, c, g, or t
tcagtcacgtactacacgaccggtgctcgatttagactcatctacagggaaaggggtgatcaggactcctcagttcaccttctcacaatgaggctccctgctcagctccgtggggctgctaatgctctcggtcccaggtatttaggaggggatgtactgtaatcgactcagtctcctactcctcccgtcgccccgtctaccccgttggacctacggcccggtcctccctattccctcccgtcgtacctaacggtttcctaaggtacccgaaaaccgtccccgttaccggtaacctattaccgtagttggaaccggtccgggtaacctacccgtaaccctttaaccgtttaggtaaacgttttccggggtttccggtaacgtaacggtaccgggtacccgacgggtaccctaaacgtcccgtaccggaaggtcccgtaccttaaagtttacgtacgggttntaacgtcggaacgtacgggtaccgtccgggtaccacgaacgngtaacttcgacggtccgggagttacgggtcggacgaccgtcgaacgtttcgtacgtttacgaaccgtagtaacgtaaacctcgaccggttacggacggggtacgggtaacggtacgtaacgggttacggtaacggttttacgttacggttacggggttaccctttagtttacggtttaccgtttggaaccgtttagacccggttaacgtaaaaccgtacctaaaccgtacccgtaccggttacgggttaacccgtttaaccggttacccgtttaccggggttaaccggaccggggttaacccgtaaacgggtacgggttacgggttaacgtaccccggtacgggttaacgaacccggtttaagggttcccgggttaagtcccgg

SEQ ID NO: 37174 - DNA, 604 bp, Homo sapiens
  misc_feature: GYAE6OF02ILEGD.13.46.E02.1.454.CMB.1.raw
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (564)..(564): a, c, t, g, unknown or other
  misc_feature (564)..(564): n is a, c, g, or t
tcagtcacgtactacacgaccggtgctcgatttagactcatctacagggaaggggctggagtggattggccatattaaggacagacctaatggcgcgacagcacactaccttgaatccgtcaaagacagattcatcatctcgagaggtgattccgacaacacggtgtctactccatatcgagcagcctagaaaatcgaggactacacggcctatattacgtagttcgactaggttgaagtcgggtccaaccggacacggtacttttggacgtggtagtcgctcgcccgnggggcccggacctggtcacgtcgtccncncgcctcgaccaggccagtcgtccttacccgngcctaccccnctaccgaagtacgccctacgttcgcggggactacgacggcggtacccgtggggccttcgacccgtgggtaaccaacgggtaccttacgtttcccgtaaaggttacccggtagtacccgtggtaaccgcgggtccgtaggaccgtagggcgtacacgtacggctcgcngtcgacgncgngngcgcgcgtctcgtcgcgacgtcgcncgtcgacgtacgtacgtaccgcgtacgacgcgacgtgtcg

SEQ ID NO: 37175 - DNA, 744 bp, Homo sapiens
  misc_feature: GYAE6OF02JZYW8.13.46.E02.1.454.CMB.1.raw
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttaggagggatgcttgtaatgctcgagtctccactctccctcgcctcacctggacncggccgcctccatctccgngctacgttctagtacaaacgccttagtactactctaattagtcggctactacctacttagtaacgtttcggttcgacgtaacggtacggtaccaggaccctaacgtcctaccgaacgggtacctaaccgtttaaagtttacggttaaacggttcgtacggttacgaacggtacgggtaaccggtcccgggggtaacccctaaggaacgtaacggtactttccggaacggtccgtacggtaacggtttcggggacgtaacggcgtaacccgtaagttccgttttaaccgaaccgttaacgtacgtaaaaacgtcgaaacggtccggtaagggtaacggtacgggtacgtagggtaaggtagttaggttacgtacgggtacgttacgtagttagttcgaacgtgacgtacgtacgaacgactaacgtacgtacgtccttacgtaccggttcgaaccggtacggtaaccggcgtaacggaacggtaactacgtacgtaaccggttaaccgaaggttcggtacgtacggtaccg

SEQ ID NO: 37176 - DNA, 847 bp, Homo sapiens
  misc_feature: GYAE6OF02JADDY.13.46.E02.1.454.CMB.1.raw
  modified_base (176)..(176): a, c, t, g, unknown or other
  misc_feature (176)..(176): n is a, c, g, or t
  modified_base (188)..(188): a, c, t, g, unknown or other
  misc_feature (188)..(188): n is a, c, g, or t
  modified_base (271)..(271): a, c, t, g, unknown or other
  misc_feature (271)..(271): n is a, c, g, or t
  modified_base (383)..(383): a, c, t, g, unknown or other
  misc_feature (383)..(383): n is a, c, g, or t
tcagtcacgtactacacgaccggtgctcgatttagactcatctacagggaaagggggtgatcaggactcctcagttcaccttctcacaatgaggctccctgctcagctccgtggggctgctaatgctcgtgggtccaggtatttaggagggattctgtaatgactacgcttcaccnccttcctccccncgccccgtccacccgttggacacgcccggcctcctacttcctccgtcgcttacgttactagtaccgaaacgcctacgttacancgtatcgggaatcgggacaacctaccttacgtagtagtttcgttcggacacggtacgccgagacctaacttcccgacgaccggtactaaccttaaggtttagtaacgggttnacggtacggaacgtaacgggggtccccggttcccgggggtacccgtaaaggacctaagtacgttacgaagggtccccgggaaggttgggtttcgggaacgaacggtcctaggggttaactttaccggttaaccaccggttaaaacgtaacggttaaaaacacgttaaacggggttccgggaaacgggggtaacgggttaaggggaaccgttaggggtaaaccggggttagttttaagggtttaacccgggtttaaggggttaacccgttttatttaaccgttttagttaaccggttgaaggttaccaaccggtaaaactaccctagtaaacccggtacgtaaacccggttccctttaaccgggtttaacggtttaccggggaacccggtacggggttaacggaccgtaccggtaaggggtaactacgtacggtaacgaccgttaagccggttacgcggtaccgg

SEQ ID NO: 37177 - DNA, 760 bp, Homo sapiens
  misc_feature: GYAE6OF02GRNPB.13.46.E02.1.454.CMB.1.raw
  modified_base (180)..(180): a, c, t, g, unknown or other
  misc_feature (180)..(180): n is a, c, g, or t
  modified_base (564)..(564): a, c, t, g, unknown or other
  misc_feature (564)..(564): n is a, c, g, or t
tcagtcacgtactacacgaccggtgctcgattttagactcatctacagggaaagggggtgatcaggactcctcagttcaccttctcacaatgaggctccctgctcagctccgtggggctgctaatgctcgtcgggtaccaggtatttaggagggatgctagtaatgactcgagtctaccncttcctcccgtcgcccgtctacccgttggacgacgcccggtccctccacttcctccgtgactacgtttacgtacgtaccgaaacgtccgtaccgtacactacgtagtagtacgtcgggacctaaccttaaccttagttaggttaacgttttcgggttacggacgaggtacggaccgacggaacctacgtccgtaccggaacggtccgtaacctttaagttaaggttaggtcgtcgtacggacgtccgggtacccggtaccgggtaccaaggtacgagtacgtacgacgggaccggtcggttaacgggtcgggtaccgagaccttagttacggtactttaccgaacgtactaaacggaaatcggaacggacgggtagggacgggnggtcgtaagggtgttacggttgtttaggttcgctttaagttacgttgtaacgtgtacgttacgacgtaacgaaccgtaacgtacgtacgtaccgggttccttaccggttacgtaccggtaccgggaacgggtacgaaacggtcggtaaggtaccgtaacgtttacgaaacgtttccgaagggttcgtacggtaccg

SEQ ID NO: 37178 - DNA, 735 bp, Homo sapiens
  misc_feature: GYAE6OF02GR2CJ.13.46.E02.1.454.CMB.1.raw
tcagtcacgtactacacgaccggtgctcgatttagactcatctacagggaaaggggtgatcaggactcctcagttcaccttctcacaatgaggctccctgctcagctccgtgggctgctatgctctggtccaggatttagagggatcgctagtatgactcagtctcgactctcctgcccgtcaccgtgacacgccgcctacactctcctgactagttcgtagtacaacgtcctacgtacagttacagtgagtcgggccaaccgtaccgttacttacgtaacgtttcggttacggctaggacgtaccgaccggactaacgtcctaccggacggtccgtaacctttaatttaacggttacggttcgtcgtacgaacgtaccgggtaccgttcccgggtacccaagacgtacgtacttaccgacggtcgacgtacggttcggacgaccggtactaccgttaagttaccgttttacaaccgtttaacgtaaagtaaaacctaccggtaaggtaccgggtacggggttagacggggtaccgttaaggtaaggttacgtttaggtttacgttaccggttacctttagtttaagttttacgtaccgtagttacgacgaccgtaaacgaccgttaaccgaacgtacccggtagtacccgttaccgtttacggttcggaacccggaaggtaaccgtacggtaccgttaggatacgtacgtaactacggacgttcggtcgtaccg

SEQ ID NO: 37179 - DNA, 788 bp, Homo sapiens
  misc_feature: GYAE6OF02GO1GU.13.46.E02.1.454.CMB.1.raw
  modified_base (220)..(220): a, c, t, g, unknown or other
  misc_feature (220)..(220): n is a, c, g, or t
tcagtcacgtactacacgaccggtgctcgatttagactcatctacagggaaaggggtgactcaggactcctcagttcaccttctcacaatgaggctccctgctcagctcctggggctgctaatgctctggtccagatttagagggatgctgtaatgactcagtctaccactcctccctgcccgtcaccgttggacagcccggcctccactcctcctgacncgttactagtcaaacgtcctacgaacactcgaattgaagtcgggaccaacctacctttacgttagtaacgttttcgggttcggacacggaggccccacggtaccctaaagtccgtaccgaggtaccgaaccctttaagttttaagaaggttcgttacgtagtaccggaacgggtacccggttacccggggtaccccaaaggtaccgtaacgggttaacttaccggaacggtcgggtaccgtaaggttccggggtaacgaacgggtcctaccggtttaggttaacccttttaccgaaacccgtaaacttaaacgggtaaactaaccggttaacggaccgggtaaaccgggggttagggtaacccgggtaggtaacgggtaacggaaggttttacggttaaggtttacgggtaacttcgttaagtttacttagtacgtacgagtaaccgtaagaccgaacttaccgtactacggttaccccgtaattaccggtttcggaccggttaacggaaccggtacggtcgttacggagttaaccgtacgtacgtaccggtacttcggtaccggtcg

SEQ ID NO: 37180 - DNA, 706 bp, Homo sapiens
  misc_feature: GYAE6OF02G1IIG.13.46.E02.1.454.CMB.1.raw
  modified_base (111)..(111): a, c, t, g, unknown or other
  misc_feature (111)..(111): n is a, c, g, or t
  modified_base (259)..(259): a, c, t, g, unknown or other
  misc_feature (259)..(259): n is a, c, g, or t
  modified_base (447)..(447): a, c, t, g, unknown or other
  misc_feature (447)..(447): n is a, c, g, or t
  modified_base (490)..(490): a, c, t, g, unknown or other
  misc_feature (490)..(490): n is a, c, g, or t
tcagtcacgtactacacgaccggtgctcgatttagactcatctacagggaaaggggtgatcaggactcctcagtttcaccttctcacaatgaggctccctgctcagctccngggctgctaatgctctcgggtcccaggatttagaggggatgctgtaatcgactcagtctaccactctcccgtagcccgtcaccgttcgacgacggcccggcctcacttcctcctgcctagttctagtacaaacgtcccttacttaacntactactggaatcggggacacctaacccttagtttacggaaagttttcgggtttaccggccaaggacgggaccgtaacggaccctaaacgttccaacccgtaagggtccctaacccgtttaaagtttacgtaaacggtcgttaccgtaagaccggacgggaccggttacccggggccgaagtaaccgngtaaccgtagaccggtacgggtctaggggtcgacggacgtacncggttaacgtactttaaccgaacgtaacctaagtaaacgtcaacggacggtaagggtacggaggagtacggaagtagttaggttcgtacggtacgtcgttattacgtgtcgtaatcgacaacgtacgaactacgacgtacgtcgtattacgtttcggaacgggccggaacgacggtacgacggtacgacgttaacacgacggtaacgtgtacggac

SEQ ID NO: 37181 - DNA, 591 bp, Homo sapiens
  misc_feature: GYAE6OF02F2N7N.13.46.E02.1.454.CMB.1.raw
  modified_base (142)..(142): a, c, t, g, unknown or other
  misc_feature (142)..(142): n is a, c, g, or t
  modified_base (199)..(199): a, c, t, g, unknown or other
  misc_feature (199)..(199): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctctggtcccaggatttagngggatgctgtaatgactcagtctaccactcctcctagcccgtacacccgttggaccncgccggacctccatccgtcctagctgtctacgtcaaacgcctcgtacntcatgatggcacnctatgacgttgtcgcagagccagccatctacgaggcacttaattagaggtgtctgacgaggtctcccgggtccagacgagtacttcgaggcgacgtacggngtacaggctagtgtactttacgaactataagtaactcgagacgtaggggtacgnggtacctagggagttagttgttaaggttcggtacttattaagtttcgcgtatagttacgccaaagggcctaaacgcttaccggtacggttacccagggttttacctcggaaccggttacgggaacctacggtcgtagtacgaaccttacggtaaactcgggtaaccttagcggacc

SEQ ID NO: 37182 - DNA, 712 bp, Homo sapiens
  misc_feature: GYAE6OF02FMHXV.13.46.E02.1.454.CMB.1.raw
  modified_base (145)..(145): a, c, t, g, unknown or other
  misc_feature (145)..(145): n is a, c, g, or t
  modified_base (265)..(265): a, c, t, g, unknown or other
  misc_feature (265)..(265): n is a, c, g, or t
  modified_base (494)..(494): a, c, t, g, unknown or other
  misc_feature (494)..(494): n is a, c, g, or t
  modified_base (612)..(612): a, c, t, g, unknown or other
  misc_feature (612)..(612): n is a, c, g, or t
  modified_base (677)..(677): a, c, t, g, unknown or other
  misc_feature (677)..(677): n is a, c, g, or t
tcagtcacgtactacacgaccggtgctcgatttagactcatctacagggaaaggggtgatcaggactcctcagttcaccttctcacaatgaggctccctgctcagctcctggggctgctaatgctctgggtcccaggatttaggngggatgctgtaatgactcgagtctacctactcctccctgccccgtctacccgttggacgacgccggcctccatcctcctgactgttctagtacaaacgcctacgtactagtacagtacgngtacggacctacctaccgttacgttagtaacgttttcgggttaccggacgtaggacggacccgtacggaccctaagtaccccgtaccgaacgggtcctaaccgtttaaatttacggttacggtctacgtacggtaccggtacgggtacccggttacccggggtaccaggacccgtaagttacgtacgaacggtccggaggtcgggtaccggacgtaggacctaacggtnttaccgtttacaccgtacgtaaagtaaacgcgaacggtacgggtaggggtaggacggtaccgtagggaagttagttggtttagtacggacctttataggtttcgtagcctagtcgtanaccgaacgtaacaccgtacgtacggtaccctaccggtttacgttacgggaccggtaaccggaacnggtcgaggtcatacaaggttacgacgttggatccg

SEQ ID NO: 37183 - DNA, 724 bp, Homo sapiens
  misc_feature: GYAE6OF02GY66N.13.46.E02.1.454.CMB.1.raw
  modified_base (176)..(176): a, c, t, g, unknown or other
  misc_feature (176)..(176): n is a, c, g, or t
  modified_base (265)..(265): a, c, t, g, unknown or other
  misc_feature (265)..(265): n is a, c, g, or t
  modified_base (493)..(493): a, c, t, g, unknown or other
  misc_feature (493)..(493): n is a, c, g, or t
  modified_base (673)..(673): a, c, t, g, unknown or other
  misc_feature (673)..(673): n is a, c, g, or t
tcagtcacgtactacacgaccggtgctcgatttagactcatctacagggaaaggggtgatcaggactctcagttcaccttctcacaatgaggctccctgctcacgctccgtggggctgctaatgctcgtcgggtccaagtagtttagaggggtatggctagtaatgactcagtccncctactcctccgtcgtccccgtactacccgttggaacacggtccggtacctccactctaccgtgtacgtacgttactagtacgaaaacnccttacgactactacgtaataggtactacgggaaccactaaccttagttagtaacgttcggttcggaacacggtacgacacggtaccaactccgtacgaacggtcctaacgttaattaacgaggtcttacgagtaccggtaacggtaccggtaccggacctaagacgtactactcgacggtcgagtaacggtggacagtacctagtagtacgtacgaactacgtaaanaaactcggtaacacggtaggtacggagtacgtaggacgttaagtagttacgttaggacgttactaattacggagtacgttaaacgtgtaaacctaacggtaactaaccgtaaccgtacggttaaccgggtaccttacggtttacggttacggaaccgggttaacggaaccgttaaccggngtaaacccgggtataacctaggaaccgttaaggtacgtaggtccgtaacgg

SEQ ID NO: 37184 - DNA, 909 bp, Homo sapiens
  misc_feature: GYAE6OF02G201P.13.46.E02.1.454.CMB.1.raw
  modified_base (156)..(156): a, c, t, g, unknown or other
  misc_feature (156)..(156): n is a, c, g, or t
tcagtcacgtactacacgaccggtgctcgatttagactcatctacagggaaaggggtgatcaggactcctcagttcaccttctcacaatgaggctccctgctcagctcctgggctgctaatgctcgtcggtccaggactccagtggggattgttgngatgactcacgtcctccacgttcctcccgtacgcccgtctacccgttgaaccacggcccggaccttccacttcctacccgttgaccgtacggttactaacgtaccaaacggtcccttacggttaataaacctaggtagtaaggtaacggggtaaaaccgttaccctttaacgttaccggttaaaaggttttcggtttaaccgaacggttaccgaacgggtaaccgggacccgtaaaccgggtacccgttaacgggttacccctaaccccggtaaaccgggtacccggtttaaccctttaaaagtttttaactttaaaccgggtttttacccgggttttttaaacccccggggaacgtttacccgggttcccgggggttaaccccaaacggttaaccgtacggttaacgtttccggaaccgggtaccgggtacgtaacgggggtttacggaccgtaggtacctacgtttacgggttaacctttacgaaactttaagttaaagaaacctttccggaaccggtaaagggggttcggaacggtaccgttagggacggttagtttacgggttaacggtttaacttttacggtaccgtgacgttacgtaccggtacttaaacgtccgttaaacctgtttacccgttcggttacctttacgttaccggtaccggtccggttaagacccgtaggtacggtacctaaaccgtaagtccgtaagtcggtcgttacacgtaccgaaccttgttccctaggttcc

SEQ ID NO: 37185 - DNA, 856 bp, Homo sapiens
  misc_feature: GYAE6OF02JX85I.13.46.E02.1.454.CMB.1.raw
  modified_base (745)..(745): a, c, t, g, unknown or other
  misc_feature (745)..(745): n is a, c, g, or t
  modified_base (750)..(750): a, c, t, g, unknown or other
  misc_feature (750)..(750): n is a, c, g, or t
  modified_base (768)..(768): a, c, t, g, unknown or other
  misc_feature (768)..(768): n is a, c, g, or t
  modified_base (796)..(796): a, c, t, g, unknown or other
  misc_feature (796)..(796): n is a, c, g, or t
tcagtcacgtactacacgaccggtgctcgatttagactcatctacagggaaaggggctggagtggattggggaaatctatcatagtgggaccacctactacagcccgtccctcaatagtcgacgtcaccatgtcagtaggacgaggaccccaaaggaacctaggttcctccccgtgaacgccgtagtacctcttcgtcggacccgcccggacggtaccgtcccggacccttaagtaccttctggtcggcgacggtaacgactcggagtatgggttacgttacgagtaccgggtccggggtacttacgttttacgagttaccgtcggtacgggggtaccgtaacggggtcgtaggttacgggtacacgtttccggtaccttaccgttaccgaaaccggtcccccttaacccgtaaaccggtccccgggtaacccctaccgggtttcccggtttacccccttacccccgggtcggtccccggtccccgttaccggcccgttaccggaaccccgggtaacgtcccccgaaccccggttaccggaccggtaccgaacccgtaacgggtaccccgggtccccggtaaccccggggttagggtaccccggtttcgggtcccggttacggggtaaacccgttaacgggttaacccctttacccggttttccgtaaaaccggtttccggacggttacggtacgggtccggtcggtaccggtacggacggtaacgttcggaaaccgtgtacggngtagngtactgacaggccgttancgactgacgttacggatcgactacggancgtcggtaagtccggagtacgtacgtacctagtcgtacgtcgtacgacgagacgtctacg

SEQ ID NO: 37186 - DNA, 657 bp, Homo sapiens
  misc_feature: GYAE6OF02GVFI3.13.46.E02.1.454.CMB.1.raw
  modified_base (125)..(125): a, c, t, g, unknown or other
  misc_feature (125)..(125): n is a, c, g, or t
  modified_base (353)..(353): a, c, t, g, unknown or other
  misc_feature (353)..(353): n is a, c, g, or t
  modified_base (542)..(542): a, c, t, g, unknown or other
  misc_feature (542)..(542): n is a, c, g, or t
tcagtcacgtactacacgaccggtgctcgatttagactcatctacagggaaagggtgatcaggactcctcagttcaccttctcacaatgaggctccctgctcagctccgtgggctgctaatgctntagggtccaggtatttagagggatgctgtaatgactcagtctccacgtctccctcgcccgtcacccttggacacggacccgcctccatctctgcagttcgtagtacaaacgtcctacgtacatacaatgaagtcggacaaccacctagtagtaacgtttcggttacgcgtagtacggccaacggacctaatcctaccggagccgtaaccttaaatttaggtaacggtntacgtacggaacgtacgggtacccgttacccgggaccaaacggtacgaagtacgttccgaagtacgcggtaagttcgggacaaggtctaactagttacgtttacaacgtaactaagaaaactcgaacgtacggaagggtcggtaaggcgaggtacggtattacggttagtggtctagttattatcgtanagtacgtacgaacaacgactaacgacgtacgtacgttacgtacgttacggaccggtaagggaacctacgggtactaggaacgtatacgaattaaccggtacgtaggtaggtaccg

SEQ ID NO: 37187 - DNA, 463 bp, Homo sapiens
  misc_feature: GYAE6OF01AGU3Y.9.21.B10.1.454.CMB.1.raw
  modified_base (275)..(275): a, c, t, g, unknown or other
  misc_feature (275)..(275): n is a, c, g, or t
  modified_base (455)..(455): a, c, t, g, unknown or other
  misc_feature (455)..(455): n is a, c, g, or t
  modified_base (460)..(463): a, c, t, g, unknown or other
  misc_feature (460)..(463): n is a, c, g, or t
tcagtgatacgtctcacgaccggtgctcgatttagtgtcgtcgcaagagaggagggggggtcacaagaggcagcgctctcgggacgtctccaccatggcctgggctctgctcctcctcaccctcctcactcagggcacagggtcctgggcccagtctgccctgactcagcctccctccgcgtccgggtctcctggacagtcggtcaccatctcctgcactggacccaccactgatattgggctattataaccttgtctcctggtatacaacaacncccagacaaacgccccacactcttaattatgagtcactaagcggtcctcgagggtttctggtcgcttctctgcctccaagtctggcaacacgcctcctgagtcacgcccaagctcgcccctcggtcactctcgttccccgccctcctcagaccgtatcactgacggcggctggacaggcncatgnnnn

SEQ ID NO: 37188 - DNA, 563 bp, Homo sapiens
  misc_feature: GYAE6OF01CRJV1.9.21.B10.1.454.CMB.1.raw
  modified_base (422)..(422): a, c, t, g, unknown or other
  misc_feature (422)..(422): n is a, c, g, or t
  modified_base (433)..(433): a, c, t, g, unknown or other
  misc_feature (433)..(433): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatatggcattataaccttgtctctggtatcaacacgccagacaaacgccccacactacttaattatgaggtcactaagcggccctgagggttctggtcgcttctctcgcctaccaagtcgtggcaacacggtccctcccgtgaacaactctcgtcgggcctccagtctgacgacgaggctgattatacngcagctcatangtctagttcggttacctcgtttacacgtattacgttcggacgggtagggaccgtagggtcctacggtacccgttccgtaggtaccggtacctacggtaccccgaacgggtcccgtccggtacccccccgg

SEQ ID NO: 37189 - DNA, 636 bp, Homo sapiens
  misc_feature: GYAE6OF01CC1WE.9.21.B10.1.454.CMB.1.raw
tcagtgatacgtctcacgaccggtgctcgatttagtgtcgtcgcaagaggtagggagggggggggtctacgaaagaggcagtcgctctcggggacgtcctccaccatggcctgggcgtctgactgctcctcacccttctcactcaggacacagggtcctgggccctgtactcgcccctagactcagtcctgcctccgtgtcgtcgggtctccgtcggacagtcgactccacctatctcctgcactcggacccaccactgatacgtggctattactaaccttgtctcctggtatcaacacgccagtacaacgccccacactcttaattatgagtcacgtaacgcgcctcgtacgggttctcggtcgtcttcgtctcgtcctaccgaacgttccgtcggacctaaccgaccggtccctcccctcgaacctaacttctacgtcgggtcctccgtacggtccgtcggtaacggacggaacggtccgtgtaacgtttattacgtgcctagctcgattactcgcgttaggtttcgttcctttctttacgaagttacttacggttccgggcgggaacgggtaccgaggtcctacggtccgttccgtgacgtccacgacccgaacggtccgtccggtcccccgg

SEQ ID NO: 37190 - DNA, 643 bp, Homo sapiens
  misc_feature: GYAE6OF01BSAOB.9.21.B10.1.454.CMB.1.raw
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcgatcaccatctcctgcactcggaccccaccactgattagttgggactattaactaaccttgtctcctgtatacaacaacgccagacaacgccccanactacttaattangtagtcataacgcgcctgtagggttctggtcgtcttctctcgtcctaccaagtctgacaaccgaccggtccctccctagacctaacttcgtacgtcgggtcctacccgtagttcgtcggaaccggaacggtacggtccttaagttaacgtttactttacgtcgtacgacgtcttaactataacgttcgtacgttacggtttcggtttccttaacgtttacgtaacgtagttaacggtcggtaaccggggtaccgggaccgtacggccgtccggtaccggtccgttagaccgttcgaacccggaccgacggtcccgttacccgtcccccgg

SEQ ID NO: 37191 - DNA, 604 bp, Homo sapiens
  misc_feature: GYAE6OF01B5ZM6.9.21.B10.1.454.CMB.1.raw
  modified_base (290)..(290): a, c, t, g, unknown or other
  misc_feature (290)..(290): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatagttggctattactaaccttgtctctgtatacaacacgccagacaacgccccanactacttaattatgagtcactaagcgcctcgtaggttctgtcgtcttctcgtcgtcctacaagtcgtcgtacaacgtaccgtcctcctagactaacgtctcgtggcctccgtagtcgacgtacgacggagtcctagtacttaacttacgtgacacgtctactatctagcgttaacggtttcggttaccttacgtttacgaagttaacgttacggttccgggacgggtaaccgggaccgtaggtcctacggtaacccgttcgtacgaacgttccgtaacccggacccgtaacggtcccgtacccggtaccccccg

SEQ ID NO: 37192 - DNA, 770 bp, Homo sapiens
  misc_feature: GYAE6OF01CVVN1.9.21.B10.1.454.CMB.1.raw
  modified_base (290)..(290): a, c, t, g, unknown or other
  misc_feature (290)..(290): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcgtggacagtcgatcaccatctcctgcactcggacccaccatgatagttgggctattactaaccttgtctctgtatcaacacgccagacaacgccccanactactaattatgagtacacgtaagccgtacccgtgtacggggtttctcgggtcgtctttccgttcgtacggtcccctaccgtaaacggttccgtacgggtaccaaaccgaaccgggtccccctccccgttaaggaaaccctaaacgttcccgttacgtaacggggtcccttacccgagtttacccgttacggtaaccgggaacccgggacggttacgttaacgttaaacgttttaaacgtttaaccgtaccggtcgtaacggttacctaacgttaacgttaacgtacggtccttaacggggttttaccggttttacccttaccgtttaaccgtaaacggttacgtttaaaccggttcggggtacccgggtaacggggtaaccccgtagggtacccggttaacccggacccggtttccgttaacggaccgtttaccaacccgggacccgtaaacgggtccgttaaccccgtccccccggg

SEQ ID NO: 37193 - DNA, 570 bp, Homo sapiens
  misc_feature: GYAE6OF01EHFHE.9.21.B10.1.454.CMB.1.raw
  modified_base (294)..(294): a, c, t, g, unknown or other
  misc_feature (294)..(294): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatagttggcattataaccttgtctcctggtatcaacaacgcccagacaaagcccccanactcttaatttatgagtcactaagccggccctcgagggtttctggtcgcttctctgcctcaagtctggcaacacggccctccctgacaatctctcgggctccagtctgacgacgagctagtattattactgcagctagatatgctaggtttcggttccttctttacaagtattacgtttcgggcgggtaacgggaccgagggtcctcggtaccccgttccgttacggacggttccaacggacccccgaaagggtcccgttccggtaccccccccgg

SEQ ID NO: 37194 - DNA, 714 bp, Homo sapiens
  misc_feature: GYAE6OF01B6LEW.9.21.B10.1.454.CMB.1.raw
  modified_base (484)..(484): a, c, t, g, unknown or other
  misc_feature (484)..(484): n is a, c, g, or t
tcagtgatacgtctcacgaccggtgctcgatttagtgtcgtcgcaagagaggaggggggggtcacaagaggcagcgctctcgggacgtctccaccatggcctgggctctgctcctcctcaccctctcactcgagggcacgaggtcctgggcccagtctgccctgactcacgccctccctccgcgtccggtctccgtggacagtcagtccactatctcctgcacgtggactccggacactggtacggtttggttccgttttagtccttagtcgttccttcgtacggtaccagcgacgaccaccgagaccaaaccggcccctaaaacttccgttacctttagacgaacgtcctacgtaacggccgtacctacgacgggtacctccgtagactccgtcgttcctcgtcgacctacgaacgttcgacgtaccaaccgaccggtccctccgtacggtacccgttcgtccggttcgggcccttaaccggnggtacgtacggaacgtaggtacggacgtaccgttaggttaactttacgttaacgcgtactacgtctaactagtagtcgaaccgaccggtaccaaccgtaacgtacgttacggtaccggtaagggttaccggacggtacccgtaacggtcccgtaacccggtacgtaccggccaacccggtaacccggaaccgtaccccaacccttacgtcgtacccgttccgttaccccg

SEQ ID NO: 37195 - DNA, 550 bp, Homo sapiens
  misc_feature: GYAE6OF01DC12T.9.21.B10.1.454.CMB.1.raw
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactcggacccacactgatattgggcattataccttgtctctgtatcaacacgcccagacaacgccccacactacttaatttatgaggtcacgtaagcgtccctcgtaggggtttctggtctcttctctcgcctcaagtctggcaacgcggtcctaccctgacactctcgtcgggcctccgagtctgacggacgaggcttgattattacngacngctcatatcgctaggttcgttccttnttacgtaagtnttacgttcgggcgggacgggacctagggtcctcggtaccgtccgtggacgtccgaacgcccgaaggtccctcccggtccccg

SEQ ID NO: 37196 - DNA, 779 bp, Homo sapiens
  misc_feature: GYAE6OF01CI8NU.9.21.B10.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (335)..(335): a, c, t, g, unknown or other
  misc_feature (335)..(335): n is a, c, g, or t
tcagtgatacgtctcacgaccggtgctcgatttagtgtcgtcgcaagagaggaggggggggtcacaagaggcagcgctctcgggacgtcaccaccatggcctgggctctgctcctcctcaccctcctcactcaggcacagggtcctgggcccagtctcgccctgactcagcctccctccgcgtccgggtctcctggacngtcggtcaccatctcctgcactggaaccngcagtgaactnttggngtcttaataactatcgtcctccgtggtaccaacgacgccaacccgaggaacctaaaaccgtccccctaaaactccaattacgtaattttanggtaaggtacaaagttaacgccggtcccgttcgtcggggtccctagactccgtctttcgtcgtcggtaccctaccgaagttcctcgggacaaccgtaccggtcccttcccgtacggtacccgttcgtccgtccgggcttacccgacgggtaccttacggaacgtaacgtcgggtaacggtacgttaggttaactttaacgttaccgtaggtaccctaaggtcttacctaaggttaacttcggtaccgaaccgggtaccctaaaccccgtaagtaaccgtttcggtaccggtttaacgggaacggttacccggggtaacccgtaacccggggttccgtaacccccggttacggttaaaccggttccccgaaaacccgggttaacccccgaaaaccgggtacccccctaaaaaccccggtcgttaccggtacccctttaaccccgg

SEQ ID NO: 37197 - DNA, 640 bp, Homo sapiens
  misc_feature: GYAE6OF01CPODM.9.21.B10.1.454.CMB.1.raw
  modified_base (403)..(403): a, c, t, g, unknown or other
  misc_feature (403)..(403): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgaccacactgatatggacattactaacttgtctccgtgtactacaacacgaccagacaacgcccacactacttaattatgacgtcactacgccgcctacgtagggttctattcgtcttctctcggctacctaatctacgacaacgccgtcctcctagacaactctcgttcggcctaccgnggtctaggacggacgaacggtctagtaactttaacgttactcgtctcgtactacgtattacgtgtacgtaaggtgtcggttacgaaccgtaccgtttacccgggttagggttacggttccggggaccgggggtaaacgggtaaaccgtaggggttaacggtaccccgttaccgggtaccggttaaccgaccgggtaaccccaagggtccccttcccgggttccccccgttacccggg

SEQ ID NO: 37198 - DNA, 627 bp, Homo sapiens
  misc_feature: GYAE6OF01B8K2W.9.21.B10.1.454.CMB.1.raw
  modified_base (200)..(200): a, c, t, g, unknown or other
  misc_feature (200)..(200): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (355)..(355): a, c, t, g, unknown or other
  misc_feature (355)..(355): n is a, c, g, or t
  modified_base (462)..(462): a, c, t, g, unknown or other
  misc_feature (462)..(462): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacngtcgatcaccatctcctgcactcggacccaccactgatatggcattataactgtctcctggtatcaacacgccagacaaacgccccanactcttaattntagagtcaacaagccgcctcgtagggttctgggtctcttctctcgcctacaagtcnggtacaacgacgtccctcctgaacaacttctcgtgggtacctaccgagtctaacgaacggaccgaggtactactaagttttactaaaccgttgccgtaaacgtctanaagtttactggtaccgttagtttaccgggtttaccctttacgtttaacaaacggtctttaagggtcccgggtaccgggaaagggtaacccgtaaggtctacgggtacccgtcgtttaagaccgtagaaccccggtaccgaaacggtcccgttcccgaccccccgg

SEQ ID NO: 37199 - DNA, 681 bp, Homo sapiens
  misc_feature: GYAE6OF01DSY9R.9.21.B10.1.454.CMB.1.raw
  modified_base (419)..(419): a, c, t, g, unknown or other
  misc_feature (419)..(419): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtcgtcgggtctccgtggaccagtcgatccaaccatcctccgtgcacgtcggaccccaccatgatagttggctattaactaacttgtctctgtactcaacaaccgccagaaccaacgccccacacttacttaattagtagacgtacacgtaacgccgccctacggtagggttctcggtcgtcttctcgtacgtacctcccgtaaagtcgtacgacaaaccgaccggtccctaccganaacctaactccgtcgtagggtcctccgtagttcgaagaaccggacggagtactagttaattacttactgactacgtctacataaccgtgtacgttggtttccgttccgtttacttaacgaacgttacgttaacgttaccgggggaccggtaacgggtaacccggaagggttcccgtacccggttaacccggttacgtagggtaaccggttaccgaacccggtacccggtaaacggttccccgtaccccgggttccccccggg

SEQ ID NO: 37200 - DNA, 620 bp, Homo sapiens
  misc_feature: GYAE6OF01BBU5C.9.21.B10.1.454.CMB.1.raw
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (321)..(321): a, c, t, g, unknown or other
  misc_feature (321)..(321): n is a, c, g, or t
  modified_base (443)..(443): a, c, t, g, unknown or other
  misc_feature (443)..(443): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctggtctctggacagtcgatcaccatctcctgcactcggaccccaccactgatagtggctattataccttgtctcctgtatcaacacgccagacaacgccccanactnttattangagcaactagcgcctgtggttcngtcgtcttcgtctcgcctcaagtcgtcggactaaccgccggtccctccgtagaacgtaacttccgtcgtcggaccttcgcgttactcggaacgacggacggtacttagtactttacgttacncgtacaacgtccgttactatacgttgccgtttaggtttcccgttttacccttacgttaccgttaagttcgttacgttacggggacggtaaccggggaccaggtccgtacgggtacccgttcccggtagtacggtacccaaccgggtcccgaacgggtcccgtacccgggtcccccgg

SEQ ID NO: 37201 - DNA, 576 bp, Homo sapiens
  misc_feature: GYAE6OF01BR5IO.9.21.B10.1.454.CMB.1.raw
  modified_base (373)..(373): a, c, t, g, unknown or other
  misc_feature (373)..(373): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcgatcaccatctcctgcactcggacccaccactgatattggctattataacttgtctctgtatcaacacgccagacaacgccccacactcttaattatgagtcactagccgcctcgtagggttctggtctcttctctgcctcgagtctcgacaacgaccggcctccgtanacatcgtcgtcggcctccagtctcggacgacgaggtcttagtactttactcgtacgtcacgtctacagttctgtacgttagtttccggttccttactttacgaagtattacgggttcgggcggtaaggggcctagggtctacggtacccgttcgtggtaccgttaccgaacgtacccgacggtcccgtcccggtaccccccgg

SEQ ID NO: 37202 - DNA, 481 bp, Homo sapiens
  misc_feature: GYAE6OF01D57MM.9.21.B10.1.454.CMB.1.raw
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (464)..(481): a, c, t, g, unknown or other
  misc_feature (464)..(481): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatcctcctgcactcggaccccaccactgatagttcgggctattaataaccttgtctcctggtatcaacacgccagacaacgccccanactcttaatttatgagtcactaagcgccctgagggtttctggtcncttctctgcctcagtcngcaacncggctccngntcacgccagcctcgcccctcggtcactctcgtccccaccttcncagactntcactgacggcggctcgggcgtaggccgctaagtgcgnnnnnnnnnnnnnnnnnn

SEQ ID NO: 37203 - DNA, 757 bp, Homo sapiens
  misc_feature: GYAE6OF01CHHW4.9.21.B10.1.454.CMB.1.raw
  modified_base (210)..(210): a, c, t, g, unknown or other
  misc_feature (210)..(210): n is a, c, g, or t
tcagtgatacgtctcacgaccggtgctcgatttagtgtcgtcgcaagagagggagggggggggtcacaagaggcagcgctcgtcgggacgtctccaccatggcctgggctctgctgctcctccaccctcctcactcaggacacgagggtccgtcgggccctgtctcgccctgactcagcctcgcctcgtgtcgtcgggtcctcgtggacngtcgactccacctactccgtcctcgactaccgtaccggacccacctacgtgtagttaggttggactaatttactaaccttgtcctacgtagtactaccaaaccgaccgaccaacgaacccaaccgaccccctaactacgtttaacttaattagacggtacgtacctaacgtaccggccgtaccgttagggtacgggtttctcgggtcttccttcgtctccgtacctacgtaacgtcgtacggaccctaaccggcccgtaccctacgtacgtactaccttccggtacggtccgggtaccttaccggacggttacgaccggtaaccgggacggtacgtctttaagggttaaactttaccgttaagccgtacgtagtacccttagtaacgtcgtacgggttacgttaccggttttcctttaccgtaattacgaacgttacggtacggtaccgggggacggtaaccgtacgtcgggtaccttccgggtaaccttcggtaacgaccggtaccaccgggtaacccgacgggttcccccttcccgggtaccccg

SEQ ID NO: 37204 - DNA, 689 bp, Homo sapiens
  misc_feature: GYAE6OF01DG7SL.9.21.B10.1.454.CMB.1.raw
  modified_base (687)..(687): a, c, t, g, unknown or other
  misc_feature (687)..(687): n is a, c, g, or t
tcagtgatacgtctcacgaccggtgctcgatttagtgtcgtcgcaagagaggagggggccctgtctgccctgactcagcctgcctccgtgtctgggtctcctggacagtcgatcaccatctcctgcactggacccaccactgatattgggcattataaccttgtctcctggtatcaacaacgccagacaacgccccacactacttaatttatgaggtcactaacgcggcctcgtagggtttctggtcgtcttctctcgcctaccaagtcgtggaccaacgaccggccctcctgaactactctcgtcggctccacgtctacgacgacggagtctagtattacttacgtgacacgtctacatactcgtcgtacggtttcggttccttcgttacgtaagtacgttacggttcgggacgggtacgggtaccgtagggtccttacgggtacccgtttccgtaggtaacgttacccgaaccggtaccccgtaacgggtcccttccccgggtacccccgttaggtacccctaccgtttcccgttaccccgtttacccctaccccgttccgtaccgaaacccgggttccttaccgttacccaccgggttacggaccgggtacccgggtcgttaccgggacccgaaaggggccctaaccggtaagttcggcttacggcgtcgcgtcgacgtgctgngc

SEQ ID NO: 37205 - DNA, 768 bp, Homo sapiens
  misc_feature: GYAE6OF01A889M.9.21.B10.1.454.CMB.1.raw
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcgatcaccatctcctgcactcggaccccaccactgatagttggactattataaccttgtctctggtatacaacaacgacccagacaaaccgccccactactacttaatttatgacgtcacgtaacgccggaccctcgtacgggtttcgtggtcgtcttcctctcgtccctaccgtaacgtccgtacggaccaaccgtacccggtcccctaccccgttacggaacctaacgttccgttaccggttccggggtacccttacccgtaacggttcccgtaacgggaaccgggtaaccgggtaacgggttaccgttacgggttaaacttttaacgtttaaccgttcggtaaccgtacggttacccttactaagttaacgttcggtaccgtttaggttttccggtttaccctttccgtttaacgtaagttaacgttacggtttaccggggaccgggtaacgggtacccggtacgggtacccgttaccgggtaacccggttccgttaaggtaccgggttacccgacccggtaacccggtaaccgggtcccgttccccgggtacccccccggg

SEQ ID NO: 37206 - DNA, 806 bp, Homo sapiens
  misc_feature: GYAE6OF01AH17B.9.21.B10.1.454.CMB.1.raw
  modified_base (205)..(205): a, c, t, g, unknown or other
  misc_feature (205)..(205): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctcaccctcctcactcaggacacagggtcctgggccctgtctgccctgactcagcctcgcctccgtgtcgtcgggtctccgtggacngtcgatccacctatcctcctgccacgtcggacccaccactgtattagttgggactaattacgttaaccttgttcctccgttggtactaccaaccaaccgacccaacgaaccaaaccgacccccaactaccttactttaatttagtacggtacggtacctaaccgtaacggcccggtccccgttacggtacggggttttccgtcgggttccgttcctttccgttccgttccgtcccgttaccgtaacggttccgtacgggaccgtaacccggacccggtaccccttacccgtacgaaccttaacgttccgttaccggttccgggtaccttccgtaacggttccgttaaccggaaccgggtaacggtacggttacgttacggttaactttaacgttaccgtcggtctacgtcctaacgtacgttaagtccgggttaacgtttcgggttttaccgtttaccttacgtttagaaacgttacggtttacgggtccggggtaacggggaaccgggtaccggtcgggttaccgttaccggtaccgtttacggtacggtaccggtaccgaaccgggtacccggcggttccccgtcccggttcccccggg

SEQ ID NO: 37207 - DNA, 815 bp, Homo sapiens
  misc_feature: GYAE6OF01B0NAG.9.21.B10.1.454.CMB.1.raw
tcagtgatacgtctcacgaccggtgctcgatttagtgtcgtcgcaagagaggaggggggggggtcacaagaggcagcgctctcgggacgtctccaccatggcctgggctctgctgctcctcaccctcctcactcaggacacagggtcctcgggccctgtcctcgccctgactcacgtccgtcgtcccttccggtcgttccggttcggggttccttccggtacgggtacctacggtaccgtaactacctaaccctacgttccttccgttcgacctaccgtaccggaaccccacgtaccgtgtaacttacggttcgggaacttaactttaacttaaccggtttcgttaccgttaccgttacgggttaacctaaccaaaccgtaaccggaaccccgaacgaaaccccgaaacccggacccccctaactaacctttaactttaagtttacgtacggtaacgtacctaacgtaaccggccgttacccggtacggtttacgggttcctggtccttcttaccttcgtaccgtccgtacgtacgtcgtacggacctaccgaccgtaccctactaacggacttaactcgttacgtccggtacctcgacgttcgacggtacggacggaccgttgtaacgttacttacgtacgtcgtacctaacggttctactaacgttcgacgttacgttccggtttacgttacctttacgttaacgttaacggttagttaaccggggtcggtaccgggtaacggtaccggtcggtacgtccggtacgttcgacgtacgccgtacgaacccggttcggtaccgtcccggtacccg

SEQ ID NO: 37208 - DNA, 758 bp, Homo sapiens
  misc_feature: GYAE6OF01EYRM2.9.21.B10.1.454.CMB.1.raw
tcagtgatacgtctcacgaccggtgctcgatttagtgtcgtcgcaagagaggagggggggggtcacaagaggcagcgctctcgggacgtctccaccatggcctggctctgctgcctcctccaccctcctcactcaggacacgagggtcctcgggccctgtctcgcctgactcacgcctcgcctcgtgtcgtggtcctccgtggacagtcgactccacctactcctccgtgaccacgtaccggacccagacgagtacgacgtagtttcggtacttacgttaattaacttacgttcgttaccttaccgttacggtaaaccaacgacgaccccgaaccgaacggtaaccctaaaacccgtacccctaaaattcctaagtagttaactttagtaaggaacgttaacaaacggtaaccgtcccggtaccgttaggttacggtttactacttcgtcttcgtacgtcgtcctaactacgtctaacgaacgtaccgccgtcctaccgagtaactcgtccgtcgcggtacccacgtacggacgtacggacggacgtagttctagtttacgttaacttcacggttcaccggtcttaacgtaattcgacgtaacgtacgttcgtacggggtaaccctaaccgttcccgggttcggtttaagggtacccgggttaggggaaccccggggtaagttaccccggtaaggggtttccccgaaaccgttcccgggtaacgacccggtaaccgacccggggtaccgttcccccgg

SEQ ID NO: 37209 - DNA, 750 bp, Homo sapiens
  misc_feature: GYAE6OF01EMNAA.9.21.B10.1.454.CMB.1.raw
  modified_base (221)..(221): a, c, t, g, unknown or other
  misc_feature (221)..(221): n is a, c, g, or t
  modified_base (559)..(559): a, c, t, g, unknown or other
  misc_feature (559)..(559): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctggccctgtctcgccctgactcagcctgccctccgtgtcgtgggttcctaccgtggactagtccgatccaacctntcctaccgtgccacgtccggaaccccacctactgagttagttcggacttaacgtttaacttaaccttcgttccttccgttaggttaactaccaaaccgtaaccgaccaacgaaccaaaccgccccctaagtaccttactttaatttacgacggtacgtaccaacgttaacggccgtacccgttacggttacgggtttctcgggtctcctttcgtcgtcgtaccctacgtaacgttcgacggaccaccgtacccgtccctactacgtaacctagtcctcgtggtacctacgtacgtcgtacggaccggtacggcgtacgtacgtaaatttcgtacgacnctacgttctaactgttaacgtcggttacgttcggtttaccgtttaccttaccgttaactaagttccggttaaccggggttacggcccggggtaaaccgaccgggttacgacccggttaacgtccccggtattacccgggaaccgttcgacccggaacccgtacccgggttcccgtccccggttacccccgg

SEQ ID NO: 37210 - DNA, 553 bp, Homo sapiens
  misc_feature: GYAE6OF01A5SR8.9.21.B10.1.454.CMB.1.raw
  modified_base (385)..(385): a, c, t, g, unknown or other
  misc_feature (385)..(385): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaacgcccccacactcttaattatgaggtcactaagcggccctcgaggggtttctggtcgcttctctgcctccaagtctggcaacacggcctcctgacatctcgnggcctcagtctgacgacgaggctgatttatactgctagctcatatgcctagtttggttcccttacgtttacaagtacttagttcgggaccggagggacccgtagggtcctcggacccggttccctggacgtcctaacggaccccgtaaagggcccttcggtccccccg

SEQ ID NO: 37211 - DNA, 708 bp, Homo sapiens
  misc_feature: GYAE6OF01BK7UV.9.21.B10.1.454.CMB.1.raw
  modified_base (597)..(597): a, c, t, g, unknown or other
  misc_feature (597)..(597): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatccacctatctcctgccacgtcggaccccaccactgatagttgggctaatttataaccttgttcctcctaggtactaccaaaccaaccgaccccaacgaaccaaaaccgccccccaactacttactttaaatttagtcggtaacggtacaacgtaacggcccggtccccgttacggtacggggttttcctcgggttccgtcctttcgttcgtcgtcccttacctaacgttctcggaccaaccgtaccggtacccttccccgtagacctaacgtcctcgtcgggtcctaccgtacgtcgtacggacgacggtagtactagtaatttacgttactgaccgtcgtctaccgtatacgttcgtacgttacgttttcggttacctttaccgtttaanaacgttagttacgtccggggcgggaaccgggtaccgacgggtccgtaccggtacccggttcgtacgaccgtacgaaccgtaccccgacggtccgtccccgggtaccccccg

SEQ ID NO: 37212 - DNA, 1063 bp, Homo sapiens
  misc_feature: GYAE6OF01BM74Z.9.21.B10.1.454.CMB.1.raw
tcagtgatacgtctcacgaccggtgctcgatttagtgtcgtcgcaagagaggaggggggggtcacaagaggcagcgctctcgggacgtctccaccatggcctgggctctgctgcctcctccaccctcctcactcgaggacacgacgggtccgtcggccctgtcctccgcctgactacacgcctcgccgtccgtgtcgtcggtcctccgtagactagtacgactaccacctacttccgtcctcgacctaccgtacccggaacccccaaccgtacgttagtaacgttacggttcgggaactttaacgtttaaactttaacccgttttcgttacccgtttaccgttaggttaaccttaaccaaaacccgaacccgaaccccgaaacggaaaacccgtaaaaccccccgccccccctaaaccttaaccgttttaaaccgttttttaaacgttttaacggtacggttaaccggttaaccctaaacggttaaacccgggaccccggtaccccggttttaaccggggtttacgggggtttttccgttacggggttaccccgtttccgttttcccgttaccggttcccgttaccccttaaccgtaacgggtttcccgtaaccgggaacccgtaaacccgtcccccggtacccccgtttccccgtaacgtaaaacctaacccgtttccggttccggtacccgggttaccccttacggtaccggtttacgaacccggtaccggaaaccgggtacgtccgttaaagtttaaccttttaacgttccgtacgaccctacgtttcctaaagttaccgtagttacgttcccggtttacgggtttttaccctttaacccgttttacgtttaaacgggaatttaaccgggttttacggggtaccccgggggtaaaaccggggtaacccgggaaacccgggtttccggtttaacccggggttacccccggtaaccccggtttttaccccgtaaggggaaacccccggttacccggtaaaacccccgggtcccggttacccgggtaaaccccgtttccccccccccgggtttaacccccggg

SEQ ID NO: 37213 - DNA, 734 bp, Homo sapiens
  misc_feature: GYAE6OF01EV71B.9.21.B10.1.454.CMB.1.raw
  modified_base (359)..(359): a, c, t, g, unknown or other
  misc_feature (359)..(359): n is a, c, g, or t
  modified_base (604)..(604): a, c, t, g, unknown or other
  misc_feature (604)..(604): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctctcactcaggacacgacgggtcctcgggccctgtctcgcccgtagactcacgtcctcgccctccgtgtcgtcgggtctcgtggacagtcgactccacctacttcctcctcgactaccgtaccgacccacctactagtacgttagttcggacttaactttacttaacctgtccttcgtaggtactacaaccaccaccaacgaacccaaccgccccaactacttacgtttaactttancgtacgtactaactacggccgtaccgttcggtacgggtttcctacggtccgttaccttccgttccgtacgtacccgtaccgtaagttcggtaccggaacgtaacccgtaacccggtccctacccgtacaaccttaactccgttcgtccgggtaccttaccggtaacgttccgtaacggtacgaacggtacgtccgttaagtttaacttacgttaaccgtcgtacggaaccttctaactaacgttntaacgttcgtttcggttacctttaccgtagttactacggtaacgttggtccgggacggtacggtacggacgtcggtaccgtcgtacggtcgtaccgtacgacccgtacgtccgtccggtccctaccccgg

SEQ ID NO: 37214 - DNA, 763 bp, Homo sapiens
  misc_feature: GYAE6OF01D1PD5.9.21.B10.1.454.CMB.1.raw
  modified_base (369)..(369): a, c, t, g, unknown or other
  misc_feature (369)..(369): n is a, c, g, or t
  modified_base (540)..(540): a, c, t, g, unknown or other
  misc_feature (540)..(540): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctcaccctcctcactcaggacacagggtcctgggccctgtctcgccctgactcagcctgcctcgtgtcgtgggtctcgtggacagtcgactcacctactctccgtgccacgtccggacccaccactgatagtggactattacttaccttgtctccgtgtatacaacaccgaccaagaaccaaccgccccactaccttactttaatttagtaggtacgtacacgtaacggccgtccgtacggttacgggttntcggtctcttcgtctcgtcctacgtacgtcgtcggactaaccgtaccggtcccttacccgacgtaactacgttcgtccggttaaccgggtcccttaccgtacggttccgaggtaaccggaccggtagggtccttaggttaactttaactacgtcggacctaggtaccttanaagttccgttacgggtaccgtttaccgggttttaccgtttttaccgtttaccgttaaacgtaacggtttacggtttaaccgggtacgggggaccggggttaaacgggtaccccgggaacggtttccccgggttacgacccgggtttacccgtcgggtaaaccgttcccccggaacggtaccccgttaacccgggccccgttccccccggggttaacccccggg

SEQ ID NO: 37215 - DNA, 777 bp, Homo sapiens
  misc_feature: GYAE6OF01CG73U.9.21.B10.1.454.CMB.1.raw
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacgacgggtcctcgggcctgtctcgccctgactcacgcctcgcctcgtgtcgtcggtctcgtgacagtcatccacctactcctcctcgacctaccgtaccgaacccacctacgtagtaattacggttcggtacttaacttttaaccgttacctttcgttacctaccgttaacggtaactaaccgaaaccgaaccgtaccaaaccgaaaccaaaccccgaccccctaattaaccgttaacctttaaatttagacggtacgtacaacgtaacggcccggttaccgtacggttggggtttactcggttacttccttaccgtctccgtacccgtacgtacgtccgtacgaacctaaccggtcccgtacctaccgtacgtaacctacgttcgtaccggtcggtacctacgtacggtacgtacccggaaccggacggtcggttactaacgtttacgttacgttaacgcgtaccgtactcgtaacttaagttccgtacggttcggtttacgtttcctttaccgttactaacgtaacgttcggtaacgggtaccgggaaccgggttaacggcgaccggtcgttacccgtaaccgtcggtaacgccgtaacggacccgtaccgttaccgggccttccccgggtacccc

SEQ ID NO: 37216 - DNA, 636 bp, Homo sapiens
  misc_feature: GYAE6OF01EDGVO.9.21.B10.1.454.CMB.1.raw
  modified_base (169)..(169): a, c, t, g, unknown or other
  misc_feature (169)..(169): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (317)..(317): a, c, t, g, unknown or other
  misc_feature (317)..(317): n is a, c, g, or t
tcagtgatacgtctcacgaccggtgctcgatttagtgtcgtcgcaagagaggaggggggtcacaagaggcagcgctctcgggacgtctccaccatggcctgggctctgctgcctcctcaccctctcactcaggacacgagggtcctgggccctgtctcgccctgactcncgcctgccctcgtgtcgtgggtctccgtggacagtcgatccacctatcctcctgccacgtcgaccccactatgattagtggactattactaccttgtctccgtgtactacgaacacgccaanaccaacnccccanacttacttattangtacgtacactacgccgtcctgtagggtttcagtccgtcttctcgtcgcctacgtaagtccgtacggaccaccgtaccggcccttaccgagaacctaaccgttctccggtcggtccctaccgtagtccgtacgacggtacgtaggtctagttactttagtacgtacggctacgtcctatagtcttacggtctttacgggtttccgtttcctacgtttaagacgttcggtaccgtacggggcgtaaccgggtaccgtcgtccgtacggtcccgttcgtagaccgtaccgacgaccccggagtccccgtccggtacccccg

SEQ ID NO: 37217 - DNA, 625 bp, Homo sapiens
  misc_feature: GYAE6OF01ANEVW.9.21.B10.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (355)..(355): a, c, t, g, unknown or other
  misc_feature (355)..(355): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacgagggtcctgggccctgtctcgccctgactcacgcctgcctccgtgtcgtcgggtctcgtggacngtcgatcaccntctctncactcgacccacactgattgtggactattacttaaccttgtcgtctaggtatacaacacgccanacaacncccctactacttattattagtgacgtacacgtacgcgtccgtcgtaggttctgtcgtctctcncgtcctacgatcgacgacaacgccgtcctccgtatactactcgtccgtggtacctacgacgtacgtacggacgacggtacgtctagttaactttagtacgtcgtacctacgtactctaacgttctcggttacgtttacgtttccgtttaccttacgtttacgtaacgttaacgttccggtacgggacggtacggtaccggtacggtccgttacggtccgtcggtacgacccgttacggacccgtacggaccgtcccggtcccgtccccgg

SEQ ID NO: 37218 - DNA, 749 bp, Homo sapiens
  misc_feature: GYAE6OF01BF3VD.9.21.B10.1.454.CMB.1.raw
tcagtgatacgtctcacgaccggtgctcgatttagtgtcgtcgcaagagaggaggggggggggtcacaagaggcagcgctctcgggacgtctccaccatggcctgggctctgctgctcctccaccctcctcactcacggacacgacgggtcctcgggccctgtctcgccctgactcagcctcgcctcggtgtcgtcgggtcctcgtggactagtcgaactcaccattcctcctcgaccacgtccggacccctaacgactgacgtagtcggactacttaacttacttcgtcctctagtatacaacgacgaccagaaccaaccgccccactacttacttaattagtgacgtactacgacgtccgcctacggtacggttctggtcctcttactctcgtcctacgtacggtctcgaacctaacgaccggtacctccgtaagtacctaacgtccgtacggtccggtaccttccgtagtacgtacggtaccggaacggtccgtacggttaacttagtttaaacgttcgaccgacttacgacgttacgtaacgtcgtaagttccgtttaacgggttttccgttccgtttaacgttaataacggtaggtttacccgggaccggggttaccgggaaaccgggtaaaccggtcgttacccgggtaccggtttacccccggagtttaacccggggaacctaccggggtaaccccggtaaccgggtacccttacccgggtcccccgtttaaaccccccggg

SEQ ID NO: 37219 - DNA, 599 bp, Homo sapiens
  misc_feature: GYAE6OF01CCAM2.9.21.B10.1.454.CMB.1.raw
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcatcaccatcnctgcactgacccacatgatactggcattactactgtctcngtatcaacacgcagacaacgccccanactcttaattatnacgtcactaacgcgcctcgtagggttctcgcgtctactcgtacgccctaccaacgtcgtcggaccaacgaccgtcccttcccagtacctaacgtcctcgtcggactccaagttcgacgtacgacgtaacggcttacgtatttaataccgtagactaacgtctaactaataacgtgaccgaacgacccacccgaataacgtcgtaccgttacggtaacggtaccgggtaaccgtaccgtaccgtacccgttacggttacgaccgaccgacccgtaaccggaaccctaaccccgacgtctccgttaaccc

SEQ ID NO: 37220 - DNA, 696 bp, Homo sapiens
  misc_feature: GYAE6OF01BVGU4.9.21.B10.1.454.CMB.1.raw
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (309)..(309): a, c, t, g, unknown or other
  misc_feature (309)..(309): n is a, c, g, or t
  modified_base (511)..(511): a, c, t, g, unknown or other
  misc_feature (511)..(511): n is a, c, g, or t
  modified_base (645)..(645): a, c, t, g, unknown or other
  misc_feature (645)..(645): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacgacgggtcctgggccctgtctcgccctgactcacgcctgcctccgtgtcgtgggtcctcgtgacacgtcgatcacnctcctctcgcnccgtcggacccactaactgtatagttcggctaagttacttacttgtcctctaggtactacaacaccgaccacgaccgaacccncccaactacttacttaaattgtcggtagtacctaacgtaacggccgtaccgttcggttacggttcgtcggtctcttctcgtctacctacgtacgtcgtcgactacccgaccgtccctactcgtaactacgttacgtcgtccggtacctcctacgtccggacggaacgtacggtacgtaccgttagttaacttacggtaccgnaccgaacgttcctagttacgtcggtcttaaccgttcgtttccgtttaaccttacgtttaacgtaacgttaccgttaggggtaccggggagtaaccggggtactccggttacgtccggtaccgttacccgggtanacccgggtacccgacgtacccggaccggttcccggttccccgtaccccggg

SEQ ID NO: 37221 - DNA, 668 bp, Homo sapiens
  misc_feature: GYAE6OF01AO9G6.9.21.B10.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (259)..(259): a, c, t, g, unknown or other
  misc_feature (259)..(259): n is a, c, g, or t
  modified_base (474)..(474): a, c, t, g, unknown or other
  misc_feature (474)..(474): n is a, c, g, or t
  modified_base (491)..(491): a, c, t, g, unknown or other
  misc_feature (491)..(491): n is a, c, g, or t
tcagtgatacgtctcacgaccggtgctcgatttagtgtcgtcgcaagagaggaggggggtcacaagaggcagcgctctcgggacgtctccaccatggcctgggctctgctgcctcctcaccctcctcactcaggacacgagggtcctgggccctgtctgccctgactcagcctgccgtccgtgtcgtgggtcctcgtggacagtcactcacntctctncacgtccgacccacatgtattgtggactattactaaccttntactcgtagtactacaaccacgcccagtaccaaaccgccccatacttactttaattagcggtaactaccgaacgaccggtccgcccgttacggtcggggtttctcggtacgtccttacgtcctcgtaccctaccgtagtccgtcgacgaaccgtccgtaccctcctacgaccttactccgtcggttccggcctcgacgttcgaccgaggcctagntagttacttacgtacgnccgtatcctaatacgagtcgttcggttaagtttccgttaccttagtaacgtagggtagttcccgggtacggggaccggtgggtaaccgtccgggtacttcccggggtacccttggggacttcccggaaacccgtacggaacccggttccggtacccccgtcccggtttaacccccgg

SEQ ID NO: 37222 - DNA, 777 bp, Homo sapiens
  misc_feature: GYAE6OF01DJ2IK.9.21.B10.1.454.CMB.1.raw
  modified_base (626)..(626): a, c, t, g, unknown or other
  misc_feature (626)..(626): n is a, c, g, or t
  modified_base (635)..(635): a, c, t, g, unknown or other
  misc_feature (635)..(635): n is a, c, g, or t
  modified_base (641)..(641): a, c, t, g, unknown or other
  misc_feature (641)..(641): n is a, c, g, or t
  modified_base (648)..(648): a, c, t, g, unknown or other
  misc_feature (648)..(648): n is a, c, g, or t
tcagtgatacgtctcacgaccggtgctcgatttagtgtcgtcgcaagagaggagggggtcaacaagaggcagcgctctcgggactctccaccatggcctgggctctgctgcctcctcaccctctcactacaggacacgcggtcgtcggcctgtctcgcctgactcgcgcctcgtcctcggtcgtcgtcgggttcctcgtacggactaggtacactaccaacgtacttcctccgtacgtaccgaaccggtcccgaaccccaactacggtaagttagttacggtcggtacttaacgttttaacttaccgtttcgtaccgttcgtacgttaacaaacgaaaccgaccgaccgaagaaacccaaacccctccccaaactttaacctttaactttaagttttacgacggttaacggtacctaaaccggtaacggtcccggttacccggttacgggtttaccgggtttcggttcggttaccttcctttcggttacgtcccgtaaccgttaaccgacgtttccggaaccggttacccaaaccggtccgtcccctacggttaacaacctaccttcgcggtaccggtcctacgttagcgtacggaagtaacggtatcttaacgttattcgacgtnacgttaacncgtaanaggttcncgttaacggttgttaccgttctttaacgtaagtacgttaggttaccgtcgggaggtaccggacgtacgtccggtacggcctttacggactacgtaccggtaacgtccggacgtccccgtccgttacccg

SEQ ID NO: 37223 - DNA, 745 bp, Homo sapiens
  misc_feature: GYAE6OF01CJX8T.9.21.B10.1.454.CMB.1.raw
  modified_base (168)..(168): a, c, t, g, unknown or other
  misc_feature (168)..(168): n is a, c, g, or t
  modified_base (229)..(229): a, c, t, g, unknown or other
  misc_feature (229)..(229): n is a, c, g, or t
  modified_base (365)..(365): a, c, t, g, unknown or other
  misc_feature (365)..(365): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactnagcctgccctccgtgtctgggtctcctggacagtcgatcaccatctcctgcactggaaccngtcagttgatggttgggagttatgtaccttgtctcctggtaaccaacaggccacccgaggacaaacggcccccaaatcatctaatttacagtacggtcacgtaacgcggtccctagacgggttttctacgttccgnttctcgtcggtcctccgtaagtacgtcgaaccgtaaaccgaccggtcccctacccgtgtacctaaacgttccgttacgtcggggttccctacccgtaagggtcccgttaaggggaacgggtaacgggcgggttaccgttaaggttaaccgttaagttttaacccgtcggtaccttaccgggtcttacctaacgttagttacggggtcctaaaggtacggtttacggggaccgttaaccggacccggtttaacccggttcgggggttatttacccggggggaccggtaaacggggtaccccgaaagggttccggtaaaccccggttaccgttacgggttaccaacccgggtaccccgaaacgggtcccggttacccccggg

SEQ ID NO: 37224 - DNA, 623 bp, Homo sapiens
  misc_feature: GYAE6OF01B3F7Y.9.21.B10.1.454.CMB.1.raw
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacngtcgatcacatctctgctactgacccacacgtgatagttggactagttataaccttgtctcctggtatacaacacgccagaacaacgccccanactacttaattatgagtcactaacgcgcctagtgggttactcgtcncgttctctctctacagtcncggtacaacgccgtcctccgtagacatctcgtcggcctccgtattcgcggaacgtacggacggtcttacgtagtttaactacgttgaccgtatccgtataagtatggtacttcggtttcgttacctttacttaacgaagtacgttaacggttccggaggggtaaaccggccggtaacggtcccgttaagggtacccccgtacggttagtacggtaaccgtaccgtaccccgggtaaacgttccccgtacccggttaaccccccggg

SEQ ID NO: 37225 - DNA, 737 bp, Homo sapiens
  misc_feature: GYAE6OF01AS2YI.9.21.B10.1.454.CMB.1.raw
  modified_base (609)..(609): a, c, t, g, unknown or other
  misc_feature (609)..(609): n is a, c, g, or t
  modified_base (709)..(709): a, c, t, g, unknown or other
  misc_feature (709)..(709): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctccaccctcctcactcacggacacgagggtccgtgggtccctgtctcgtccttgactcagcctgcctccgtgtcgtgggtcctacgtcggactagtcgaacgtcaacctctccgtcctggaccaccgtccggacccctaaccactgtaagttcgtcggtacctatttaaccttaaccgttcggtaccttcgtagtacttaccaaccgacccgaccgaactaaccaaccctacccccctaacttaccttaaacttttaacgtttacgtacgggtataacctaacgtaccggtcccggcccgttacgttaggggtttccgtcggttccgtcctttccgtacccgtcgtacccgtcttaaacgtccggtacggaccaacggtcccccggaccctaccgttcgaactaactccgtcgtaaccggtctaccctcggttactaccgtagacggtacgtcttacgttaattcgtccgacgtacgactacgtataggtcnccttaaggttccgttcgtttcttacggttcaattcgtaccggttgggaccggtcgaacggtcttccggaccggttctaccggagtttacccgcggacccncccggtaacgtccccgtacccggtcccg

SEQ ID NO: 37226 - DNA, 836 bp, Homo sapiens
  misc_feature: GYAE6OF01C5T93.9.21.B10.1.454.CMB.1.raw
  modified_base (240)..(240): a, c, t, g, unknown or other
  misc_feature (240)..(240): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtccgtgggccctgtctgccctgactcagcctcgcctccgtgtcgtgggtctccgtggacagtcgactccacatctcctgacacgtcgacccaaccnctagtatagtcggacctaattaacttaccgttacgttcgtccgtacggtactacaaaccgaccgaccaacggaaccaaaccgccccctaaactacttaacgtttaacttagtacgtaacggttaccgtaactaaccggtcccggtccccgttacggtacggggtttccgtcggttcttccgtttcgtcgttccgaccttaacccgtaaccgtacccgtactaacccggtacccgtcccttaccgacgtaaccgttactaccgtccggtacggtacccaccgtaagtacggtacgggtaacggtacgacgtttacctaacgttactttaagtttacccgtgtactacttaacgtaagttaccgtaaaggtaccggtttaaagggtttaggtttacggggtttaggttccgggtacggggtaaccggggtaccgggtaaaccggtaacgttccgggtaaccgggtaccgttaacccgggtaccgggtaaaccgccccgggaaaaccccgggtttcgggaaacccccccgtttccggtacccccgggttttaccgttaaccgtttccctttccccgtttaaacccccgtccccccccgg

SEQ ID NO: 37227 - DNA, 756 bp, Homo sapiens
  misc_feature: GYAE6OF01EW82A.9.21.B10.1.454.CMB.1.raw
tcagtgatacgtctcacgaccggtgctcgatttagtgtcgtcgcaagagaggagggggggggtcacaagaggcagcgctctcgggacgtctccaccatggcctgggctctgctgctcctcaccctctcactcaggcacgagggtcctgggccctgtctgccctgactcagcctgccctccgtgtcgtgggtctccgtaggactagtcgataccacctatcctcctgactacgtcggaaccccaccgtactagattagttcgggactaacgtttaactaaccgtttgtccttccgtaggtactaccaaacctaaccgacccgaaacgaaacctaaacccgacccccctaacgtaaccttactttaaaattacgtcggtaacgtaccaacggtaacgccggtcccgttaggtacgggtttccgtcggtctcctttctccgtccgtccctaccgtaagtacgacggaccaaccgtacccggcccttaccaggtaccctaacttccgtacggtccggtaccgtcccgtaggttcccgtaacggaaccgtacggtacggtaccgttaacgttaagtttaccttacgtgttaccgtactaccgttactaagtacgtacgacgtaggtaccgttggacccgaccgtaccgttccggttaggtaccggtaccgggcggggtaaacgtaccgtaaggggttcccgaccgttccgaaccgtcccgaacgacccgtaacgtcccggttaccccgtcccggttaaccg

SEQ ID NO: 37228 - DNA, 825 bp, Homo sapiens
  misc_feature: GYAE6OF01D6WEH.9.21.B10.1.454.CMB.1.raw
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacgagggtcctgggccctgtctcgccctgactcagtcctcgcctccgtgtcgtgggtctccgtggactgtcgactccaccacttcctccgtgctaccgtcggaacccaccgtactgtaacttagttcgggactaatttaactaaccgttgtcctccgttaggtactacctaacgtaaccgaccaagaacctaaacccgacccctaacgtaccttaactttaactttacgtaggtacgttaacgtaaccgtaacggacccggttacccgttacggttacggggttttaccgtcgggttccgtcctttccgtcctcgtaccctaaccgtacggtcgtaccggaacctaacccgtacccgtacccctccgtacgaacttaacgtccgttacggtacggtaccctacgtacgttacggtaacgtaccgggaacggtacgtaccgttaaggtaactttacgtacgtacgtaccgacggttactaaccgttgttaacgtccggttaacgtttacgtttccggtttacctttaacgttaacggttacgttaacggttcgggtaaccggggtaccgggtaaccgggtaccgtacggtaccgggttaaccggtacccggtttaccgtaacgggttaccgtaaccccggaaccggttaccccggaacccgggttccccgtccccggttaacccccggg

SEQ ID NO: 37229 - DNA, 696 bp, Homo sapiens
  misc_feature: GYAE6OF01DC97H.9.21.B10.1.454.CMB.1.raw
  modified_base (212)..(212): a, c, t, g, unknown or other
  misc_feature (212)..(212): n is a, c, g, or t
  modified_base (562)..(562): a, c, t, g, unknown or other
  misc_feature (562)..(562): n is a, c, g, or t
tcagtgatacgtctcacgaccggtgctcgatttagtgtcgtcgcaagagaggagggggggggtcacaagaggcagcgctcgtcgggacgtctccaccatggcctgggctctgctgcctcctcaccctcctcactcaggacacgacgggtcctcgggccctgtcctcgccctgactcacgtcctcgcctcgtgtcgtcggtcctccgtggacngtcgactccacctagtcctccgtgaccacgtccggaacccaccgactagtagttacggttcggacttaaatttacctaccgtttcgtccttacgtagttacaccaaaccgaccgaccaacgaaaccaacccgtacccccaattaacctttactttaaacgtttacgacggtaacgttactaaccggtaacggcccgtacccgttcggttacgggtttctcggtctcttctcgtcgcctaccgtgtccgtgaaccaccgtcccgtcctaccacgtaaactcgtctcggcggtacctacgtcgttcgacggacgtacggcgtacttacgttactttacgacgtcgaaccgtntacctatcgtacgtagttccgtttaccgtttcgttccttacttagaacgttggtccgacggggtcgaaccggtacgcgttaccgtccgaccgttgtacggcgtacccacggtaccgccgtccgtccccgtccgg

SEQ ID NO: 37230 - DNA, 756 bp, Homo sapiens
  misc_feature: GYAE6OF01DFD3V.9.21.B10.1.454.CMB.1.raw
  modified_base (606)..(606): a, c, t, g, unknown or other
  misc_feature (606)..(606): n is a, c, g, or t
  modified_base (713)..(713): a, c, t, g, unknown or other
  misc_feature (713)..(713): n is a, c, g, or t
tcagtgatacgtctcacgaccggtgctcgatttagtgtcgtcgcaagagaggagggggggggtcacaagaggcagcgctctcgggacgtctccaccatggcctggctctgctgctcctcaccctcctcactcgaggacacagggtcctgggccctgtctcgacccgtgactcagcctcgcctcgtgtcgtcgggtctccgtggacagtcgatcacatcgtctgccacgtcggaccccactactagtatacgttggaccttaatttaacttaacctttcgttaccttaccgttaggtaactaaccaaccaaaccggaccccaacggaacccaaaaccccgtacccccctaacctaacctttaacttttaaacgtttaacgtcgtaacggttaacctaacggtaaccgtccggtaccccggttacgggttacggggttttaccgtcgggttccttcgtttcccgttacgttccgtccctaaccggtagtcccggttacgaaccgtaacgcccgtcccttcccggacgtaacctaacgttccgtccgtccgtacgtacccgtaggttccgacggacggacgtacggcgtttagtaacttacgtttccgnggtactacggtactactacgtgtacgtacgtttcgttacgttcttacttagtacgtacgttaggtaccgggtggaaccggtagtcggtaccgtacggtcccgtacgngtaccgtaccgacccgtagacccggtccgtcccggtaccccgg

SEQ ID NO: 37231 - DNA, 698 bp, Homo sapiens
  misc_feature: GYAE6OF01AQ4D0.9.21.B10.1.454.CMB.1.raw
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtcgtggtctcctggacagtcgatcaccatctcctgccacgtcggaccctaccactaggatacgttgggactattaactaaccgttgtcctcctaggtataccaacaaccgaccagaacaacgccccacacttacttattatgacgtacaactaagcggaccgtcgtacggtttcgtagtcctacgttcgtactcgctaaccagtttcgcgacgtaaccgtaccgtccctacccgacgaactaacgttccgtacgtccgggtacttccgagtacgttcgaaaccggtacggtaacggtaccgtttagtaaacgttttctaacggttacgtaaccgaaactcggttaacctaagtactacgggctttaagggttccgtaacgtacgttcccgtaccgggttaggtaacgttccggggaacgggtaacgggaacctaagggggtaccctacggtaccggtaccgttaccgaacgggtcccaaacgggttccctaaccgggtcccccgttggttaccccg

SEQ ID NO: 37232 - DNA, 777 bp, Homo sapiens
  misc_feature: GYAE6OF01AM698.9.21.B10.1.454.CMB.1.raw
  modified_base (209)..(209): a, c, t, g, unknown or other
  misc_feature (209)..(209): n is a, c, g, or t
  modified_base (422)..(422): a, c, t, g, unknown or other
  misc_feature (422)..(422): n is a, c, g, or t
  modified_base (464)..(464): a, c, t, g, unknown or other
  misc_feature (464)..(464): n is a, c, g, or t
tcagtgatacgtctcacgaccggtgctcgatttagtgtcgtcgcaagagaggaggggggggtcacaagaggcagcgctctcgggacgtctccaccatcggcctgggctctgctgctcctcaccctcctcactcgacggacacgagggtcctcgggccctgtctcgccctgactcagcctgtccctcgtgtcgtcggttctccgtagacncgtgaactccacctacgtcctcctgactaccggaccgacccacctactggtacttagttcggacttaatttaaccttaaccgttcgtccttacgtacgtactaaccgaaaccgacccgaccaacgaaaccaccacccccgtaactaccgttatttaaacgttcgtaggtacgtaccaacgtacgcccgtacgtcggttaggttcgtgtccctnttacctccgtccgtactaccgtattcggacaccggtaacccnccgtaccggtccctataaacccgtcgttaccgtacggtcgttacccggtacttaacgtccgttaacgggaaccgttaccgggattacgtaccgtttaaatttccggtctacgaccgtcggtcctaaagttaccgtagtttacggtccgtttaaccggtttcccgtttaacccttacgttaacgtacgttaacgggtccggttaacgggaccggggtacgaaccgtcccgggttaacggttccccggttcgttacccggaagttcggaacccggtacctaacccggggctacccccgttccggttaacccccgg

SEQ ID NO: 37233 - DNA, 717 bp, Homo sapiens
  misc_feature: GYAE6OF02HFLEX.9.21.B10.1.454.CMB.1.raw
  modified_base (104)..(104): a, c, t, g, unknown or other
  misc_feature (104)..(104): n is a, c, g, or t
  modified_base (179)..(179): a, c, t, g, unknown or other
  misc_feature (179)..(179): n is a, c, g, or t
  modified_base (352)..(352): a, c, t, g, unknown or other
  misc_feature (352)..(352): n is a, c, g, or t
tcagtgatacgtctcacgaccggtgctcgatttagtgtcgtcgcaagaggaaggaggggggggtcacgaagaggcagtcgctctcgggacgtctccgaaccggnttggcctgggctctgctgctcctcaccctcctcaactacaggacacagggtctgggtcctgtctgcctgactcgngcctgcctcggtgtcgtcgggtctcctggacagtcgatccacgatccgtcctggcctacgtcgggaacccaccgtacgtcggaacttacgttcgggcctacttactaaccttgtcttccttggtactcgaactaccgccagaccaaacgccccacacttactttaatttacgnggtacggtcaactaacgccgccctcgtaggggtttcgtcggtcgtcttcgtcgtcgaccttacctaacgtcgtagggacaacgtaccggtccctaccgtacgaacctaacttacgtaccgtcgggcctaccgacgttcgttacggaccggtaacggacggtactacgaaactttaacttaaccgttcggacctacgtccttacctaagttacgttccgtaccgttagggttttccggttacccttcgttttacgaaacgttacgttacgtttcgggcgggtaacgggtaccctagggtccttacgggacccgttccgtaggtacggtccgacggtacccggtacgggttccgttccggtccccgg

SEQ ID NO: 37234 - DNA, 613 bp, Homo sapiens
  misc_feature: GYAE6OF02JW5P7.9.21.B10.1.454.CMB.1.raw
  modified_base (396)..(396): a, c, t, g, unknown or other
  misc_feature (396)..(396): n is a, c, g, or t
  modified_base (442)..(442): a, c, t, g, unknown or other
  misc_feature (442)..(442): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctcgtgtctgggtctccgtggacagtcgatcaccatctcctgcactggacccacgactgatagttgggctattataaccttgtacctcctggtatcaacaacgccagacaacgccccacactcttaattagtgacggtacacgtaagccgacctctacgggttactcggtcgtctctacgtcgcgtacagtctacggtcaacacgtcctcctgaacactcncgtggacctcagtcgtacgacgtacgaggtctagtatttacttcgngcgtacgctacgtactagtcgtacgttacgtttccggttactttccgttaacaaagtaacggtttacgttccgggacggtaacgggtaccgtcggtaacgtttccggaacccgttcggttacgtaccgttccgaccgtaccccgtaacgggtccgttacccgtacccccgg

SEQ ID NO: 37235 - DNA, 655 bp, Homo sapiens
  misc_feature: GYAE6OF02H0THM.9.21.B10.1.454.CMB.1.raw
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcgatcaccatctctgcactcggacccaccactgatagttgggcattataaccttgtctcctggtactacaacaaccgccagaaccaaacgccccactacttacttaattatgagtacaactaagccggccctcgtagggtttctggtcgtcttctctcgcctactaagtctcggacaacgaccggtccctccgtgaactactcgtcgtcgggcctccgagtcctaggaaccgtacggaggtcctagttaactttacttacgtggacctagtcctactaagttagtccgtacgtttacggtttccggtttccctttaccgttttaacgaaacgtttacgttacggttccgggacgggtacgggtaacccgcggtccgtacggtaaccccggtttcgtacggtacggtaccgaaccgggtaacccgtaacgggtccttaccccggtacccccgg

SEQ ID NO: 37236 - DNA, 658 bp, Homo sapiens
  misc_feature: GYAE6OF02H15N0.9.21.B10.1.454.CMB.1.raw
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactcggacccaccactgatagtgggactattataaccttgtctcctggtactcaacaaccgccagaacaaacgccccacactacttaatttactgaggtacacgtaacgccggtacctcgtagggtttctggtcgtcttctactcgcctaccgaagttctcggacaaccgtacggtccctccgtacgacctaacttcctcgtcgggtctacccgtagtcctaggaccgacggtaggtccttaggtaactttacgttaacgtcgtacgagtcctaactaattactcggtacgttacggtttcggtttaccccttattttaccgaaacgttaacttaacggttccgggtaccgggtaacggaaccggtcggaccgttcggtaacccgtccgttacggacgttaccgaccggacccgtaacggtcccgtacccgttcccccgg

SEQ ID NO: 37237 - DNA, 540 bp, Homo sapiens
  misc_feature: GYAE6OF02ID77C.9.21.B10.1.454.CMB.1.raw
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (533)..(534): a, c, t, g, unknown or other
  misc_feature (533)..(534): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacgaggtcctgggccctgtctgccctgactcagcctgcctccgtgtctgggtctcgtgacagtcgatcacatctcctgcactcggaccaccactgatagttggcaattataaccttgtctcctggtactcaacacgaccagacaaacgcccacacttacttaattangacgtacactaacgcgcctcgtaggttcgtggtctnttctctcgcctcgtaancgtagacacgaccgtcctcccgtgacgtcacgacccgagccgtcccgccccgtcggtctacctccgtccgttccctccttccgtacagtactactacgactacggacggcggtcgtacggaccgtacggaccgacgtaagtacggactgactcacgcgcncngcncgacncgngnngangnc

SEQ ID NO: 37238 - DNA, 690 bp, Homo sapiens
  misc_feature: GYAE6OF02FHHCN.9.21.B10.1.454.CMB.1.raw
  modified_base (325)..(325): a, c, t, g, unknown or other
  misc_feature (325)..(325): n is a, c, g, or t
  modified_base (407)..(407): a, c, t, g, unknown or other
  misc_feature (407)..(407): n is a, c, g, or t
tcagtgatacgtctcacgaccggtgctcgatttagtgtcgtcgcaagtaggtaggagggggggtcacgaagaggcagcgctctcgggacgtctccaccgactggcctgggctctggctgctcctcaccctctcactcgaggacacagggtcctgggaccctgtctgccctgacctcagcctgcctccgtgtctgggtctaccgtggacagtcgatcaccatcctctgccgactcggacccacactgactacttgggtactattactaaccttgtctccgtaggtaacttccgaaccaacgcccaaggaaccaaacgcccccgtanaccttacgttaactttagtcgtaggtaccaacgtaacggccgggtccccttagacggggttttcgtggtaccgtcgtttccncgtcgccttccgaaaggtcctaggacctaaccgaccggtcccttacccgtacgacctaagtccgttcgtcgggtacctccgaaaggttccgtacggtaacgtacggacggtacttagttaactttactaacgttcgactaagttcctaacgtaacgttcgacgacgttacgtttcggttaccctttacgtttaacaaagtattacggtccgggacggaccggactacgggtctacggtaccgtcttcggactccgtaccgcccgtaggtcctccggtaccccg

SEQ ID NO: 37239 - DNA, 702 bp, Homo sapiens
  misc_feature: GYAE6OF02JTAJO.9.21.B10.1.454.CMB.1.raw
  modified_base (544)..(544): a, c, t, g, unknown or other
  misc_feature (544)..(544): n is a, c, g, or t
  modified_base (667)..(667): a, c, t, g, unknown or other
  misc_feature (667)..(667): n is a, c, g, or t
tcagtgatacgtctcacgaccggtgctcgatttagtgtcgtcgcaagagaggaggggggtcacaagaggcagcgctctcgggacgtctccaccatggcctgggctctgctgctcctcaccctctcactcaggacacagggtcctgggcctgtctcgccctgactcagcctcgcctcgtgtcgtgggtcctccgtggacacgtgactcaccatcctcctgcctacgtacgacccacctactaggtattaggttcggactaactttacttaccgttcgtcttaccggtacgttaactaccgaaaccaccgacccgaaacgaacccaaaccgcccccaactacgttaactttaacttagtacggtacggttaacctacggtaacgccggtacccgttaggttcgggtttcgtcgtccgttcttccgtactcctacctacgtagttcccgtacgaacaaccgtcccggttccctacgtactaactaactccgtcgtcgtccgtctacggtcgtacggaacgaccgtgacctttagtacttcgttaccnggtactacgttctacttgtaactcgttaattcgttttaccgtctttactacgtacggtacgtacgggtacgtacgggtacgtacgggcgttccttcgacccggttagtccgaacgggttcccncggtaacccggtccgtaccggtcccccgtacccgg

SEQ ID NO: 37240 - DNA, 752 bp, Homo sapiens
  misc_feature: GYAE6OF02J05WQ.9.21.B10.1.454.CMB.1.raw
  modified_base (242)..(242): a, c, t, g, unknown or other
  misc_feature (242)..(242): n is a, c, g, or t
  modified_base (652)..(652): a, c, t, g, unknown or other
  misc_feature (652)..(652): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacgcgagggtcctgggcccagtctcgccctgactcacgtcctgcctccgtgtctcgcgtcctccgtggacagtcgatccacctattcctcctgcacgtcggaaccngtactagttgggttacttttaacgtgtcctccgtacgtaaccaacaccaccgagaccaaaccgaccccctaaactcatagtactttagacgtaacgttacaacgttaaccggccggtacccgggtacggggttacttttcgcgtcctaccgtctacctcgtcgcctaccgtacgtcctaacgaccgacccgtccttacccgtagtaacctaattcccgtacgggtcggtacctaaccgtaacggtaccggttagggaacccggggtacggttacgtaccttaacgttaacggttttagttaaccgttgttaccgactttactactaacgtacggtaggtttaaaggtttacgttacgggtttaaggggttccggtaacggggtacgggaacggtaccctaggttacccgngtaccccggtcgtaacggtccgaaccggtaccgaacggtccccgttcccgacccggttcgtacccgtcccttccgggttacccctaccccgtacccgtcg

SEQ ID NO: 37241 - DNA, 601 bp, Homo sapiens
  misc_feature: GYAE6OF02FINT5.9.21.B10.1.454.CMB.1.raw
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (299)..(300): a, c, t, g, unknown or other
  misc_feature (299)..(300): n is a, c, g, or t
  modified_base (329)..(329): a, c, t, g, unknown or other
  misc_feature (329)..(329): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatcctcctgcactggaccccacnctgatagtggcattanaaccttgtctcctggatacaacacgccagacaacnccccanctctaattannagtcatacgcgcctgagggtttctggtcncttctctcgcctacagtctggcaacgaccggtccctcccgtgaaccaattccgtcgtcggcctcgacgtctcgacgacgagctgtattacttacncgcagtctnaagtcngtacgtagtttcggttaccttcgttacctaaagtctttacgttaccggacgggaaccgggtaccgaaacggggtccgtaccggtaacccggtttaccgtacgggtacggttaccctaaccgggaccccgtaacgggttccctccccgggttaacccccccgg

SEQ ID NO: 37242 - DNA, 706 bp, Homo sapiens
  misc_feature: GYAE6OF02J2J0H.9.21.B10.1.454.CMB.1.raw
  modified_base (142)..(142): a, c, t, g, unknown or other
  misc_feature (142)..(142): n is a, c, g, or t
  modified_base (230)..(230): a, c, t, g, unknown or other
  misc_feature (230)..(230): n is a, c, g, or t
  modified_base (341)..(341): a, c, t, g, unknown or other
  misc_feature (341)..(341): n is a, c, g, or t
  modified_base (557)..(557): a, c, t, g, unknown or other
  misc_feature (557)..(557): n is a, c, g, or t
  modified_base (567)..(567): a, c, t, g, unknown or other
  misc_feature (567)..(567): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggactacgnggtcctcggcccttgtcctcgccctgactcagcctcgccctcgtgtcgtgggtcctccgtggacgagtcgactccacctatcctccgnaccgtcgtaccggaccccacctgttagtacgtggttacggcttaattaaccgttaccgttctccgtacttcggtactaaccgaaccgaacccgccaaacgacccaaacccnccccctactacgtttaacgtttaacttagaggttaccgtaccgaacgtacccggtccgtaccgttacggtcggttccgtcgtccgttctctacgtccgacctacgtactccgtacggaacctaccgtacccgtcctccggtaactactacgtccgtccgtcggtaccttacgtcgtaccgtgaccgtacgtgtacgtattcgttaacttcgcgacncgtctacgtntccggtactcgttaccgttcttaccgttacttcggtaaatcggtacgggtaccggagtaccggtcgtaccgttcgtaccggttccgtacgtcgtaacgtccccgtaaaggtcccgacgttacccggtaccccgttaccg

SEQ ID NO: 37243 - DNA, 521 bp, Homo sapiens
  misc_feature: GYAE6OF01C2A92.44.19.B08.1.454.CMB.1.raw
  modified_base (423)..(423): a, c, t, g, unknown or other
  misc_feature (423)..(423): n is a, c, g, or t
  modified_base (467)..(467): a, c, t, g, unknown or other
  misc_feature (467)..(467): n is a, c, g, or t
  modified_base (513)..(513): a, c, t, g, unknown or other
  misc_feature (513)..(513): n is a, c, g, or t
tcagacagtatatacacgaccggtgctcgatttagtgagtcagtaagggggagaggagcccagccttgggattcccaggtgtttcattcagtgatcaggactgaacacagaggactcaccatggagtttgggctgagctggattttccttgctgctattttaaaaggtgtccagtgtgaggtgcagttggtggagtctgggggaggtttgggtaaagcctggggagtcccttagactctcctgtgcagcctctggattcacttttcagtaacgcctggatgacctgggtccgccaggctcaggaagggctggagtgggtggccgtattagaaccaaagctgacggtggacagcagactacgctgcacccgtgaaaggcagattcaccatctcaagagatgaattacaaaagatacggtgtctntgcagatgaacagctgaacaccgaggacacagcctactattacngtctggatggttcattgggccagggaaccctggcaccgtctcctcngcctaccg

SEQ ID NO: 37244 - DNA, 582 bp, Homo sapiens
  misc_feature: GYAE6OF01B7BDX.44.19.B08.1.454.CMB.1.raw
  modified_base (296)..(296): a, c, t, g, unknown or other
  misc_feature (296)..(296): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccncaggctccgagggagggctggagtgggtggccgtatagaacaagctggacggtggacagcagactacgctcgcaccggtgaaacggcaagacttccaccatcctacaagagatgaattacaaaagtntaacggtntactctgcaagatagaacacgcctagaaccaccggagaaccacgacgaccgtactacttctggtcgtgggtattggttactaggttccgggaccgtaacggggtacccttcggtaccctacccgtcctaccctccgacgtccccgtacccg

SEQ ID NO: 37245 - DNA, 561 bp, Homo sapiens
  misc_feature: GYAE6OF01ANPI0.44.19.B08.1.454.CMB.1.raw
  modified_base (460)..(460): a, c, t, g, unknown or other
  misc_feature (460)..(460): n is a, c, g, or t
tcagacagtatatacacgaccggtgctcgatttagtgagtcagtaagggggggtctcaggaggcagcgctctcgggacgtctccaccatgggccctgggcgtccggtcgtcggtacttaccggtccgacccctaccttacgactcagggcacagggtcctgggcccagtctgccctgactcagcctgcctccgtgtctgggtcacctggacagtcgatcaccatctcctgcactggaaccagcaatttcattggtaatcatgactatgtctcctggtaccagcatcacccaggcacacgcccccagactcgtgatttttgaggtcaataagcgcccctgacgggtcccgatcggttctctggctccaagtctggcacacggcctccctgaccgtctcgtcgggctccgaggctgacgactgaggctagattattactgcacgctcgagtggagccacctntgtactttgtcgttttcggcggtaggtccacgtcgtcggaccgtccgtaggtccgacgtacccgaacggtccgtccgcccccgtacgtccgaccgttcccg

SEQ ID NO: 37246 - DNA, 561 bp, Homo sapiens
  misc_feature: GYAE6OF01C5PJA.44.19.B08.1.454.CMB.1.raw
  modified_base (329)..(329): a, c, t, g, unknown or other
  misc_feature (329)..(329): n is a, c, g, or t
  modified_base (412)..(412): a, c, t, g, unknown or other
  misc_feature (412)..(412): n is a, c, g, or t
tcagacagtatatacacgaccggtgctcgatttagtgagtcagtaagggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacattggtgttataactatgtctctgtaccaacaacaccaggacaaacgccccaaatcatgattcatgatgtcagtaactcggcctgaggggtttctgggtcncttctctggctcaagtctggacaacacggcctccctgaccatctctggctcgaggctggaggacgaggctagaactagttacngacagctacgaattaaacgaaaagaacgacaaactacttaggttaatagttacgggacggaagggacccaaaggctacggacccgtactacggtccaacggaccccgaaaggtccctacccgaccccccgttcggtccaccgtttcccg

SEQ ID NO: 37247 - DNA, 540 bp, Homo sapiens
  misc_feature: GYAE6OF01CDIZV.44.19.B08.1.454.CMB.1.raw
tcagacagtatatacacgaccggtgctcgatttagtgagtcagtaagggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacatttggtggttataactatgtctcctggtaccaacaacaccaggcaaacgccccaaactcatgattcatgatgtcagtaatcggccctcgaggggtttctggtcgcttctctggctcaagtctggcaacacggcctcctgaccatctctcgggctccaggctgaggacgaggctgactattactgcagctcaataataaaagaagacaaactacttagttatacgttcggacggtaacgggaccaagctacggaccgtaccgtaggttccacgacccgaaggtcctacgcccccgtcggtccaccgttcccg

SEQ ID NO: 37248 - DNA, 555 bp, Homo sapiens
  misc_feature: GYAE6OF01AHNH1.44.19.B08.1.454.CMB.1.raw
  modified_base (166)..(166): a, c, t, g, unknown or other
  misc_feature (166)..(166): n is a, c, g, or t
  modified_base (252)..(252): a, c, t, g, unknown or other
  misc_feature (252)..(252): n is a, c, g, or t
  modified_base (286)..(286): a, c, t, g, unknown or other
  misc_feature (286)..(286): n is a, c, g, or t
  modified_base (386)..(386): a, c, t, g, unknown or other
  misc_feature (386)..(386): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
tcagacagtatatacacgaccggtgctcgatttagtgagtcagtaaggggggagaggagccccagccttgggattcccaggtgtttcattcagtgatcaggactgaacacagaggactcaccatggagtttgggctgagctggatttcctgctgctatttaaaggngtccagtgtgaggtgcaggttggtggagtcgtgggggagtttggtaaagcctggggagtcccttaggactctcctgtgcagcctcnggattcactttcagtacgctggatgactgggccncaggctcgagggagggctggagtgggtgcgtatacgaacaagctgacggtggacagcagactacgctgcaccggtagaaaggcagacttcacctatctanaagagatgtattacaaaagtgtacggtntctntgcagatagaacngcagaacacgagacacgagccgttatattactgtcgtagggtattcggtttacaggttccgggaccgtaacggggtaaccccttgggtacccgtacccgttctcccgtacgccgtcccctaccg

SEQ ID NO: 37249 - DNA, 639 bp, Homo sapiens
  misc_feature: GYAE6OF01BEGXW.44.19.B08.1.454.CMB.1.raw
  modified_base (177)..(177): a, c, t, g, unknown or other
  misc_feature (177)..(177): n is a, c, g, or t
  modified_base (264)..(264): a, c, t, g, unknown or other
  misc_feature (264)..(264): n is a, c, g, or t
tcagacagtatatacacgaccggtgctcgatttagtgagtcagtaagggtaaaggggatcaggacttctcagttcagtcttctcaccatgaggctccctgctcagctccttggggctgctaatgctctggatcccgtggacccaggtgcagatgttgtgctgacccagactcccctntctctgtccgtcaccccgtggacaggccggcctccatcgtcctgcaagtctagtcagagtccttcctcgacaatagtgattggaaanctatattgtactaggtacctgcagacggtacaggtccagttcctccggctacgcctcctctacgttcctaatgtactttctttacgaacgtccgtccttcgtcgtaggtagttcgacttagtacttacggttcaggtcggacgtacgggtccggggttacggggactaggtactttacgaactacgtagaaactcgtaacggtccgggtaggacggcgtaggacggtaagttggttaggtaattttacgttacgtgtacgtagtcggacgtaaggtcgtagttaccgtaccggtttaccccggaccgtttacgggacccggtaacggggtacccgtaggggtacgtaaacgtacgaaggtcgtaacgtggtacgg

SEQ ID NO: 37250 - DNA, 543 bp, Homo sapiens
  misc_feature: GYAE6OF01EPLQK.44.19.B08.1.454.CMB.1.raw
  modified_base (409)..(409): a, c, t, g, unknown or other
  misc_feature (409)..(409): n is a, c, g, or t
  modified_base (428)..(428): a, c, t, g, unknown or other
  misc_feature (428)..(428): n is a, c, g, or t
tcagacagtatatacacgaccggtgctcgatttagtgagtcagtaagggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacattggtggttataactatgtctcctggtaccaacaacacccaggacaaacgcccccaaatcatgattcatgatgtcagtatcggcctgagggtttctggtcgcttctctggctccaagtctgcaacgacgcctccctgaccatctcgtcggctccgagctgaggacgagctgactattacngcagctacataataaaganacaatacttagttactagttacgggacggtacggaaccaagcctacggacccgttccgtaaggtccaacgacccgaacggtcctacccggaccccccttggtcctaccgttcccg

SEQ ID NO: 37251 - DNA, 549 bp, Homo sapiens
  misc_feature: GYAE6OF01CX7UU.44.19.B08.1.454.CMB.1.raw
  modified_base (237)..(237): a, c, t, g, unknown or other
  misc_feature (237)..(237): n is a, c, g, or t
  modified_base (412)..(412): a, c, t, g, unknown or other
  misc_feature (412)..(412): n is a, c, g, or t
tcagacagtatatacacgaccggtgctcgatttagtgagtcagtaagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggganatataaccttgtctcctggtatcaacaacatccaggcaaacgccccaaactcatacttttgatccagtgagcggccgtcaggttgtttctaatcgcttctctggctcaagtctggccacacggcctcctgtcgatctcgtcgggctccggctgacggacgaggctgactattacngcgtctctaatttacaacttcttagagtacgttgggtgttcggcggtagggtactcgaccgtggacccgttcgtagggtccacgaccccgaaggtcccttaccggccccccttgggtcccaccgttccgttaccccg

SEQ ID NO: 37252 - DNA, 545 bp, Homo sapiens
  misc_feature: GYAE6OF01C0FGP.44.19.B08.1.454.CMB.1.raw
  modified_base (447)..(447): a, c, t, g, unknown or other
  misc_feature (447)..(447): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
tcagacagtatatacacgaccggtgctcgatttagtgagtcagtaaggggggagaggagccccagccttgggattcccaggtgttttcattcagtgatcaggactgaacacagaggactcaccatggagtttgggctgagctggatttttccttgctgctattttaaaaggtgtccagtgtgaggtgcagttggtggagtcgtgggggaggtttggtaaagcctggggagtcccttagactctcctgtgcagcctctggattcactttcagtaacgcctggatgacctgggtccgccaggctccgagggaagggctggagtgggttggccgtattagaaccaagctgacggtgggacagcagactacgctgcaccgtgaaacggcagattcacatcacaagagatgaattacgaaaagtatacggtgtactcgtgactagatgaacngcctagaacaccgagacacagcctatattacgtgtctgggattcggttcagttcgggaccacgggaccctggcctaccgtctccncncgccctacccg

SEQ ID NO: 37253 - DNA, 710 bp, Homo sapiens
  misc_feature: GYAE6OF01ET4NL.44.19.B08.1.454.CMB.1.raw
  modified_base (373)..(373): a, c, t, g, unknown or other
  misc_feature (373)..(373): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcaggtgatggaagtttgggggacgccgtaggttcgggccggggggccctaaggactctcctgtctcgtctctcgaacccacctttagcagctactggatgcacgtgggtccgccaagctaccgaggaaacgggcctgagtggtgggtctcgacgtataacaccgagtgggactatcacgtggtacncgagacgcgtggaacggccgtatcatcactctacagacgaacaagtcgtaacgaaaactcggttagttaactttaaacgaaagtcgaaacgtagtacgttaaaggacggtacgaacgggacgtaaccgggtcttacggtacttaacgttagtttcggttaggttacgtaacgttaaccgtttagttaggttaacttttaccggtacgggtttaggggggtaacgttttaacggttccgggttttaccggggtacccctaacggttacccgggttacgggggtacccgtaaacgggggttaaacccgtttcggggttcccggttccggtttaccccgg

SEQ ID NO: 37254 - DNA, 725 bp, Homo sapiens
  misc_feature: GYAE6OF01ENKH8.44.19.B08.1.454.CMB.1.raw
  modified_base (476)..(476): a, c, t, g, unknown or other
  misc_feature (476)..(476): n is a, c, g, or t
tcagacagtatatacacgaccggtgctcgatttagtgagtcagtaagggggggagaggagccccagccttgggattcccaggtgtttttcattcagtgatcaggactgaacacagaggactcaccatggagtttgggctgagctggattttccttgctgcttattttaaacggtgtccagtgtgaggtgcagttggtggagtcgtgggggtaggtttggtaaagccgtggggagtcccttagactctcctgtgcagcctctggattcactttcagtaaccgcctggatgaccgtgggtccgccaggcctccgaggggagggctgggaggtgggttcggccgtataacgaaccaagcgtaggacggtggacagcagactacgctcgaccacccggtaggaaacggcaaggtacttccaacctattcctacgaaaggtagtactaggtaacttaacgaaaaaggtacgttaacgggtnttaccgtacgtagacgtaagtaagtacgaaaccacggtaccctaggaaacccgaaccgggaacggaaccaaccgaccggtacccgtttacttaacgtttaccgtcggttaccgttaggggtaactttcgggttttaccgaccgggtttacccgggggaccccgttaaaccgggggtaaccccctttgggtaccccgttaccccggttcccgttaccccgttaccgtacccggtcccccctaaaccccgg

SEQ ID NO: 37255 - DNA, 561 bp, Homo sapiens
  misc_feature: GYAE6OF01E4RMM.44.19.B08.1.454.CMB.1.raw
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (448)..(448): a, c, t, g, unknown or other
  misc_feature (448)..(448): n is a, c, g, or t
  modified_base (547)..(547): a, c, t, g, unknown or other
  misc_feature (547)..(547): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcacttttcagtaacgcctggatgacctgggtccgccaggctccgagggaggggctggagtgggtgcgtatagaacaagctgacggtggacagcagacacgctacgcgacccgtagaaacggcagtacttacaccatctacaagagatagattacaaaagtntacggtntctctgcagatagaacngaccagaacaccgagacacagccgtatattactgtacgtgggacttggttcacggttcgggacaccggggtaaccctgggacccaccgttctaccctcnccgtccctaacccg

SEQ ID NO: 37256 - DNA, 557 bp, Homo sapiens
  misc_feature: GYAE6OF01EX6ZO.44.19.B08.1.454.CMB.1.raw
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtggggggaggtttggtaaaagccgtggggagtcccttagactctcctgtgcagcctctggattcactttcagtaaccgcctggatgacctgggtccgccaggctccgagggagggctggagtgggtgcgtatagaccaagctgacggtggacagcagactacgctgcaccgtgaaaggcagatcacatctacaaganatgatacgaaaagtagtacggtntctctgcagactagaacagcctagaacacggagacacacgccgtactactacgtgtcgtgggtacttggttactacggttcgggaccgtacgggtacccctggtaccctaccgtcctccctcgcgtccctacccg

SEQ ID NO: 37257 - DNA, 570 bp, Homo sapiens
  misc_feature: GYAE6OF01ESXZF.44.19.B08.1.454.CMB.1.raw
  modified_base (146)..(146): a, c, t, g, unknown or other
  misc_feature (146)..(146): n is a, c, g, or t
  modified_base (169)..(169): a, c, t, g, unknown or other
  misc_feature (169)..(169): n is a, c, g, or t
  modified_base (182)..(182): a, c, t, g, unknown or other
  misc_feature (182)..(182): n is a, c, g, or t
  modified_base (236)..(236): a, c, t, g, unknown or other
  misc_feature (236)..(236): n is a, c, g, or t
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
  modified_base (346)..(346): a, c, t, g, unknown or other
  misc_feature (346)..(346): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
tcagacagtatatacacgaccggtgctcgattttagtgagtcagtaaggggggagaggagccccagccttgggattcccaggtgtttttcattcagtgatcaggactgaacacagaggactcaccatggagtttgggctgagcggngtgttctaggctgatagttaagntcagtgtgagtgnagtggtgagtgtgggagttgtaagcgtgggatccttagctctctgtgcagcctntggattcactttcagtaacgcctggatgacctggccncgaggctcgaggagggctggngtcgggttgcgtataggaacaagctgacggtggacagcagacacgctgaccnccgtagaaacggctagaacttcaccattcagaagngatagattacaaagtctacggtntacttcganaganatacgactacgtacacgaacgacgaacgactacggtactaccgttactacgttacgtcgtcggttaggtctttacggtttcgaccggttacggaccggtaccggtaccgtcggtacccgtacccttccgtacctccgcccgtcccgtaacccg

SEQ ID NO: 37258 - DNA, 652 bp, Homo sapiens
  misc_feature: GYAE6OF01DR3D8.44.19.B08.1.454.CMB.1.raw
  modified_base (184)..(184): a, c, t, g, unknown or other
  misc_feature (184)..(184): n is a, c, g, or t
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (262)..(262): a, c, t, g, unknown or other
  misc_feature (262)..(262): n is a, c, g, or t
  modified_base (498)..(498): a, c, t, g, unknown or other
  misc_feature (498)..(498): n is a, c, g, or t
tcagacagtatatacacgaccggtgctcgatttagtgagtcagtaaggggggggtcacaagaggcagcgctctcgggacgtctccaccatggcctgggctctgctcctcctcaccctcctcactcagggcacaggatcctgggctcagtctgccctgactcagcctgcctccgtgtctgggtcnccgtggacaggtcggtcaccatcctcctgcactgganccagcgtaatnttcttagtcttaattgtctcctgtatcaanatcatccaaggaccaaacgacccccaaaatccatcgtattcatgattcgtactaagtaacgtccggccctaggttacgggttctgggttccgtctttctcgtcggtacctactaacgtcgtaggaccaaccgaccggcctccctagacctacttccgtcgtcggcctaccggaggtcgtaggacggacggacgtcgtacgtaacttacgtacgtggactagtactaataagtaaanaaaacggtacaaccgtaaactcgttaacgttaacttacggttccgggaacgggtaaccggaaccaaacgggtccgtacgggtaccccgttacggtacgggtacccaaacggtaccccggaacggttcccacccggtcccccgtcgggttacccc

SEQ ID NO: 37259 - DNA, 882 bp, Homo sapiens
  misc_feature: GYAE6OF01CAF4T.44.19.B08.1.454.CMB.1.raw
tcagacagtatatacacgaccggtgctcgatttagtgagtcagtaagggggggagaggagccccagccttgggattcccaggtgtttttcattcagtgatcaggactgaacacagaggactcaccatggagtttgggctgagctggattttccttgctgcttaattttaaaaggtgtccagtgtgaggtgcagttggtggagtcgtggggtaggtttggtaaagccgtggggagtcccttagactctcctgtgcacgcctctggtattcacttttcgaagttaaccgcctggattcgacccgttgggtcccgccgacggcctacccggaagggggaacggggtcgtaggggtacggttggggtttcggacccggtttaagttaacggaaacccgtaaaaggccgttagggaacggggttacggggaaacctaggaccgaacggtaaccgtaccggcgttacggacccgtaacccgggttaaggaaaacgggccaaaggtactttacccgaacccgtaacttcccgttaacgaaaacggtaggtaactttagggtaaactttaaaccgaaaaaaggtacgttaacgggttacgttccttaccgtgtaaccgtaggtaactacggaaaacctcggtaacccgttaacggaaaccccgtaaaccgggaacgggaaccctaaccggtaaccggttacccctttacgtttaacgtttaaccgttcgggttacgttacgggggttactttcgggtttttaacggaccggttttacccgggggaaccccggttaaacgggggtaaccccccgtttggggttaacccccttaccccggtttaccccgttaccccgtaacccggtacccggtccccccgtaaacccccggg

SEQ ID NO: 37260 - DNA, 666 bp, Homo sapiens
  misc_feature: GYAE6OF01CQMIY.44.19.B08.1.454.CMB.1.raw
  modified_base (306)..(306): a, c, t, g, unknown or other
  misc_feature (306)..(306): n is a, c, g, or t
  modified_base (478)..(478): a, c, t, g, unknown or other
  misc_feature (478)..(478): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttcctgctgcttattttaaaaggtgtccagtgtgaggtgcagttggtggagtcgtgggggtaggtttaggtaaaggccgtggggacgtcccttagactctcctgtgcagcctctggacttctactttcagtaaccgcctggatcgaccgtcgggtccncgaggcctaccggaggggaacgggcgtaggaggttcggggttacgaccgttagttaacggaaacctaaaggcgtaggaacgggtggaacacggcaacgactacgctagaccgaccggtagaaagcagtactcaactatctacaagagatagtaactaacgaaagtgtacgtntacctgtagcaagatacgaacgtacgaccgtaacgaaccgaccggaaggaaccctaacggccgtacccgttaacttaacttaccgtacggtcggttacggtagttacggtttacgacggttacccgggacccgtaacggggtaccctcggtcctaacccgttcgcccgtacgccgtacccctacccgg

SEQ ID NO: 37261 - DNA, 695 bp, Homo sapiens
  misc_feature: GYAE6OF01DOA26.44.19.B08.1.454.CMB.1.raw
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggaaagccgtggggagtcccttagacttctcctgtgcacgcctctggattcactttcagtaacgcctggatcgaccgtgggtccgccacggctaccgaggggaggggcgtgggaggtggggttcggccgttagtacgaacgaagcgtaggacggtgggacagcgaagtacctacgctacggccgacccggtagaaacgggctaagacttaccaacctatcctacgaagagtactagtaacttaacgaaaaggtattaaccgggttgtacctacgtacgacgaagtactacgaaccgtacgtaccctaggaaaccccgaacggtacggaacctaaccgtacggtacccgttacgttaacttacgtcggttcgtagggtacgtttcggttacgtacggttaccgggacccggttaaaccgggtaccccgttacggtacccgtaccggttcccttaccgtacccgacgttccccgtaaccccgg

SEQ ID NO: 37262 - DNA, 620 bp, Homo sapiens
  misc_feature: GYAE6OF01BTJ8U.44.19.B08.1.454.CMB.1.raw
  modified_base (297)..(297): a, c, t, g, unknown or other
  misc_feature (297)..(297): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgaccgtgggtccncaggctcgagggagggctggagtgggtgcgtatagaacaagctgacggtggacagcagactacgctgccaccgtgaaacgcagactcacatctacgaagagatagtaacttacgaaaaagtgtaacggtgtacctctagctaagattaacgaaccagtccctaaggaaccaaccgggaagaaccacgacggtacccgttattaacgttacgtcggtacgttagggtacgttcggttttccgaacgggtttccgggaccggtacggggtaacccctgggttaccctaccggttcctacccgtacgaccgtccccgtaaccccgg

SEQ ID NO: 37263 - DNA, 709 bp, Homo sapiens
  misc_feature: GYAE6OF01ECPA5.44.19.B08.1.454.CMB.1.raw
tcagacagtatatacacgaccggtgctcgatttagtgagtcagtaagggggggagaggagccccagccttgggattcccaggtgttttcattcagtgatcaggactgaacacagaggactcaccatggagtttgggctgagctggtatttttccttgctgcttattttaaaaggtgtccagtgtgaggtgcagttggtggagtcgtgggggtaggtttaggtaaacgccgtggggacttcccttagacctctcctgtagcacgtcctctggtacttccactttcgaagtaaccgcctggatcgtaccgtcgggtcccgcgaggccgtccgaaggggaacggggctgggaggttgggggttcggccgttaagtacgaaaccgaaggtctagggaacgggtgggaacaggcaaggtacctaccgactgacccgtaccgtaggaaaggcagtacttccaccatctaacgaagagatgaataacaaaaggtacgttacggtcgtctcgtagacgtagtacgtgaacctacgcctaagaacccggaacgacggaaccacgtaccgtaccgtttactattacccggtgtaccgttagggtacgtttggtttaccgtacggttacccggggacccggttaaacggggtacccccgttgggttacccccgtaccggtttacccttcccctaacgtcccggtccccgtaaaaccccgg

SEQ ID NO: 37264 - DNA, 981 bp, Homo sapiens
  misc_feature: GYAE6OF01EB56W.44.19.B08.1.454.CMB.1.raw
tcagacagtatatacacgaccggtgctcgatttagtgagtcagtaaggggggagaggagccccagccttgggattcccaggttgttttcattcagtgatcaggactgaacacagaggactcaccatggagtttgggctgagctggtattttccttgctgacttagtttttaaaaggtgtccagtgtgaggtgctagttggtggagtcgtgggggtaggtttaggtaaagtccgtggggtacgttcccttaagaccttcttccgtgtcgccgtagtcccttcgtggtaactttcctaccgttttacaacgttaaccgtccgttaggacttcggtaaccccggttcggggtacccgccgtaaccggtccgtacccgggaacgggggtaacgggggtccgttagggggtacggggtttcgggggtttccggaacccggtttaaagtttaaaccggaaaacccggtaaaagtccggttacggggaaccggggttacggggtaaacacggaaccgaacggtaacccgttaacgggcccttaggaacccccgtaacccgggttaaaggaaaacgggtcctaagtaacccgttaccaacccgtacttacccgttaacgaaagggtaacgtaacgttaacgtaaacgttaaaccgtaaaaaagggttacgtttaaccgggttaacgtttacccgttaccggttaacgggacttaaaccgggtaacttaaccgggaaacccgtacggtaaccccgtacggaaaacccgtaacccgggaacggtaaacccaccggtaccggtacccggtttacttaacgttacggttacggttaccgttagggttaacgtttacgggttttacccggtacgttttaccccggggggaaacccggttaacccggggtaacccccgttcggggttaaccccctttacccgggttaccccttaccccggttaacccaccccggttcccccggtaaaccccccgg

SEQ ID NO: 37265 - DNA, 796 bp, Homo sapiens
  misc_feature: GYAE6OF01ENENW.44.19.B08.1.454.CMB.1.raw
  modified_base (190)..(190): a, c, t, g, unknown or other
  misc_feature (190)..(190): n is a, c, g, or t
tcagacagtatatacacgaccggtgctcgatttagtgagtcagtaaggggggggtcacaagaggcagcgctctcgggacgtctccaccatggcctgggctctgctgctcctcactctcctcactcaggacacagggtcctgggcccagtctgccctgactcagcctgcctcgtgtctggttctctggacngtcgatcaccatctcctgctacgtcgggtccagacaatcgactagttaggggatacttaacttaacctttcgtccttccgttggtaactaccaaaccaaacctactaccgaacggaccaaaacccgtaaccccccaaaaccttactaacgttttaccgtttttttaggaacgttacccgtaacggttacggaccgggtccgggtcccggttaccgtaggggttttacgttttaccgttaaacgttccggttcctttccgttccgtacggtcccttaccgtaacggttccgttccggacccgaccggtacccggtccccttcccgttacggtaccgtacttccggtcggtcgggtcctccgggtccgtaggacggacggtcgtcgtacgtacttagttaccgtcggtcgtacttactaacgtttactaacgtttcgttaggtacgggttacgggtttggggttacggttaccggggtaccgggtacgggtaccctaccgtacccggttaccggtacccgttacggtacggtaccgacccggacccgtaaccgggtccccgttacccggtcccccggttccggtacctcccggtttccgttcccccgg

SEQ ID NO: 37266 - DNA, 649 bp, Homo sapiens
  misc_feature: GYAE6OF01AI2G6.44.19.B08.1.454.CMB.1.raw
  modified_base (262)..(262): a, c, t, g, unknown or other
  misc_feature (262)..(262): n is a, c, g, or t
  modified_base (371)..(371): a, c, t, g, unknown or other
  misc_feature (371)..(371): n is a, c, g, or t
tcagacagtatatacacgaccggtgctcgatttagtgagtcagtaaggggggagaggagccccagccttgggattcccaggtgttttcattcagtgatcaggactgaacacagaggactcaccatggagtttggctgagctggattttccttgctgcttattttaaaaggtgtccagtgtgaggtgcagttggtggagtcgtgggggtaggtttaggtaaagccgtggggacgtcccgttagactctccgtgtgcagtcctntggattcactttcagtaccgcctggatcggaccgtgggtccgaccaggcctccggagggaacgggctgggagtgggttcgccgtatacgaaccaagctgacggtggacngcagactacgctacgccgacccggtagaaacggcaagtacttccgactatcctacaacggtagtatacggtaacttaacgaaaaggtacgttaacgggtctctacgtagtcgaagtactacgaactacgaccgtaacgaacgaaccggaacgaccgaacgaccgttccgtacttacgttacccgtagtcgtaggtacgttcgttaccgacggtccgggtacgaacggttaccccgtggttacccgtccgttacctaccgtcaccgtccccgtaaccgg

SEQ ID NO: 37267 - DNA, 1051 bp, Homo sapiens
  misc_feature: GYAE6OF01DUUT8.44.19.B08.1.454.CMB.1.raw
tcagacagtatatacacgaccggtgctcgatttagtgagtcagtaaggggggagaggagccccagccttgggattcccaggtgtttttcatttcgagtgatcgagactagaacacagagactccaccagtggtaggtttggctgagtcgtggttactttttccgtgtctgtactttaaagttttaaaaggtcgtaccgtaggttggtaggtaggtcgtacgttaggtttgggtagggtacggttcggggttaggggggttaagggttttaacgggtaaaaccggtccgggttacgggggtaaccgtttaccccgtttaacggtaccctttcccgttccgttggtccgaccgtaccgtcccgttcgttacggttacctttaccttaccgtttacggaaacgttaacccggtccgttaggtacttccggtacccggttccggggtcccgaccggacggtcccgtaccggggaaggggggaacggggtcgttagggggtagggtttcgggggttaccggtaccggtttaaaggttaaaccggaaaaccgaaggtccggttaacggggtaccgggggtacggaaccgacggtacgaacggtaccgtaccggcgtacggaccccgtaaccgggtaaaggaaacggccgtaaggtaccctttaccgaacctaacttaccgtaaacggtaaggtaacgtacgttaaggtaactttaaaacggaaaaaggttcggtttaacgggttacttcctacggttacggaactaaggtaacgtaaccggtaaaccgtccggtaacccgtaaacggaaacccgaacccggggaaacggaaaccctaacccggtaccggttaccccgtttaaacgtttaaccgtttaaccggttcgggttaccgggttacgggtttacggtttttaccgggtttaccgtaccgggggtttaccccgggtaacccgggtaaaccccgggttaaaccccggtttccgggtaaacccccgttaccccgggtttcccttaccccggtaccccggtacccgtaccccccgtaaacccccggg

SEQ ID NO: 37268 - DNA, 873 bp, Homo sapiens
  misc_feature: GYAE6OF01ARIID.44.19.B08.1.454.CMB.1.raw
tcagacagtatatacacgaccggtgctcgatttagtgagtcagtaagggggggagaggagccccagccttgggattcccaggtgttttcattcagtgatcaggactgaacacagaggactcaccatggagttgggctgagctggtattttccttgctgtcttaattttaaaggtgtccagtgtgaggtgctaggttggtggtagtcggtgggggtaggtttaggtaaacggtccggtgggggtacgttccccgttaaggtaccttccgtccgttgttcgaccgtacgtcccttacgttggtaactttcctaaccgttttcgtaacggttaaccgtcccgttagggtacttccggtaacccggttccggggtacccgaccgtaacgggcccgttacccgggaaggggggtaacgggggtccgttagggggtacggggttcgggggtttcggtacccggtttaagttaaacggaaaacccgtaaacggtcggtagggaaccgggttacgggaactacggaccaacggtaccgtaccggtcgtacgacccgaaccggtagggaaacgccgtaacgtacttacccaacctcgtaccgtacgaaaggtacgtagttacgtaacttaacgaaaacgtacgtttaacggtcgttacctacgtagggtaactaagtacctacggaactaccggtacccgtaacgaaaccccgaggaaccgtacccgaagtaccgtacccgttattaacgttaccgttgtaacggtagggtacctttcggtttaacggacggttccccggggaacggtacccgggttacccgttcggttaaaccccgtccccgtttaccctacccgaaccgtacccgtccccggtaaacccg

SEQ ID NO: 37269 - DNA, 815 bp, Homo sapiens
  misc_feature: GYAE6OF01C2AUU.44.19.B08.1.454.CMB.1.raw
  modified_base (203)..(203): a, c, t, g, unknown or other
  misc_feature (203)..(203): n is a, c, g, or t
tcagacagtatatacacgaccggtgctcgatttagtgagtcagtaaggggggggtcacaagaggcagcgctctcgggacgtctccaccatggcctgggctctgctgctcctcactctcctcacccaggacacagggtcctgggcccagtctgccctgactcagcctgcctcgtgtcgtggtcgccgtggcagtcggtcaccgntcctcctgcacgtggacgaccaggtacgtaattacttcctttaagttctttaaacgtttcgtcttccgttggttactactaacgatactataccgtaacggtaaacgacccccaaacgtcaacttaccattactacgtagacgtaccgtaagtaacgacgtacccgtaggttaacgggtttacctaacgttacgtccttacgtacgtacgtaccgtaccgtaacgtcccgaaccgtaaccgtaccgtcccgttacccgtacgtaacctaacgttccgtaccgttcgggtacctaccggtacggtacgtacgggtaacggaacggtaggtacgtagttaacgtttaagttacgtttcggttacgtacgttaacgtaggttacgtttacgttcgttaccgtacgttaaccgttaccgtttacgtttacgttcggttaccggtttacgggtaacgggttaccggaaacccggttaaacggttaccccggttaaccggttaccggttacgggttaacccgaacccggtaaaccccgacccgggttaacccccaaaccccggttacttacccgtttacccggtaaccccgttacccggttccccgtttaaccccccg

SEQ ID NO: 37270 - DNA, 806 bp, Homo sapiens
  misc_feature: GYAE6OF01ERTAS.44.19.B08.1.454.CMB.1.raw
tcagacagtatatacacgaccggtgctcgattttagtgagtcagtaagggtaaagggggctggagtcgggtggcagtcatctggtctgatggagtaaagactactatggaaactccgtggaagggccgattctccgtctccagagacaattccaagaacaccgtgtatctacaaactgaacaatttgagagccgaggactcggctctcgtattattgtacgagcccattcgttctacgtggggccagggactccccgttggttcctaccggtccttcctcaacgaccccttaccgaccgtaacgggcccctacgttcccggttccctttccccccgttcggccgtcccccgttcgccccgttacccgaaggggtaccgaccgtaaccccggttcccggaacggtaacggtcccgaaaaccgtaccggcccggggtaccccgttcgggggtacccgtttcgggaccccgtttacgggggttaccctaaaaccgggggtaacccctttaaacccgtttacccgttaaacgtttaaaccgtttaacccgtttacggttccgttaccgggtaacgggtcccgggtccggtttaacggggaccgttaaaacggggtcccgctttaaaaggttacgggtatccgaagtcagtacttacgacgtacgcgtactctacgtacgacgtacggtacgtacgtcgaacgtacgtactacgtacgtacgtacgtacgtacgtcgtaccgtacgtacgtacgtctacgtaccgttcgtaccgtacgttacgtacgtacgtaccgtacgttcgtcgtacg

SEQ ID NO: 37271 - DNA, 790 bp, Homo sapiens
  misc_feature: GYAE6OF01BXVJB.44.19.B08.1.454.CMB.1.raw
  modified_base (178)..(178): a, c, t, g, unknown or other
  misc_feature (178)..(178): n is a, c, g, or t
  modified_base (204)..(204): a, c, t, g, unknown or other
  misc_feature (204)..(204): n is a, c, g, or t
tcagacagtatatacacgaccggtgctcgatttagtgagtcagtaaagggaaaggggatcaggacttctcagttcatcttctcaccatgaggctccctgctcagctccgtggggctgctaatgctctggactccctggacccagtgcagattgttgtgctcgacccagacctcccctntctctcgtcccgtccacccgtggacncgcccgcctcatcgtcctgctaagtctagtcagacgcctctgacatagtgaagtaggaaagtactattattgtactacggtacctgacgagtacggtcgacggtaccacggttcctccgacacgtcctcctactagttacctagttacgtattttaccttaacgaacggtcccgttacccgttcgttacgtacgggtacgttacggacccgtaaaggttaacgggtttacgggttaccgtaagggtcggggtaccgggtaacggggtacccggggggtacgggtaaaccgttacgtttacgttttaccgaaaccgttaacgtaaaacggtaaaccgtacgggaccggggtaccgggtagggaccgggtcgttacgggtagttaaggtttacggtttaaggttaacttttacgtacgttaacgtacgttaacgtacggaacgtaacggtcgtttaaccggttacccgttaaccggggtttacccccggtaccggttacccgggtaaccgggtaaccggggttaacggtaacggggttaaaccggaaacgttaccggaaaccggttaccggtacgttacggggtccgg

SEQ ID NO: 37272 - DNA, 648 bp, Homo sapiens
  misc_feature: GYAE6OF01AX5IB.44.19.B08.1.454.CMB.1.raw
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
  modified_base (412)..(412): a, c, t, g, unknown or other
  misc_feature (412)..(412): n is a, c, g, or t
  modified_base (444)..(444): a, c, t, g, unknown or other
  misc_feature (444)..(444): n is a, c, g, or t
tcagacagtatatacacgaccggtgctcgatttagtgagtcagtaaggggggagaggagcccagccttgggattcccaggtgttttcattcagtgatcaggactgaacacagaggactcaccatggagtttgggctgagctggattttccttgctgctattttaaaaggtgtccagtgtgaggtgcagttggtggagtcgtggggggtaggttttggtaaaaggccgtgggggagtcccgttagactctcctgtgcagcctctggattcactttcagtaacgcctggatgaccgtgggtccncaggctccgagggagggctggngtgggtggcgtatagaaccaagctggacggtggacagcagactacgctagccaccgtgaaacgcaagcttgacccagtcctacgaagngtactagaattaacaaaaggtcttaacgggtntccttagtcggacgtaagacgtcgaaacgtacgacccgtaagaaacccgacggaacggaaccaccgtaaggtcccgttacttaagttaccgtggtacggttagggtactttgggtttaccgtacggttcccggggaccgtaacgggtaaccccgttgggtacccgtaacccgttccgttccctacgaccggtcccctaacccgg

SEQ ID NO: 37273 - DNA, 724 bp, Homo sapiens
  misc_feature: GYAE6OF01DXDS7.44.19.B08.1.454.CMB.1.raw
  modified_base (692)..(692): a, c, t, g, unknown or other
  misc_feature (692)..(692): n is a, c, g, or t
  modified_base (701)..(701): a, c, t, g, unknown or other
  misc_feature (701)..(701): n is a, c, g, or t
  modified_base (705)..(707): a, c, t, g, unknown or other
  misc_feature (705)..(707): n is a, c, g, or t
  modified_base (709)..(709): a, c, t, g, unknown or other
  misc_feature (709)..(709): n is a, c, g, or t
  modified_base (712)..(712): a, c, t, g, unknown or other
  misc_feature (712)..(712): n is a, c, g, or t
  modified_base (716)..(717): a, c, t, g, unknown or other
  misc_feature (716)..(717): n is a, c, g, or t
  modified_base (719)..(720): a, c, t, g, unknown or other
  misc_feature (719)..(720): n is a, c, g, or t
  modified_base (723)..(723): a, c, t, g, unknown or other
  misc_feature (723)..(723): n is a, c, g, or t
tcagacagtatatacacgaccggtgctcgatttagtgagtcagtaaggggggggtctcaggaggcagcgctctcgggacgtctccaccatggcctgggctctgctgctcctcactctcctcactcaggacacgacgggtccgtcgggcccagtcctcgccctgactcagcctcgcctcgtgtcgtggtactcctggacagtcgatcctaccttctcctcgctacgtggactcagcgagtgacgccttactaacgtttacttaagtcgtccgtcctccgtcggtccgacgtaaccgccggtcctcctacgactacttcgtcgtcggcctaccgcgtccgtaggacggacgtacgtaactttaaattcttttcgtcgtttacctactaacgttactacgttacgttttcgttgggtttcgggtttcgggttaccggttcggggcggggtaaccggggtaccggtacgggttaccggtaacccggtttccgtacgggttaccgaaccggtacccggtaacggtcccgtccccggttaacccccgtcggttaccgtacccgtttccggttccccttaaccccgttacccctttacccgttaacctttaaccgtttaccggttacggtttacccggtacgggtaccgggtccggggtaccggtacgggaaccggttacggcgttaacggtaagcgtntacgcgtcncgcnnncncgncgcnngnngcnc

SEQ ID NO: 37274 - DNA, 869 bp, Homo sapiens
  misc_feature: GYAE6OF01ES9TP.44.19.B08.1.454.CMB.1.raw
tcagacagtatatacacgaccggtgctcgatttagtgagtcagtaaagggaaaggggatcaggacttctcagttcatcttctcaccatgaggctccctgctcagctcctggggctgctaatgctctggactccctggacccagtgcagatgttgtgctcgacccagacctcccctctctctcgtccgtcaccctggacacgccggcctccatcgtcctgactaagtctagtcacgacgtcctcctgactatagtagagtaggaaaagtactatttatttcgtacgtacggtacctgacgagggacggtcgaacgggcccgtaacggttcccgtacccggacgtacgtcccttaccctactaactttaccttaagttcgttaacttttccgtttaacgaaccggtcccgttcccttaccgtttccggtagggttaccgtaccggtactaaacggttagtttaccggtttacggtaaagggttccggggtaaccggtacgggggtacccgggggttaccggggaaaccggttaacggtttaaccgttttaaccgaaaccgttaaccggttaaaaggtaaaaaccgtccgggtaaccgggggttacccggggtaacggggtaacgggtacgggttaacgggtaagggttaagggtttagggttttaaggttttaaacgttttacggtttaacgttaacggtacttacggtacgtaacgtaacggtcgtttaaccggtttaccggttaccccgggttttaaccccggtacccggttaacccgggtaaccgggtaaaccggggtaacccgggttaaacgggttaacgggtaaacgtaacgggtaaacggtaccggttaacggtcgggttaacgg

SEQ ID NO: 37275 - DNA, 849 bp, Homo sapiens
  misc_feature: GYAE6OF01E1H2S.44.19.B08.1.454.CMB.1.raw
  modified_base (186)..(186): a, c, t, g, unknown or other
  misc_feature (186)..(186): n is a, c, g, or t
tcagacagtatatacacgaccggtgctcgatttagtgagtcagtaagggggggagaggagccccagccttgggattcccaggttgttttcattcagtgatcagcactgaacacagaggactcaccatgggattttggctgagctgggttctctcgttgcttctttaagaggtgccagtgtcaggtncgagtctaggtggagttcggtgggggaggacgccggacccaggcccgtagggaaccttcccgtaggacgtaccttcctccgttgcgaccacggtcccttacgtggtaactttctagttccttacgacggtaccctaggtctacctaacgtcgccgtaccggtccgggggtcccgacccgacgggttaccctcggacggggaccggtacgggggtcgtaggggacgggttgggtacggacttaagtttacagtacgaaagtaacggtagtagggtaattaggaaaccgtaacgtacgtaacggtccgtaaaccgacggaaaggtaacgggtccctagtacccgtacggtccgtaacgacgtacgtaacctaaccgtaccgaacggaacctacgtaccgtagacctacgttacgtacggtaaccttaacgttaaccggtaacctaacccgttaacggtaaaccgtaacgggttaacggaaccggtaacccggtaaccggttacgttaaccgggtttacctttaaacggtttaccgggttacggttaccggtacccgggttaacccgacccccggggttaccccccgttaacccggggtaaccgggttaccccccgggttaccccgttaacccggttaaccggttccccggtttaaaccccggggg

SEQ ID NO: 37276 - DNA, 873 bp, Homo sapiens
  misc_feature: GYAE6OF01D3Q30.44.19.B08.1.454.CMB.1.raw
  modified_base (861)..(861): a, c, t, g, unknown or other
  misc_feature (861)..(861): n is a, c, g, or t
tcagacagtatatacacgaccggtgctcgatttagtgagtcagtaagggggggagaggagcccagccttgggattcccaggttgttttcattcagtgatcaggactgaacacagaggactcaccatggagtttgggctgagctggtatttttccttgctgtacttaagttttaaaaaggtcgtccaggtggttggagggtgtcgtagggtttgggtagggtaggttcggttgggggggttaagggtttagggtaaacgggtccgggtagggggtaccgttccccgttaagaccttccgttccgtggtcgacacggtcctcgtggtacttacctactttacaaggtaaccgccgtaggacgtcgtaccgtcgggtaccgccgacggccgtaccggaaggggggaacggggtcggtaggggtaacggtttggggggtttacgggtaccggtttaagttaaaccgggaaaccgtaaagggttcggtacgggtaaccggggggttacggggaaaccgaacggtacggtaaacggtacccgttaaaccggtccgggttaccggaccccgttaaacccggggtaagggtaaaaccgggtcgtaaacgtaaacccgttacctaaaccccggtatttacccgtaaacggtaaaggaacgttaagtacggtaaaacttaacgaaaaaggtacggtttacggttactaacttcgaacgtagaacggtaggtaacctaacggcccgtaacgtaacgaacggtaaccgaacgaacacgtacgtccttattacacgtagtcgtaggtcgttcgttaggtaccgttcgggaccgtaacccgggtcctggtacccgtccacctttccgaacgtccncccgtaacccgg

SEQ ID NO: 37277 - DNA, 717 bp, Homo sapiens
  misc_feature: GYAE6OF01C7YMX.44.19.B08.1.454.CMB.1.raw
  modified_base (280)..(280): a, c, t, g, unknown or other
  misc_feature (280)..(280): n is a, c, g, or t
  modified_base (421)..(421): a, c, t, g, unknown or other
  misc_feature (421)..(421): n is a, c, g, or t
tcagacagtatatacacgaccggtgctcgatttagtgagtcagtaagggggggagaggagccccagccttgggattcccaggttgttttcattcagtgatcaggactgacacagaggactcaccatggagtttgggctgagctggatttttccttgctgtcttattttaaaaggtgtccagtgtgaggtgctagttggtggagtcgtgggggtaggttggtaagccgtggggatcctagactctcctgtgcagtcctcgtggattctactttcagtaacnctaggatcgaccgtggtccgccgacggcgtaccggaggggaacggggtcgtggggtaggtggggttcggaccgttaagtacgaaccgaagcgtaggacgggtggacagcagactacgctacgcaccgtagaaacggcacgnttacgaccatctacgagagtactagtaacttaacaaaggtacgttacggttacgtacgttcgaagcgtaaaggtacgtacggaaacctacggaccgttaaccgaaaccggaaacccgggaagaacccgtaaacgaccggtaacccgtttatttaaaccggtttcgttacggttccggtaagggttacggttttagtttaccgggtacggttacccggggaccggttaaacccgggtaacccggttcgtacccgtacccgttaccgttacccgttaccaccgtccccgtaaccccgg

SEQ ID NO: 37278 - DNA, 759 bp, Homo sapiens
  misc_feature: GYAE6OF02I7ZS7.44.19.B08.1.454.CMB.1.raw
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
tcagacagtatatacacgaccggtgctcgatttagtgagtcagtaagggtaaaggggatcgaggacgttctcccacgttcgtactcgtttcttcaccattggaggctccctgctcagctcctgggctagctaatgctacgtggtagtccctggacccagttggtcctaggtatgtttagtttaggcttcgaaccctagtactccccgttntctctgtccggtcacccctggacggaggccggtcctccagtcgtccggtcncaagtctagtccaggcgcctcctgctagtagttgaacttaggaaagtacttattagtttcgtaacttggtaccctgaccgtacggacggtcgacggtcccgaagggtaccgtccggagaacgtcccttccgttctaacgttcgttaattaggttaaacttttaccgtttacgaaacggtaccttacccttacgtttacgtttagggtaacgttcggaaccctaaggtactttacggggttacgaagggttcggacgtacgggtccgggtacgggactacgtacgtttacgaactaacgtaacgaaaacgtcgaacggtccgggttagggacgtaccgttagaaggtagttaggttaggttaacttttagttacgtgtactagtcgacgaaggtctagttacgtacgttttccccggtacggttaccggacggtaacgggaccggtacggggttaacggtaaacggtacggtaacgggtaccggtaacggtggtacggg

SEQ ID NO: 37279 - DNA, 590 bp, Homo sapiens
  misc_feature: GYAE6OF02GX5Y3.44.19.B08.1.454.CMB.1.raw
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtggggggaggtttggtaaagccgtggggagtcccttagactctcctgtgcagcctctggattcactttcagtaacgcctggatgacctgggtcccgccaggctccgagggaggggctgggagtgggttggccgtatagaaccaagctgacggtgggacagcagactacgctgccaccgtgaaaggcagattcaccatctacaagagatgaattacaaaagtatacggtgtactctgcaagtatagaacagcctagaaccgaccggaggaccacgacgccgttacttacttactgtcgtagggtacttggtttacgtaggttccgggacccgtaacgggtaacccgtgggtaccctaccggttcctccctaccgaccgtccctaccccg

SEQ ID NO: 37280 - DNA, 524 bp, Homo sapiens
  misc_feature: GYAE6OF02I6L4A.44.19.B08.1.454.CMB.1.raw
  modified_base (241)..(241): a, c, t, g, unknown or other
  misc_feature (241)..(241): n is a, c, g, or t
tcagacagtatatacacgaccggtgctcgatttagtgagtcagtaaggggggggtcacaagaggcagcgctctcgggacgtctccaccatggcctgggctctgctgctcctcactctcctcactcaggacacagggtcctgggcccagtctcgccctgactcagcctgcctccgtgtctggttctcctggacagtcgatcaccatctcctgcacgtgggtccagcaatgactagttggganatactaaccttgtctctggtatcaacaacatccaggcaaacgccccaaaactcgggattacttttgacgtccagtgagcggccgtcaggtgtttactaatcgtcttctctggctaccaagtctcggcacacgcctcctgtcatctcgtggctccggctgaggtacgagctgactatactgcgctctatttacaacttctagagtacgttgggtgttcggcggacggacagctacgaccgtcgtacgtcacgcccgaagctcgcccctcggctactcttcccgg

SEQ ID NO: 37281 - DNA, 511 bp, Homo sapiens
  misc_feature: GYAE6OF02GK1OM.44.19.B08.1.454.CMB.1.raw
  modified_base (318)..(318): a, c, t, g, unknown or other
  misc_feature (318)..(318): n is a, c, g, or t
tcagacagtatatacacgaccggtgctcgatttagtgagtcagtaagggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacattggtggttataactatgtctcctggtaccaacaacacccaggcaaagcccccaaaactcatgattcatgatgtcagtaatcggccctnaggggtttctggtcgcttctctggctccaagtctggcaacacggcctccctgaccatctctgggctccaggctgaggacgaggctgactattactgcagctcataataaaagagcaaacactgttatattcggacggaggaccagctaggaccgtctaggtcacgcccaaggcctcgcccctggtccactccg

SEQ ID NO: 37282 - DNA, 587 bp, Homo sapiens
  misc_feature: GYAE6OF02GCONP.44.19.B08.1.454.CMB.1.raw
  modified_base (575)..(575): a, c, t, g, unknown or other
  misc_feature (575)..(575): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaaagccgtggggagtcccttaggactctcctgtgcagcctctggattcactttcagtaacgcctggatgacctggtccgcaggctccgagggagggctggagtgggtgccgtatagaaccaaagctgacggtggacagcagactacgctgcaccgtgaaaggcagatacaccatcctacaagagatgaattacaaaagatacggtatactctcgactagatacgaacacgtacctagaacgacccgaggaccacgacgtccgttacttaacgttactgtacgtgggtattcggttactacggttccgggccctaagggtaacccgttggaccgtaccgtccgttacccgacgtaccncccgttaccccg

SEQ ID NO: 37283 - DNA, 580 bp, Homo sapiens
  misc_feature: GYAE6OF02JC22Z.44.19.B08.1.454.CMB.1.raw
  modified_base (237)..(237): a, c, t, g, unknown or other
  misc_feature (237)..(237): n is a, c, g, or t
  modified_base (324)..(324): a, c, t, g, unknown or other
  misc_feature (324)..(324): n is a, c, g, or t
tcagacagtatatacacgaccggtgctcgatttagtgagtcagtaaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggganatactaacttgtctctggtatcaacaacatccaggacaaacgccccaaactcattacttttgagtccagtgacgcggccgtcaggtntttctaatcgcttctctggctacaagtctcggaccacgacggtccctccgtcgtcgtactctcgtcgggcctccggctgacggacgagctagtacttattactcgcgtctacgtactttacgacttcgttagacgtacggttgggtacgtttcgggacgggtaacgggtctaccgaccgttggtacccgttcgtacggtacacgtacccgaaggtccgtccggtacccccgttcggtacctacccgttcgttcccg

SEQ ID NO: 37284 - DNA, 531 bp, Homo sapiens
  misc_feature: GYAE6OF02FQ38X.44.19.B08.1.454.CMB.1.raw
  modified_base (293)..(293): a, c, t, g, unknown or other
  misc_feature (293)..(293): n is a, c, g, or t
  modified_base (437)..(438): a, c, t, g, unknown or other
  misc_feature (437)..(438): n is a, c, g, or t
  modified_base (469)..(469): a, c, t, g, unknown or other
  misc_feature (469)..(469): n is a, c, g, or t
tcagacagtatatacacgaccggtgctcgatttagtgagtcagtaaggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctgggggaggtttggtaaagcctggggagtcccttagactctcctgtgcagcctctggattcactttcagtaacgcctggatgacctgggtccnccaggctccagggaagggctggagtgggtggccgtatagaaccaaagctgacggtgggacagcagactacgctgcaccgtgaaaggcagattcaccatctcaagagatgaattcaaaagatacggtgtctcgtgcagatgaacnncctgaacaccgagacacagccgtctattacngtactgggatggttcattcgggcctagggaaccctggtccaccggtctcctcacgcctaccc

SEQ ID NO: 37285 - DNA, 603 bp, Homo sapiens
  misc_feature: GYAE6OF02GAE5W.44.19.B08.1.454.CMB.1.raw
  modified_base (449)..(449): a, c, t, g, unknown or other
  misc_feature (449)..(449): n is a, c, g, or t
  modified_base (495)..(495): a, c, t, g, unknown or other
  misc_feature (495)..(495): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttcctgctgctatttaaaaggtgtccagtgtgaggtgcagttggtggagtcgtgggggaggtttggtaaagccgtgggggagtcccttagactctcctgtgcagcctctggattcactttcagtaacgcctggatgacctgggtccgccaggctccgagggaagggctggagtgggtggcgtatagaaccaagctggacggtggacagcagactacgctgcaccggtgaaagcagactcaccatctacaagagatgaattaccgaaaagtagttacggtgtctcgtgactaagatagaacncgcctagaaaccacggaaggaccacgacgccgttactaacttacgngttcgtaggggtatttacggttcgtaacggttccgggacccgtaacggggtaaccccgttgggttaccctaccggttaccttcccgtacggaccgtcccctaaccccg

SEQ ID NO: 37286 - DNA, 575 bp, Homo sapiens
  misc_feature: GYAE6OF02G88OI.44.19.B08.1.454.CMB.1.raw
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
  modified_base (491)..(491): a, c, t, g, unknown or other
  misc_feature (491)..(491): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggaattttccttgctgctattttaaaaggtgtccagtgtgaggtgcagttggtggagtcgtgggggaggtttggtaaagccgtggggagtcccttagactctcctgtgcaacctctggattcactttcagtaacgcctggatgacctgggtccgccaggctccgaggggagggctgggagtgggttggccgtagttagaaccaaagctaggacggtgggacagcacgactacgctgcaccgtgaaggcagactcacatctacaagagatnatacaaaagtntacggtgtctctgacgagagtgaacagccctagaaccgaccgaggaccagacgccgtatactttacngtcgtggtattggttctaggttccggaccgtagggtaacccctggtacctacccgttctcccgtacgacgtccccaccgaccgg

SEQ ID NO: 37287 - DNA, 631 bp, Homo sapiens
  misc_feature: GYAE6OF02HXJBI.44.19.B08.1.454.CMB.1.raw
  modified_base (301)..(301): a, c, t, g, unknown or other
  misc_feature (301)..(301): n is a, c, g, or t
  modified_base (450)..(450): a, c, t, g, unknown or other
  misc_feature (450)..(450): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgcttattttaaaaggtgtccagtgtgaggtgcagttggtggagtcgtggggggaggtttggtaaagccgtggggacgtcccttagactctcctgtgcagcctctggattcactttcagtaacgcctggatcgaccgtgggtccncgaggcctccgaggggaagggctgggaggtggggtggaccgttataacgaaccaaagctaggacggtgggacaggcagacctcgctgacacccggtaagaaacggcagacttacaacctatctacgaagaagatgaattacaaaaggtnttaacggtgtctgtacgactaagtatacgaacagaccgtagaaccaccggaagaccacgacgtcccgttataacttacgtgtacgttgggtacgtttacggtttactacgggttacccgggacgtaaccggggtacccgttggtccctacccgttctacccgtcgacccgtccctaacccg

SEQ ID NO: 37288 - DNA, 604 bp, Homo sapiens
  misc_feature: GYAE6OF02JJJ6E.44.19.B08.1.454.CMB.1.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (409)..(409): a, c, t, g, unknown or other
  misc_feature (409)..(409): n is a, c, g, or t
  modified_base (439)..(439): a, c, t, g, unknown or other
  misc_feature (439)..(439): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaaggccgtgggggagtcccttagactctcctgtgcagcctcgtggattcactttcagtaacgcctggatgacctgggtccncagctcagggagggctggngtgggtgcgtatagaccaagctgacggtggacagcagactagctgccaccgtgaaagcagatcacntcncaaganatgaattacaaaagtntacggtgtctactgcaaggtactagaaccngacctacgaaacaccggaagtacccaagtacgccgttacttaacgttaccgtagttccgtagggtacttggttttaccgaacggtttccgggacccggtaacggggtaaccccgttgggtacccgtacccgttccttaccgtacccgacggtccccctaacccgg

SEQ ID NO: 37289 - DNA, 562 bp, Homo sapiens
  misc_feature: GYAE6OF02HH7A6.44.19.B08.1.454.CMB.1.raw
  modified_base (412)..(412): a, c, t, g, unknown or other
  misc_feature (412)..(412): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtggggggtaggtttgggtaaagccgtgggggagtcccttagactctcctgtgcagcctctggattcactttcagtaacgcctggatgacctgggtccgccaggctccgagggaagggctggagtgggtggccgtatagaaccaagctggacggtgggacaggcagactacgctgccaccgtagaaacggcagtattacacatctacaagnatgattacaaaagctagtntctntgcagatagaacacgcctagaaccacggagacacagccgtatacttactgtcgtggattggttacaggttccggaccgtacgggtaaccctggtaccctaccggtcctaccgcgtacgccctacccg

SEQ ID NO: 37290 - DNA, 598 bp, Homo sapiens
  misc_feature: GYAE6OF02FXDJN.44.19.B08.1.454.CMB.1.raw
  modified_base (279)..(279): a, c, t, g, unknown or other
  misc_feature (279)..(279): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (450)..(450): a, c, t, g, unknown or other
  misc_feature (450)..(450): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtggggggaggtttggtaaagccgtgggggagtcccttagactctcctgtgcagcctctggattcactttcagtaacncctggatcgaccgtgggtccgcaggctccgaggggagggctgggagtgggtggccgtatagaaccaagctagacggtggacagcagactacgctgccaccgtagaaacggcagattcaccatcanaagagatgaattacaaaagtntacggtntctctgacagatcgaacngcctaggaaccacggaaggaccacgacgtccgtataactcgtagcgttaggtacgttcggtttacgcggttccgggacccgtaacgggtaaccccgttgggtacccttcccggtacccttcccgtacgtaaccgtcccctaaccccgg

SEQ ID NO: 37291 - DNA, 569 bp, Homo sapiens
  misc_feature: GYAE6OF02GJOE4.44.19.B08.1.454.CMB.1.raw
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
tcagacagtatatacacgaccggtgctcgatttagtgagtcagtaaggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgactattggtggttataactatgtctctacggtaccaacaacaccaggacaaacgccccaaactcatgtattcatgatgtcaagtaatccggcctcgtagggtttctggtcgtcttctcgtgctcagtctgacacacgcctcctcacctntctcgtggcctcgnggctggaggacgaggctagacttattacgtcgctagcctacaataaactaaaagactacaacttagttacgtttagtacgttacgggacggtacggaacgtacgcgtacggtaccgtacgttacggtacgaccgaccggtaacggcctcccggtcccccgtacggtcctaccgttcccg

SEQ ID NO: 37292 - DNA, 556 bp, Homo sapiens
  misc_feature: GYAE6OF02HD3KL.44.19.B08.1.454.CMB.1.raw
  modified_base (296)..(296): a, c, t, g, unknown or other
  misc_feature (296)..(296): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (480)..(480): a, c, t, g, unknown or other
  misc_feature (480)..(480): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccnccaggctccgagggaagggctgggagtgggtggccgtatagaaccaagctgacggtgggacagcagactacgctgccaccgtgaaacggcaagattcaccatcctacaagagatgaattacaaaagntacggtntctctgcaagatgaacagcctagaacacgagacacagtccgtctattacngtctgggattgggtttcagttccgggaccgtagggaccccttggtacctcccggtctcccgtctacgccctacccg

SEQ ID NO: 37293 - DNA, 768 bp, Homo sapiens
  misc_feature: GYAE6OF02IMDZS.44.19.B08.1.454.CMB.1.raw
tcagacagtatatacacgaccggtgctcgatttagtgagtcagtaagggggggagaggagccccagccttgggattcccaggtgttttcattcagtgatcaggactgaacacagaggactcaccatggagtttgggctgagctggtattttccttgctgctattttaaaaggtgtccagtgtgaggtgcaggttggtggagtcgtggggggtaggtttagggtaaagccgtgggggacgttcccttagactctcctgtgcagcctctggattcactttcagtaacgcctggatcgaccgtgggtccgccgaggcctccgaaggggaggggcgtggaggttgggttggccgttagttacgaaccaagcgtaggacggtggaacagcgaagacgtacgctcgaccgaccgtagaaacggcagtaacttcactactactacaaagcgtaatagtaacttaaacaaaagttagttaacgggtactaccttcgtacgacgtaaagttacgtacgaaaccgacgacccgtaagaaaccccggaaacgggaacgggaacccaaaccggtacggtacccccgtttaagtttaaaccgtttacgtacgggttttaccggtaggggttaactttttaccgggggtttttaccctaaccggggttttaccccggggtacccggttaaaccgggggttaacccccgtttgggtaacccccggttaccccggtttccccgttacccggtttacccgacccggttcccccccgtaaacccgg

SEQ ID NO: 37294 - DNA, 529 bp, Homo sapiens
  misc_feature: GYAE6OF02GPUFA.44.19.B08.1.454.CMB.1.raw
  modified_base (239)..(239): a, c, t, g, unknown or other
  misc_feature (239)..(239): n is a, c, g, or t
  modified_base (321)..(321): a, c, t, g, unknown or other
  misc_feature (321)..(321): n is a, c, g, or t
  modified_base (426)..(426): a, c, t, g, unknown or other
  misc_feature (426)..(426): n is a, c, g, or t
tcagacagtatatacacgaccggtgctcgatttagtgagtcagtaaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcacgtgggtccagcaatgacagttggganatataaccttgtctcctggtatcaacaacatccaggcaaacgcccccaaactcattacttttgagtccagtgagcggccgtnaggtgtttctaatcgtcttctctggcctccaagtctggccacaccggtcctcctgtcgactctcgtcggcctccggcctggacggacgaggctgacttattacgngtcgctctattacacttcttagagtcgttgggtgttcggcggaggctccgctcgccgtcgtaggtcacgccgaggctccgcccctcggtctaccgtcttcccg

SEQ ID NO: 37295 - DNA, 624 bp, Homo sapiens
  misc_feature: GYAE6OF02GTI7D.44.19.B08.1.454.CMB.1.raw
  modified_base (296)..(296): a, c, t, g, unknown or other
  misc_feature (296)..(296): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtgggggatccccttagactctcctgtgcagcctctggattcactttcagtaacgcctggatgacctggtccncaggctccgagggagggctggagtgggtggccgtatacgaacaagctaggacggtggacagcagactacgctgccaccggtgaaacggcaagattcacctatcctanaaganatgaattacaaaagtgtacggtntacctctgacaagatacggaacacgtacctaagaaaccgaccggaaggtaaccaaccgacgtcccgttacttaaccgtttacgtcgttacgtgggtactttcgggtttaccgtaacggtttcccggggaccgtaaccgggtacccttgggtacccttcccggtcctcccgtacgtaccgtccccgtaaccccg

SEQ ID NO: 37296 - DNA, 904 bp, Homo sapiens
  misc_feature: GYAE6OF02H6W2C.44.19.B08.1.454.CMB.1.raw
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgcttaattttaaaaggtgtccagtgtgaggtgcagttggtggagtcggtgggggtagtttaggaaaggtccgtggggacgttccccgttaaggaccttccgtccgttggtcgactacgcccttcgtaggtatttaccgtacttttcgaacgttaaaccgccttagggaacttcggtaacccgttccgggggtccccgtaccggtaacggtcccgttaaccgggaagggggtaaacggggtccgttaggggacggtttcgggggttacgacccggttaagttaaccgaaacccggtaaaagcgtaagggtaccggggtagggaacctacggactaaacggaacccgtaccggtccgtacggtaccgaacccgggttaaggaaaaaccggtccgtaaggtaaccttacccaacccgtaagtccgtaaacgaaaggtagtaacgtacgtaaacgtttaaaccgaaaaacggttacggtttaaaccggtcgttacgttacgtacggtaccgtaaaggtactaaacggaaacccgtacggaaaccgtaacgggaaaacccaaccggggtaacgaaccctaaaccgtaacgggtacccttttaagttaacccgttacggtacgttaccgggtagggttacttttacgggttaacctaccggggttaccggacccgggtaaacccgggttacccctgggttaaccccgtccggttccccgttaaccctcccggtaccgtaccccgtaaccccgg

SEQ ID NO: 37297 - DNA, 987 bp, Homo sapiens
  misc_feature: GYAE6OF02I5884.44.19.B08.1.454.CMB.1.raw
tcagacagtatatacacgaccggtgctcgatttagtgagtcagtaaggggggagaggagccccagccttgggattccccaggtgttttcattcagtgatcaggactgaacacagagactcaccagtggtagttggctgagcgtggtacttttcctgctgtacttaagttttaaaaggtcgtaccgtagtggtggtaggtgacgtaggtttgggtggtagttcgggtagggggttaggtttacggtaaacgccggttaggggtacgttcccgttaagaccttccgttccgttggtcgaccgacgtcccttcggttacggtactttaccttaccgttttaccgtaaacggttaaccggttcgttacgggtaacttacccggttaacccggttccggggttaccccgaccccggtaacgggtcccgtaacccggggtaaaggggggtaacggggtcggttacggggggtaacggggttttcggggggttaccgggttaacccggtttaaacggttaaaaccgggaaaacccgtaaaacgggttccggtaacggggtaaccgggggttacgggaaaaccgaggaaccgtaaaccggtaaccttaaccgggtccgttaccggaacccccgtaaacccggggttaaaggaaaaacggccgtaaacggttaacccttacccgaaaccgttacgtacccgtaaaccggtaaaggtaacgtaaacgttacggaaaacgtttaaaaccgaaaaaggtttaccgggtttaccgggtttacttacccgtaccgttacggtaacgtaaagtaccgtaaacgaaacgttaccgaccgtaaacgaaaccgtaaccggactaaccgaccgttaacggccttaacgtttaacttacggacgttagtacggttatttacggttacgtccggtaccggaaccggtaaccggttaccttccgggacccttaccggttcccgtacacccgtccgtaccccgtacccgg

SEQ ID NO: 37298 - DNA, 728 bp, Homo sapiens
  misc_feature: GYAE6OF02IC6GV.44.19.B08.1.454.CMB.1.raw
  modified_base (242)..(242): a, c, t, g, unknown or other
  misc_feature (242)..(242): n is a, c, g, or t
tcagacagtatatacacgaccggtgctcgatttagtgagtcagtaagggggggggtcacaagaggcagcgctctcgggacgtctccaccatggcctgggctctgctgctcctcactctcctcactcaggacacagggtcctgggcccagtctgccctgactcagcctgcctccgtgtctggttctctggacagtcgatcaccatctcctgcacgtgggtccagacaatcgactagttggganatactaacttcgtctcctggtactacaacaacataccaaggtaaaccgaccccctaaatcaactccaattctatacgacggtaccttaagtaaacggacggtcccttacggtaacggggttttactaaacgttccgtacctttccaacttccgacccttacccgtaacggttcccggaaccaaccgtacccgtcccttaccccgtacgaacctaacgttccgttccgtcgggtacccttaccggaaggtccgtagggacgggacggacgggtacttagtaattttagttttagttgttcgtctagaagttgtttacgttccggtcgtacctaattaccttaacgttacgttacgttccgttaacgggtaacgggtaccgggtaaccggtaacggtcccgttacccggttaccgtacgggttaccaaccggtaccccggaaaccggtaccccctaaacccccggtacgttaccgtacccttaacccg

SEQ ID NO: 37299 - DNA, 631 bp, Homo sapiens
  misc_feature: GYAE6OF02FZQ7R.44.19.B08.1.454.CMB.1.raw
  modified_base (193)..(193): a, c, t, g, unknown or other
  misc_feature (193)..(193): n is a, c, g, or t
  modified_base (239)..(239): a, c, t, g, unknown or other
  misc_feature (239)..(239): n is a, c, g, or t
  modified_base (574)..(574): a, c, t, g, unknown or other
  misc_feature (574)..(574): n is a, c, g, or t
  modified_base (605)..(605): a, c, t, g, unknown or other
  misc_feature (605)..(605): n is a, c, g, or t
tcagacagtatatacacgaccggtgctcgatttagtgagtcagtaagggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacngtcgatcaccatctctgcacgtgggtccagcaatgacagttggganatactaaccttgtcctcgtgtactacaacaacactccgaggaccaaaccgaccccctaaaacgtcctaactttacgtttttacgacgtacctaggtggacggtccggccgttacgtacgggtttcgtttacgtaacgttccgtctttctcgtcggtcctaccgtaacgtctacggacccacgacccggtccctcccgttcgtcgtactccgttcggtcgggtccgtcccggtccgtacggacgggacggtaggtccgtacgtacttactcgtcggccgtctactacttactacttcgttgtacgttggttgggttggtcgggcggacggtcgtcncgtcgtccgtcgtacgcgacgacgtcggccnccgtcccgtcgtcctacctcgtcccg

SEQ ID NO: 37300 - DNA, 658 bp, Homo sapiens
  misc_feature: GYAE6OF02GPROU.44.19.B08.1.454.CMB.1.raw
tcagacagtatatacacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagacctctcctgtgcagcctctggattcactttcagtaacgcctggatcgacctgggtccgccgaggcctaccgaagggagggctgggagtgggtcgccgttagtacgaaccaaaggctaggacggtgggacagcgagactacgctgccaccgtagaaagcagacttcaccatcacaagagtatagaacttaacgaaaagcgttaacgggtctactcgtacgacgaagtacgtaggtaaacacggtcctaaggaaccgaaccggtaagaccaacgacggtccgttacttaacttaccgtacgttacgttaggtagtttcgggtttaccgtcgggttacccgggaccgtaaccggggtaacccgttacgggtacccttacccggttcccttacccgtacggtacccgtacccgtaaccccgg

SEQ ID NO: 37301 - DNA, 784 bp, Homo sapiens
  misc_feature: GYAE6OF02GE6GI.44.19.B08.1.454.CMB.1.raw
  modified_base (266)..(266): a, c, t, g, unknown or other
  misc_feature (266)..(266): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggaggtttgggcgtgaggtcggtctttttcttgtgtacttaagttttaaaaggtgtaccagtgtgaggtggcctgttggagtcgtgggggagagttggcacgacgccggtgggggtccctgacgtactcctcgtgtcgcncgcctcgtcggtccctttccccgttaggacgtctactcgcctatacgtaccgtcgggtccccgtacgacggtcccgtccggaagggggtacggggtccgtacgggtagggttcggggtccgttaccggaacgtacggttacgggcgtacgttaggtcgacctaacgtacgaacaaccgtaactaacgtaaccgggagtacggtaccgggtaggaaccggggtcctacgtccgaccctacgtcctacgaacgacgtaactaaaccgttaccgaaacctcgttaccttttagacgtaaatccgtaacacgtccgtagacggtacgtaaccgaacgtaccgtaccgtttacctttacgttcggtacgttcgggaacggtaaggggggaccggggtattaccgggtacgtacccgtaagggtcgggtttggggtacgggttaacgggtaccctaacgggttcccggtaggggcccgaacgggttaccggcccgttaggtccccgtacccgggccgtacccgg

SEQ ID NO: 37302 - DNA, 646 bp, Homo sapiens
  misc_feature: GYAE6OF02I7A5Z.44.19.B08.1.454.CMB.1.raw
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
  modified_base (552)..(552): a, c, t, g, unknown or other
  misc_feature (552)..(552): n is a, c, g, or t
tcagacagtatatacacgaccggtgctcgatttagtgagtcagtaagggggggagaggagccccagccttgggattcccaggtgttttcattcagtgatcaggactgaacacagaggactcaccatggacgtttggctgagtctggtattttccgttgcttgactattttaaaagggtgtccagtgtgagtgctaggttggtggagtcgtagggggtaggtttaggtaacgtccgtggggacttcccttagacctctcctgtgctacgctcgtgtattcctacttcagtacgctggattcgacgtggccnccgnggcctcggaggtagggctggngtcgggtgccgtaagtacgaactagcgtggacggtgacnggtacanacgttacgcgtagacctaccgtaaggaacgtnacgtatacccgactanccgtaacagaacgtatacggtataaccgtaaagtagtacggtactcttacgcgtaacgacgtaagtacgaacgtcgtaccgtacgaacgacgacgactacgacacttacgttactcggttacnggttacgtgttcgtacgtacggttaccgggactaccgggtaaccccgttggaccccgttacgttccctacgtaccttcccggaccctaccccgg

SEQ ID NO: 37303 - DNA, 934 bp, Homo sapiens
  misc_feature: GYAE6OF02I6SXC.44.19.B08.1.454.CMB.1.raw
tcagacagtatatacacgaccggtgctcgatttagtgagtcagtaaggggggggagaggagccccagccttgggattcccaggtgttttcattcagtgatcaggactgaacacagaggactcaccatggagtttgggctgagctggtattttcctgctgactattttaaaaggtgtccagtgtgaggtgcaggtgatgggtaagtttggggggacgtccgttacgggttccggggcccggggggggtccccctaaaggtacctccgttacccgtcggttccgtccggttcccttccgtacggtaaacccccctaccttttaacggccaacggtcccgttaacgttcgggaatttcgggacctaacccgttccggggggtacccccgaccgtaaacggtcccgttacccggaaacgggggtaaaacggggtcccgttaaggtaaccgttgggtttcgggggtccttaccggtaacgttaaccttaaaccgtaccggtaagtacggggtaaccttacgtaccgtacgttagggttacctacacgggtaaccgtccggtacgggaaccggggtcccgtaagttccgtaactccgtaatcccgtacccaaaggtaacgtaaccgtaacgttacggtaaacccggaaaaaccggtaccgggtttaagttaaaccttaaacgtaaaacgtaacggtaaaccgtaacggttacgttaaagggtaacggttaacggaacgggtaacgtaccggggtcttaacgtacttaaccgtttagttacgggtacggttacggtaacgttacctttaagtacgttaactttacggttagggttacgggggttacgtttaacggtttccgggttaacgggaccccttaaggaccggttaccgggggaccgtaacggggttaccgttcgggttaccgtttaccggtcccgg

SEQ ID NO: 37304 - DNA, 818 bp, Homo sapiens
  misc_feature: GYAE6OF02HFR2A.44.19.B08.1.454.CMB.1.raw
  modified_base (156)..(156): a, c, t, g, unknown or other
  misc_feature (156)..(156): n is a, c, g, or t
  modified_base (307)..(307): a, c, t, g, unknown or other
  misc_feature (307)..(307): n is a, c, g, or t
  modified_base (489)..(489): a, c, t, g, unknown or other
  misc_feature (489)..(489): n is a, c, g, or t
tcagacagtatatacacgaccggtgctcgatttagtgagtcagtaagggggggagaggagccccagccttgggattcccaggttgttttcattcagtgatcaggactgaacacagagactcacagtggagtttggctgagcgtgtacttttcctgntgtacttaagttttaaaaggtgtccaggttgtggtacggtgcgtaggttgggtggtaggttcgggtaggggggttaggtttaagggtaaacggtccgggtagggggtacgttacccgttacgacgttcgtaccgtggtcactcggtccttntcggttattcgtaacgttttcgaacgttaaccggccgttggacttacggtaccggtcgggtacccggcgacggtccgtaccggaagggggacgggtacgtgggtacgggttcgggttcggaccgttaagttaaccgtaacgtaaacggtcgttacgggaacgggttaccgggaataaccggngtaaacgtaccggtacgtaacccggtcgaacccggtaaccgaaggtaaaccggataaggttaaccctacgtaaccgtacttcgaacgaaggagtaacgtagtaaacgtaaacggaaaaggttagtacgttagttccctaggtacgacgtaagggtaacctacgaaaccggacgtaacggtaaccgtaaaccgaacggtaacggaccctaacgtaccgtcgttaacgttacgttagcgggttagtacggttagttcggttcggtaccgtacggaccgtaaccgggcttaccgggactacccgccggtttccaacgtcgtacccctaccgg

SEQ ID NO: 37305 - DNA, 851 bp, Homo sapiens
  misc_feature: GYAE6OF02IC0EV.44.19.B08.1.454.CMB.1.raw
  modified_base (103)..(103): a, c, t, g, unknown or other
  misc_feature (103)..(103): n is a, c, g, or t
  modified_base (155)..(155): a, c, t, g, unknown or other
  misc_feature (155)..(155): n is a, c, g, or t
tcagacagtatatacacgaccggtgctcgatttagtgagtcagtaaagggaaaggggatcaggacttctcagttcatcttctcaccatgaggctccctgctcngctccgtggggctgctaatgctctggactcccgtcgggacccagtggcaagngttgttgtcgcgtccgaacccagtcccttccccctctcctcgttcgtcccgtacccgaccccgtcggaaccgcggccccggtccttaccgtagttcgttcccgtaggacctaacgttacgtaacggtacacgtaccggtccctaccgtgaccttaggtagtacggaagtaacggtaaacgactatttagttacgtaacgttacggtacctaggaaccagggtaccgtacggaacgtccgtaacgtcccgtcgcgtacctccttaccgtacactttaccgtagttccgttaacttttcgttaacgacccggtctttaccgtccgttgtaagggtaccgtaccgtaccgtaatacgggtttacgtacgagggttccggaggtacggggcggggttaacggattaacgtacgttaaccaacgtaacgtaaagtacgtccggtaaacgggccgggttagaacggttacgtaagggacggtaaacggttttcgggtttaaagttaaccggttttaagttaccgtacggttaaccgtaagttacggtaaacggtaaccgttaacgttttaccgttttccggttaaacccccggggtttacctacccgggttaacccggggttaaacgggaaccgggttaaacggtaaccgggttaagaaaccggttaaccggaacggttaccgtaagggtcttaacccgggg

SEQ ID NO: 37306 - DNA, 889 bp, Homo sapiens
  misc_feature: GYAE6OF02HNG1J.44.19.B08.1.454.CMB.1.raw
  modified_base (133)..(133): a, c, t, g, unknown or other
  misc_feature (133)..(133): n is a, c, g, or t
  modified_base (190)..(190): a, c, t, g, unknown or other
  misc_feature (190)..(190): n is a, c, g, or t
tcagacagtatatacacgaccggtgctcgatttagtgagtcagtaagggggggagaggagccccagccttgggattcccaggtgttttcattcagtgatcaggactgaacacagaggactcacagtgtgttgntgagcgtggttctcgttgttagtaacgtttaagtcgtactagtgtagaggtgcgtcngtagtggacgtcgtaggaggagtcgttacgccgtacggccgggtccggggtaccaggaccgtaccttccgtacgtcgtcgacgacgtccgtcggtacggtcctaccgtaccgtacgacgaacaccgaacctaacgtagtagtggtacggttccgggtaccaccggtcgacccggtacgggaacggggtacggggtacggtacgggtggttacggttaccgtacgttacgtacgttttaacgtttaacgttacggttaggttacgtttaaacttaccgtaaaccgttaacgttaaccgtaaccggtacctaacggtaaccggtttaccggtaaacgggtacccggttaccgtaaaccgttcccgaaccgtttaccgtacccgtaaccggtaaaaccgggtaaactttaacccggtaacccggtaaaacggttaacccgttttaacgttttaaccgtaacttaaaacctaacggttaaaccaaacccgttaacgtaacgggagggtaaacccgtacggaaacccgccgttaacccggttacgtttaacgtcgttaaaccgcggtaaccgggaccgaaaacgtgtaacccgggtacgccggttacggttacgggtttaggtttacttacgttttaacggttcgttacgtaccgggttccgggaaccggtaacccgggtacgggtaccccgttggtacccccg

SEQ ID NO: 37307 - DNA, 706 bp, Homo sapiens
  misc_feature: GYAE6OF02GCDKS.44.19.B08.1.454.CMB.1.raw
tcagacagtatatacacgaccggtgctcgatttagtgagtcagtaagggggggagaggagccccagccttgggattcccaggtgttttcattcagtgatcaggactgaacacagagactcaccatggagtttggctgagctggtattttccttgcttgcttaatttttaaaaggtctccagtgtgaggtgcagttggtggagtcggtgggggtaggtttaggtaaagccgtggggtacgttccttagacctctctgtcgcacgtcctcgtagtactttctacctttcaacgtaccgccgtggatcgaacccgttcggtacccgcgacggtccgtaccggaggggacggggcgtagggtaggttggggttacggtacggttaatacggaaaccgtaacgcgtacggacgggtcggacgaggacacggactacgcgtcgaccgacccggtaagaacggcagtactaccgactactcacagtagtacgtagtaataacgaaacggtatacgttgtccgtaccgagactaagtacgtaacaaccgctccgaaaggaaccctacgggaacgacgtaccaaccgggtccctttaagtaccttacgtcgttacgggtggttacgttcggtacgttaccgggttccggaaccggttaaccggtaccggtacggttccccgacgttaccctcgacccgttaccgcctaaccccgg

SEQ ID NO: 37308 - DNA, 680 bp, Homo sapiens
  misc_feature: GYAE6OF01BDQDP.52.63.F08.1.454.CMB.1.raw
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgcacgacgggtccgtcgggcccagtctggtttgacgcagcccgccctcgagtgtctggcccgggccccgggacagcgaggtccaccactcctccgtgcctcgtaggaacgcgacgacccagacctaggttagggaattaaattgtcgtcctccgtaggtaccagcagcctaccgaaggaacccaaacccctaaactcctacactctatcgaacaatgaagtacgaccgtacctagaacgtaactccgtagaccgttattttcgcggtacctaccgtaagttccgaggtaccgtaggtaccaccggaccctacccgtgggacctacgtacccgaaccggtacctccgaagtaccggtgaccggacgacggccctaagttacgttacgcgtaccgactactcgtacggttagggcgtacggactacggtaaccctaaacgtaacgttcgggtacgacgttacggttccggggacgggaaaccgggtaacccttaaggggttacccgaacccggttccggtaaggtcccggtaaacccgg

SEQ ID NO: 37309 - DNA, 590 bp, Homo sapiens
  misc_feature: GYAE6OF01ANHZV.52.63.F08.1.454.CMB.1.raw
  modified_base (358)..(358): a, c, t, g, unknown or other
  misc_feature (358)..(358): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgcggccccgggacagcaggtcaccatctcctgctctggaagcagacccagcattgggataattatgtctcctggtaccagcagctcccaggaaccaacccccaaactcctcactctatgacaatgataacgcgaaccctcgaaggtactcctgaccgtatttcnggtcctcaagtctggctacggtcacgcccaccgtgggaccactccgaccggacctccgagacgtggaccgacggacggccgtattacgttacgtcgaccgctacgtccgaagtgggacttgggaccacgtaccctaaaacgcgttacggtcggcgtaacggtccggggacgggtaacgggtaacccgtaagggtttaccgacccggttaccgtaacgggtcgtaaacccggg

SEQ ID NO: 37310 - DNA, 792 bp, Homo sapiens
  misc_feature: GYAE6OF01B35AY.52.63.F08.1.454.CMB.1.raw
  modified_base (221)..(221): a, c, t, g, unknown or other
  misc_feature (221)..(221): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgcacagggtcctgggcccagtctggtttgacgcagccgcctcagtgtctgccggcccgggacagcaggtcaccatccnctgctctggaacgcagacccagcagttgggagttaattatgtctccgtggtaccagcacgcctacccgaaggaacccaaacccccaaactccctacatactatacgaacaatagaataacgccgaaccctacgaacggtaacttcccgtacgtaacccgttattttccgtacgggtacccttaccgtaaacgttccggtacgggccgtaacgggttcccgaacggtacccccgtaacccggttcggggacctaaccggttacccgaacccgggtacctacccgaacggtacccggttacggggacccggaaccggtaaccggggtacccgttaaacgttttaaccgtttaaccgtcggtacccgtcctaaacgtttccgaagggtttcggggaacgttcgggaccgtaaaccggtaacccgttaaaaccgaccgggttcgggttacggtaacccggttacgggtttaccccggggggacggggttaaacccggggtaaacccgttaaacggggtttaccccggtaaacccccgggttttcggtaaaccggggtcccgtaaaacccccgggg

SEQ ID NO: 37311 - DNA, 563 bp, Homo sapiens
  misc_feature: GYAE6OF01DC4YZ.52.63.F08.1.454.CMB.1.raw
  modified_base (207)..(207): a, c, t, g, unknown or other
  misc_feature (207)..(207): n is a, c, g, or t
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
  modified_base (439)..(439): a, c, t, g, unknown or other
  misc_feature (439)..(439): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgccggccccgganagcaggtcaccatctcctgctctggaagcagacccagcattgggagtaattatgtctcctggtaccagcagctacccaggaaccaacccccaaactcctcatcctaatgaacaatcgataacgcgaccctanagtaacttccagtaccgtattttcnggcttacaagtctggcaggtcacgccaccgtggcactcaccgactccagcgtcggacgacggcggaaaaaccgtnttaacgttactgccgacgactcgagtgggatggcgacgacctaaacacgtgtcggacgtaggttccgggacgggtacgggaacccgtaacggttacgtacccgttaccgtacggtcgaacccgg

SEQ ID NO: 37312 - DNA, 524 bp, Homo sapiens
  misc_feature: GYAE6OF01EX0SY.52.63.F08.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (305)..(305): a, c, t, g, unknown or other
  misc_feature (305)..(305): n is a, c, g, or t
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (436)..(436): a, c, t, g, unknown or other
  misc_feature (436)..(436): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgcggccccggganagcaggtcaccatctcctgctctggaancagacccagcattgggagtaattatgtctcctggtaccagcagctcccaggaaccaacccccaaactccncatctatgacaatgataagcgacctnagtaacttcctagaccgtatttcnggctacaagtctggcaggtcacgccaccgtggcatccgaccggactaccgacgacgtggacgacgaggccgtattactacngcgcatcgagtgggatcggacagacctaaacgcgtggtgactaggttccggacggacggacctaggttcgaccgtcgtaggcgaccgg

SEQ ID NO: 37313 - DNA, 565 bp, Homo sapiens
  misc_feature: GYAE6OF01EWWF2.52.63.F08.1.454.CMB.1.raw
  modified_base (208)..(208): a, c, t, g, unknown or other
  misc_feature (208)..(208): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
tcagcgcagtacgacacgaccggtgctcgatttagcgatcgtataaagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgcggccccggganagcaggtccaccatctcctgctctggaagcagacccagcagttgggagtaattatgtctcctggtaccagcagcctcccaaggaaccaaaccccccaaactccctacatctatgacaatgataagcgaccctnagattccngactntttcngcctacaagtctggcaggtcacgcccacccgtgggcaagtccgacccggtactcccgaggacgtcgggccgacggacggccgtaagttactacgtgacgtcagtacagtgggatacggccagtaccctaaacacgtggtcgtacgtacgttccgggacggaagggacccgtaaggttacgtacccggtcgtacggtccgaacccgg

SEQ ID NO: 37314 - DNA, 807 bp, Homo sapiens
  misc_feature: GYAE6OF01EH2JA.52.63.F08.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgcggccccggganagcaggtcaccatctccngctctaggaagcacgacccagctagttgggacttaattagtgtctccgtaggtaccagcacgcctcccgaaggaacccaacccctaaactcctcactactatacgacctaaagtagtaacgtaacgaccgtacccgtacgtaacgtaacttaccgtacgtaccgttacgtttacgttcgtaccgtaccgtaacgtacgtacggtacgtacggtaccgtaccgtacccgtacccggtaccgggtaccgtaaccgtacccggtacccggtaacccgtacccgtaaccggtaaccggtaccgggtacccggtaaccgggtaaccgggtaacccggttaaccgtttaaccgtttaaccggttaccggtaccggtaaccgtaaccgttaaccggtaacggttaacggggtacgggtaccgggtaccggtaaccggtaaacccgttaaaacccgtaaccggttaccgggttacgggttaaccggttaccgggttacccggggtaacccggggtaacccgggtaaacccgggttaaaccgggttaacccgggttaaccccgggttaacccggttaacccgggtacccgg

SEQ ID NO: 37315 - DNA, 639 bp, Homo sapiens
  misc_feature: GYAE6OF01B4T2O.52.63.F08.1.454.CMB.1.raw
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgcacagggtcctgggcccagtctggtttgacgcagcccgcctcagtgtcngccggcccggganagcaggtcaccatctcctgctctggaagcacgacccagcgattggggataattatgtctcgtaggtaccagcacgcctcccaaggaaccaaacccccaaacgtccctacactctactagacaatgaataacgccgaccctagaacggtaacttccgtacgtaccgtattttccgcggtacctaccaaaggttctaggacctaggtccacgcctaacccgtgggaccacgtacgacccggactacccgagtaccgtcggaccgaacggacggtacccgtaatttacgttaacgcgaccgctagtaccgagttgggaagtcggaacacggtacctaaacgacgttaggcggtcctaacggttcggggaccggtaacgggtacccgtaaacgggtttaccggaacccggtttaccgtacgggtcctaaacccgggg

SEQ ID NO: 37316 - DNA, 720 bp, Homo sapiens
  misc_feature: GYAE6OF01CUKSO.52.63.F08.1.454.CMB.1.raw
  modified_base (226)..(226): a, c, t, g, unknown or other
  misc_feature (226)..(226): n is a, c, g, or t
  modified_base (636)..(636): a, c, t, g, unknown or other
  misc_feature (636)..(636): n is a, c, g, or t
  modified_base (653)..(653): a, c, t, g, unknown or other
  misc_feature (653)..(653): n is a, c, g, or t
  modified_base (708)..(708): a, c, t, g, unknown or other
  misc_feature (708)..(708): n is a, c, g, or t
tcagcgcagtacgacacgaccggtgctcgatttagcgatcgtataagggggaagctctgcttcagctgtgagcgcagaaggcaggactcgggacaatcttcatcatgacctgcctccctctcctcctccacccttctcattcactgcacgacgggtcctcgggccctagtcgttggttcgacgcacgcccgccctcgagtcgtcgtcggcccgggaccccgggtanatccgacggtaccaccctacttcctccgtcgtcctcggtacggaaacgccgaaccgacccgagtacgtaaggtttaggggaatttaaacttacgttcgtccgttaccgtacggttaacccgagccaccggtacccgtaacccgaaccggaaaccccaaccccctaaacctccctactactactaactacgtaactaagtacgaacgtaacggacccgtaacctacgtaacggtaacttccgtaacgttaccgttatttcgacgtactaaccgtacgttcgtccgacgtagtacccgaacgtccccgtaacgtcggacctacgtaccgaccggtactaccgacgacggtcggaccggacgtacgtaccttaattaccgtacgcgacgtacctagcgtaaggtcgggtaacncgaacaacgtaccgtanggtgtcggagtaagggtccggacgggaacttacggtaacgttcgaaccggttacnggtcccaaccgg

SEQ ID NO: 37317 - DNA, 709 bp, Homo sapiens
  misc_feature: GYAE6OF01DDQNC.52.63.F08.1.454.CMB.1.raw
tcagcgcagtacgacacgaccggtgctcgatttagcgatcgtataagggggaagctctgcttcagctgtgagcgcagaaggcaggactcgggacaatcttcatcatgacctgcctccctctcctcctcacccttctcattcactgcacagggtcctgggcccagtctggtttgacgcacgccgccctcagtcgtcgtcggccggccccgggacagcaggtccaccatcctcctgcctcgtaggaacgccacgaacccagtcctaaggtttagggaagttaaatttagtcgttacctccgtacgggtaaccagccgacgtccctaccccgaaacgggaaaccccaaacccccgaaacctccctactaactaccttaagtacgaaactaaagttacgaactaacggacccgacccttacgaacggttaaaccttcccgtacggtacccgttacttttcgaccggtcctaccgaagttcgtggacgtacggtacaccgtcccgaccgtgggactactccgaacccggtactaccaggtccgtacgggccgaacgtacggtacctagtttacgttacgcgtaccactacgtcgacggtgggtacgtacggactaaccgtacctaaacgtcgtagggtcgacgtacggttaccggggacggtaacgggtaccctaagggttccgacccggtttacggacggttccgaacccggg

SEQ ID NO: 37318 - DNA, 847 bp, Homo sapiens
  misc_feature: GYAE6OF01ED46T.52.63.F08.1.454.CMB.1.raw
tcagcgcagtacgacacgaccggtgctcgatttagcgatcgtataaagggggaagctctgcttcagctgtgagcgcagaaggcaggactcgggacaatcttcatcatgacctgcctccctctcctcctcacccttctctattcactgcacgacgggtccgtcgggccctagtcttggtttcgacgcacgccgcctcagtgtctcggccgggccccggacacgcgacggtccacctactcctccgtcgtcctcgtaggaacgccgaacgacccagacgtaagttagggtaagttaattacgttcgtccgttaccgttacggtaaccacgaccgaccggtaccctaaccccggaaaccggaaaaccccctaaaacccccctaaaccttcccctaactaaccttaccttaacgtaacggtaaacctaaagtaacggtaaacgtaacccggacccgtaaccctaacgtaaacggttaacctttacccggtacgttaacccggtttaacttttccggtaccggtacccttaaccggttaaacggttcccggtacgggtaccgtacgggtacccgtaacccggtaccccgtaacccggtgggaccctaaccggtacccgtaaccgggtaccttacccggaacgtaccggtacgggaccgtaacggtaccggtaacgtttaacgttaccgtaacgtccgaacctacgtacgtacgtaaggttacgggaacgtcggaaccgaaccgtaaccgttaaacgacggttcggtacggtacgtaacgggttccgggaaccgggttaacgtaaccgttacggtacccggtacccgttacggtaaccgtccggaaacccggg

SEQ ID NO: 37319 - DNA, 725 bp, Homo sapiens
  misc_feature: GYAE6OF01DOMNR.52.63.F08.1.454.CMB.1.raw
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctggccggccccgggacagcaggtcaccatctcctgctcgtggaacgcacgaccagctagtgggataattatgtctccgtggtaccagcagcctacccaggaacccaaccccaaactcctaccgatcctatacgaacaatagaataacgccgtaccctacgtaacgggtaaacttcccgtacgtaaccgttattttccgtacggtccttacccgtaagttccgtagggacctaacggggtccctaaccgggaccctaacccccggttggggaccctaaaccgttcccgaaaccccgggtacctccgaacggtaccgttcgggggacccgaaccgggtacgggtacccgttaattttaaccgttacgtccgaccgtacctaagttcccgtaagggtacgggttagacgggtacccaaggttaccccgtaaaagtccggtagggtcggaacgttacggttacggggacccggggaaggtaaacccggttaacggttacccggaacccgttcccggtaagggtccggaaaccccgg

SEQ ID NO: 37320 - DNA, 727 bp, Homo sapiens
  misc_feature: GYAE6OF01CPDLA.52.63.F08.1.454.CMB.1.raw
  modified_base (590)..(590): a, c, t, g, unknown or other
  misc_feature (590)..(590): n is a, c, g, or t
  modified_base (597)..(597): a, c, t, g, unknown or other
  misc_feature (597)..(597): n is a, c, g, or t
tcagcgcagtacgacacgaccggtgctcgatttagcgatcgtataagggggaagctctgcttcagctgtgagcgcagaaggcaggactcgggacaatcttcatcatgacctgcctccctctcctcctcacccttctcattcactgcacgacgggtcctcgggccctagtcgtggttcgaccgcacggcccgccctgacggtcgtcgtcggccggggaccccgggacacgcgtacggtaccaacctatcctccgtcgtacctcggaggaacgcaacgacccgtagacgtaaggttagggtaattaattacgttcgtccgttaccgttacggaccacgcgacgaccctaacccgaacgaaaacccaaacccctaactcctacaacgtactaacgtacgaaactaagtagtaaacgtaacgcccgtaaccgtaagaaacgggttaccttacccgtacggttaccgttacgttttacgaccggtactaccgtaaggtcgtagggaccacggtaccaccgtacccgaccggtggaacctacgtaccgaaccgtaccacgacggtacgtcggacgacgtacgtactattactacgngacctanatcgaggtcggaactcggaactaccggtaaccaaacgttcgagggtccggtacgtacgggttaccggggaacggtaaccggtaacgtaacgggtttcccgaaccggttaacggtcgtaacccggaaccgg

SEQ ID NO: 37321 - DNA, 762 bp, Homo sapiens
  misc_feature: GYAE6OF01E2YFJ.52.63.F08.1.454.CMB.1.raw
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctggcggccccgggacagcacggtcaccatctcctgctcgtggaagcacgacccagcagttgggagttaattatgtcctccgtggtacccagccacgtcctacccgaacggaaacccaaacccccctaaaactccctacaacttactatacgaactaatagaacgtaacgaccgtacccctacgaaacggtaacttcccgtacgtaacccgttattttaccgtcggtacctacccgtaaacggttccgtagggtaccgtagggtacccacggacccccgtaaccccggtggggaccctaacgttacccggaacccgggtacctaccccgaagggacccgttcggggaccgaacccggtaacgggaccccgtttaattttaaccgtaacgttcggaccgtacctaagttaccgtaaggtcggggaactcgggaaccgtaaacgtaccccgtaaaaacgccgttggtcgggtaccgtacgggttcccgggggaaccggggtaaacgggtaaccccgttaaacgggtttcccggaacccggttcccggttaagggtccccgtaaaccccgggg

SEQ ID NO: 37322 - DNA, 682 bp, Homo sapiens
  misc_feature: GYAE6OF01A5Y0C.52.63.F08.1.454.CMB.1.raw
  modified_base (214)..(214): a, c, t, g, unknown or other
  misc_feature (214)..(214): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (339)..(339): a, c, t, g, unknown or other
  misc_feature (339)..(339): n is a, c, g, or t
  modified_base (540)..(540): a, c, t, g, unknown or other
  misc_feature (540)..(540): n is a, c, g, or t
tcagcgcagtacgacacgaccggtgctcgatttagcgatcgtataagggggaagctctgcttcagctgtgagcgcaggaaggcaggactcgggacaatcttcatcatgacctgcctcccctctcctcctcacccttctcattcactgcacagggtcctgggcccagtctggtttagacgcagcccgccctcagtgtctggccgggccccggganagcaggtccaccattctcctgctcgtaggagcacgacccagcagtggatattntgtctccgtagtaccngcacgcctaccgaacgaaacccaacccccaaactcctacatcctatacgaactaanagtaacgtaaccgcccgtaaccctacgacggtaaacttcccgtacggtaaccttcgttttaccgtcggtaccctacgtaacgttcgtacggacgtacgggtccaacgtacccgacccggtgggtacaccgtaccgaaccggtacctaccgacgtacggtcggacccgtaacggacggtacctagttactaccgtgacccgntacgtccgtaagtgggtaacgtcggaccgtaacgtaaccgtaactacggtacggtacgtaccgtacgggttccgggaaccggggttaaggacccgttaaaggttacccggtacccgtaccggttacggcccggtaaacccgg

SEQ ID NO: 37323 - DNA, 746 bp, Homo sapiens
  misc_feature: GYAE6OF01AW196.52.63.F08.1.454.CMB.1.raw
  modified_base (232)..(232): a, c, t, g, unknown or other
  misc_feature (232)..(232): n is a, c, g, or t
  modified_base (624)..(624): a, c, t, g, unknown or other
  misc_feature (624)..(624): n is a, c, g, or t
tcagcgcagtacgacacgaccggtgctcgatttagcgatcgtataagggggaagctctgcttcagctgtgagcgcagaaggcaggactcgggacaatcttcatcatgacctgcctcccctctcctcctctacccttctcattcactgcacgacgggtccgtcgggccctagttcgttggtttcgaccgcacggcccgtccctcgaggtcgtcgtcggcccgggccccggganaggccgacggtccacctacttccgtcctgtcctcgtggaacgccacgacccagctaggtagggtaattattagtcgtccttccgtacggacccagcgaccgtcccgtaacccgaaaccggaaacccctaaaacccctaacgtccctacacttactagtacgaaactatacggaactaaccgaccgtaacccgtagtaacgtaccttccgtacgtacccgtttagtttccgaggttacctaccgtaggttccgtacggaccgtacgtccgaccgtcccgtaccggtcggacctaccgtacccgaaccggtcctaccggacgtacggtcggacgtaaccggaccggtacttacttacgttacgccggtacaccgtagttaccggaggtcggtanacccgggacttaaccgaaccgttaacggtcgttacggcggttacgaccgggttacgggacggtaaacgggtacccgttacgggttacccggtaacccgtcggttaaccgccggaaccccggg

SEQ ID NO: 37324 - DNA, 687 bp, Homo sapiens
  misc_feature: GYAE6OF01EXOVA.52.63.F08.1.454.CMB.1.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagttctggtttgacgcagccgccctcagtgtctggccggccccggganagcaggtcaccntctcctgctcgtggaagcacgacccagctattcgggaagtaacttatgtactcctggtaccagacagctacccaaggaaaccaacccccaaactcctacactctatagacaagtgaataacgccgaaccctcgaagggtaactttccctagacccgttattttccgacggtacctacctaaggtcgttacgggcaacggttccaacgtcccaaccccggttgggcctaacgtacccacccgggtacctacccgaaggtaccgtcgggaccgtaacgggacggaccgtaactttacgttaacgttcgacccgtacgacgttacgaaggttcgggtaagtacggacgtaaccggaacccttaaacgacccggttggtccggtacggtaacggttcccgggcgggtaaacggggacccgttaaacgggttccggaaacccggttcccggtaaacggtcgtaaacccgg

SEQ ID NO: 37325 - DNA, 684 bp, Homo sapiens
  misc_feature: GYAE6OF01EWFRQ.52.63.F08.1.454.CMB.1.raw
  modified_base (192)..(192): a, c, t, g, unknown or other
  misc_feature (192)..(192): n is a, c, g, or t
  modified_base (388)..(388): a, c, t, g, unknown or other
  misc_feature (388)..(388): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcgactgcacgagggtcctcggcccagtctggtttgaccgcacgcccgtccctnagtcgtctcggcccgggtccccgggactagccgacggtccaacctacttcctcctgcctgtacggaacgcacgacccagacgtagttagggaacgttaattacgtcgttcctaccgtacgtaccagtacacgtccgtacccgaacggaaaccctaacccccgtaactccctctacttactactacgaactaagtanactaacgacccgtaacctacgtaagtaccttaccgtcgtaaccgtttcgtttcgcgtacctacgtagtcgtcgacgtacgtcgaacgtcccgtaaccgtggacttacgtaccgacccgtactaccgaacgtcggtacggaccgacggtacgtaccgttattactacgcgacgtaccgagttcgaggttacgacgtacggactaaccggtacccgtaaagccgttacggacggtaccgtacggtaccggacgggtacgtaacgtccggtacggtacccgtcgtaggtaccgacccgg

SEQ ID NO: 37326 - DNA, 814 bp, Homo sapiens
  misc_feature: GYAE6OF01APUOE.52.63.F08.1.454.CMB.1.raw
  modified_base (160)..(160): a, c, t, g, unknown or other
  misc_feature (160)..(160): n is a, c, g, or t
tcagcgcagtacgacacgaccggtgctcgatttagcgatcgtataagggggaagctctgcttcagctgtgagcgcagaaggcaggactcgggacaatcttcatcatcgacctgcctccctctcctcctcacccttctcattcactgcacgacgggttccncgggccctagttccttgggtttcgaccgtccgacgtcccgtccctacgtacgttcggtccgtcgggcccggggaccccgggaacacggaccgaacgggttccaacctacttccgtccgttcgaccgttcgtagggaacaccgaaccggaacccaggtacctagggttacgggtaaattaactttagtcggttacctaaccggtacgggtaacccaggaccaaccggtaccctaacccggaaacggtaaacccctaaaaccccctaacgtcctaaccacgttacctaagtaacgaaactaagtaggtaaaccgtacggacccgttaacccaaggtaacgttaaacttccgtaacggaacctttacgtttacgtaccgtactaaccggtttaacggtccggtacggtaacgtaccgacggtaccgaacccggtacgtaccggactaaccgtaccggaacccggttccgaaccgtaccggtaccggaccggtaacggtaccggacgttaacccgttaagtttaacccgtacgtccgtaacgtaccgtaagtacgtaacggtacgtacttacgaactaccgggtaaactacggtaccggttaggacgtacgtaggtacgggacgaagtaccgtagtccgaaccgtgtacgcctaacgg

SEQ ID NO: 37327 - DNA, 830 bp, Homo sapiens
  misc_feature: GYAE6OF01ANUX8.52.63.F08.1.454.CMB.1.raw
  modified_base (135)..(135): a, c, t, g, unknown or other
  misc_feature (135)..(135): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttcncattcactgcacgaggtcctgggcccagtctggttgacgcagccgcctnagtntctggccggcccgganagcgaggtccaccattccgtcctgccttcgnggaactccgacgacccagtactaggttacgggtagttaattatcgttacctccgttacggtaccaggtctacgcccgttaccgaacgaaaccccaaccccctaacgtcctacgactaccgttaacacgtaacaacgtacgtaacgtaaaccgtccccggaacccgttacggaaaccggttaaccttaccggttacgtaacccggtttacttttaccggcgttacccgtaaccgtaacgttccgtaccgggtagtaccggtaccgtaaccgtccccggtaacccgggttacggtaccgtaaccggttaacccgtaaccccggggttaacccgttaccggaaaccgggtacccggttaaccgggggaaacccggtaaacccggggtaacggttaaccccccgggttaatttttaaacccgggtttaaaccggtttccgaacccgggtaacgttaaccgggttacctaaaccgggttacgggtaacggttacggaaccctaccggttaaacgttaaaccggcgttacggtcggttacgtacgggtcggacgggtaccgtaacggtacggttacaccccggtggtaccgtccggaaccg

SEQ ID NO: 37328 - DNA, 805 bp, Homo sapiens
  misc_feature: GYAE6OF01CK70K.52.63.F08.1.454.CMB.1.raw
  modified_base (725)..(725): a, c, t, g, unknown or other
  misc_feature (725)..(725): n is a, c, g, or t
tcagcgcagtacgacacgaccggtgctcgatttagcgatcgtataagggggaagctctgcttcagctgtgagcgcagaaggcaggactcggacaatcttcatcatcgacctcgcctccctctcctcctcctacccttctctacttcactgcacgacgggtccgtacgggccctagttcgttgggtttcgaccgacaccggcccggccctcgtacggttcgtccgtcgggcccggggaccccgggaacgacggaccgtacggtcccaaccgtacttccgttccgtacgtccgttacggtacgggaacgtccgaaccgacccgacgtacgtaacggttacgggtaatttaacgttacgttccgttaccgttaccgttacggtaaccgtacggtaccgtaaccggtaccccgtaaccccggtaaaaccggaaaacccccctaaaaccccccgtaaacccgttccctaaccgttaacgttaccgttaacgtaccgtaaacgtaagtaacggtaacgtaaccgacccggtaaccctacgtaacggttaaccttccggtaacgttaccgtttacgtttcgtacgtacccgtacgtacgtacgtcgtacgtacgggtacaccgtacccgccggtacgaaccttacgaccgaaccgtaccgtacgcggtaccgtacgggcgtaaccgggactacgttaactcgttacgcgacgtacacgtcgtaggacgacgngaccgaactacgacgtcgtcggtcgtaggtacggcggacggtaccgtaacgtcggtaccacggttacgcggtaccacggg

SEQ ID NO: 37329 - DNA, 852 bp, Homo sapiens
  misc_feature: GYAE6OF01BSXMB.52.63.F08.1.454.CMB.1.raw
tcagcgcagtacgacacgaccggtgctcgatttagcgatcgtataagggggaagctctgcttcagctgtgagcgcagaaggcaggactcgggacaatcttcatcatcgacctcgcctcccctcctcctcctcctacccttctcattcactcgcacgacgggtccgtcgggcctagtccgttggtttcgaccgcgacgcccgtccctcgacggtcgtcgtacggcccgggaccccgggacacggccgacggtccacctacttcctccgtcgtcctcgtaggacgaccgaacgacccaggtaccgtaggtttagggtaagtttaacgtttacgttcggttacccgttacccggttacgggtaacccgtacggacccgtaacggtaccccgtaaccccgaaaaccgggaaaccccctaaaacccccctaaccttccctaccgtaacttacgtaacgtacgaaactaacgtacgaaccgtaccggacccgtaccgtaacgtaaggttacccgttccgtacgtaccgtttacgtttaccgacgttacccgtaacgtacgttcgtacgaccgtacggtaccgaccgtcccgtaccggtacggcctaccgtacccggacccgtacgacccggtacgtaccggggtaccggtaccgggaccggtaacgggttacctaacgttttacggtaccgtcggaactacgttacgtaacggttacggtgggaccttaaccgggactaacccggtaaaccgttaaccggtaggtccggtacggtaccgttaacgggtcgggggacccgtaacgggtacccggttacggtaccgttacccggttacgaaccggggtccctaaccgggg

SEQ ID NO: 37330 - DNA, 533 bp, Homo sapiens
  misc_feature: GYAE6OF02GTBET.52.63.F08.1.454.CMB.1.raw
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgcacagggtcctgggcccagtctggtttgacgcagccgccctcagtgtctgcggccccgggacagcaggtcaccatctcctgctctggaagcagacccagcattgggagtaattatgtctctggtaccagcagctccaggaaccaacccccaaactcctcatctatgacaatgataagcgacctnagatcngacgtatttcngctcaagtctgcagtcagccaccgtggcactcaccggtacctccgacgacgtggaccgacgacggccgatttacttactcggacgacgatcgagtgggatggactacgacctaacacgtcggtcgacctagttccggacgggtagggaccctaaggttaccggaccggtaccgttacggtctaaccgg

SEQ ID NO: 37331 - DNA, 503 bp, Homo sapiens
  misc_feature: GYAE6OF02FZ8OA.52.63.F08.1.454.CMB.1.raw
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
  modified_base (454)..(454): a, c, t, g, unknown or other
  misc_feature (454)..(454): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgcggccccgggacagcaggtcaccatctcctgctctggaagcagacccagcattgggagtaattatgtctcctggtaccagcagctcccaggaacaaccccaaactcctcatctatgacaatgataagcgaccctnaggaattcctgaccgattttcnggctccaagtctggcaggtcagccaccctgggcatcaccggactccagactggcgacgaggccgtattacttactgcgcatcagtgggatggcagcctaacnctgtggcagttcggacggaggaccaaggttcgaccgtccgtaggtcacg

SEQ ID NO: 37332 - DNA, 705 bp, Homo sapiens
  misc_feature: GYAE6OF02JC3T6.52.63.F08.1.454.CMB.1.raw
  modified_base (335)..(335): a, c, t, g, unknown or other
  misc_feature (335)..(335): n is a, c, g, or t
tcagcgcagtacgacacgaccggtgctcgatttagcgatcgtataaggggaagctctgcttcagctgtgagcgcagaaggcaggactcgggacaatcttcatcatgacctgctccctctcctcctcacccttctcattcactgcacagggtcctgggcccagtctggtttgacgcagccgccctcagtgtctgcggcccgggacagcaggtcaccatctcctgctctggaagcagacccagcattgggagtaattatgtctcctggtaccagcagctcccaggacaaccccaatcctcatctatgacaatgataagcgaccctcaggaacttccngtacccgtatttttccgacgggtccttacccgaagtcttgggacctacgggtccaacggtcccaaccccgttgggggacctaacgttcccgaacccggggtaaccttaccccgaacggtacccgttacggggacccgaaccgggaacgggtccccgtaaagtttacgtttaaacccgttcggacccgtaccgtaacgttccgaaacggttcgggggtaaattcggggaccgtaaccggtaccccgttaaaacgtaccgttagggtacgggtaaccgtacggtttacccggggaccgggtaaacggggaaccctaaacgggtttccggaaccccgggtttacccgttaacggggtaaccgtaacccccggg

SEQ ID NO: 37333 - DNA, 718 bp, Homo sapiens
  misc_feature: GYAE6OF02FZT9F.52.63.F08.1.454.CMB.1.raw
  modified_base (558)..(558): a, c, t, g, unknown or other
  misc_feature (558)..(558): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgcacagggtcctgggcccagtctggtttgacgcagccgccctcagtgtctgccggccccgggacagcaggtcaccatctcctgctctggaagcacgacccagcagttggagtaattatgtctcctggtaccagcacgcctcccgaaggaaccaacccccaaactcctacactctatacgaacaatgaataagccgaccctacgaacggtaactttcccgtaggtaaccccgttattttttccgtacgggtacccttacccgtaaacggttccgttacgggaccgtaacgggttacccgaacggccccctaaccccgggttggggaccctacgttacccgaaccccgggtaaccttcccgaacggtaccgttcgggacccgaacggaccgggtaccgtaacttttaacgttaccgnggtccgacgtacgttccgaagttggggacttcgggcctaacggaaccctttaaacgacggttcgggttacggtaccgtacggttaccggggaccgggtaacgggtaacccgttaaggttacccggaccccggtttaccgttacgggtaccctaacccggg

SEQ ID NO: 37334 - DNA, 669 bp, Homo sapiens
  misc_feature: GYAE6OF02HEISK.52.63.F08.1.454.CMB.1.raw
  modified_base (207)..(207): a, c, t, g, unknown or other
  misc_feature (207)..(207): n is a, c, g, or t
  modified_base (364)..(364): a, c, t, g, unknown or other
  misc_feature (364)..(364): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgcggccccggganagcaggtcaccatctcctgctctggaagcagacccagcattggagtaattatgtctcctgtaccagcagctcccgaggaaccaacccccaaactcctcatctatgacaatgaataacgccgaccctcgaaggaacttcccgagacccgtattttccnggtcctccaaagtctggcagggtcacgcccacccgtgggaccacgtaccacccggtacctccagtaccgtgggaccgaacggacggtcccgtaatttaacgttaccgtcggtaccgacctaacgtaccgtaacggttcggggaacgttcgggaaccgtacgtaaccccttaaacgtaccgttacgggtcgggtaacccgttaaggtttacccgggggaccggggtaacggggttaaaccccggttaacggggtttaccggaacccccggtttacccggttacggggttaccccgtaaacccgggg

SEQ ID NO: 37335 - DNA, 609 bp, Homo sapiens
  misc_feature: GYAE6OF02FPQH0.52.63.F08.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgcctcagtgtctgcggccccggganagcaggtcaccatctcctgctctggaancacgacccagcattgggataatatgtctctgtaccagcagctcccgaggaaccaaacccccaactccctacactctatgaacaatagatacgccgaccctacaggtacttccacgtaccgtattttcgcggtactaccaagtctggctaggtccacgcccaccgtgggacacgtaccgaccggtacctaccagacgtcgggaccgacggacggacctaagtttacgtaaccgtggaccgtactacgtacgtacgtaggggactcggtaaccgacggtaccctaacgacggttacgtcgggtacctacgggttacgggaccgggtaacgggacctaacggggttaccgaccggtccgttacggtccgtaacccggg

SEQ ID NO: 37336 - DNA, 632 bp, Homo sapiens
  misc_feature: GYAE6OF02IFMZF.52.63.F08.1.454.CMB.1.raw
  modified_base (207)..(207): a, c, t, g, unknown or other
  misc_feature (207)..(207): n is a, c, g, or t
  modified_base (572)..(572): a, c, t, g, unknown or other
  misc_feature (572)..(572): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgcggccccggganagcaggtcaccatctctgctctggagcagacccagcattgggagtaattatgtctctggtaccagcagctcccgaggaaccaaaccccccaaatccctcactctatcgactaatgaataacgccgaaccctcgaaggaaactttccgtacgaacccggttaactttttccgtcgggtacccttaccctaaacggttccgtacgggtacctaagggttccgaacggacccccgtaaccccggttggggaaccctagttacccgaaccccgggtacctacccgaacggaccgttcgggaccggaacggaccgggtacccgtaatttactacgtcgaccgcaactcagtgggagtggcacgactaacncgtgtggactcggtcggcggaacgggactaacggttcggaccgtcggtacggactaccgg

SEQ ID NO: 37337 - DNA, 685 bp, Homo sapiens
  misc_feature: GYAE6OF02IRULG.52.63.F08.1.454.CMB.1.raw
  modified_base (206)..(206): a, c, t, g, unknown or other
  misc_feature (206)..(206): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgcctcagtgtctgcggccccggganagcaggtcaccatctcctgctctggaagcacgaccagcagttgggataattatgtctccgtggtaccagcagcctaccgacggaaccaacccccaaactcctacatctaatcgaactaagtagaataacgccgaaccctagaacggtaacttcccgtacgtaacccgttactttttcgtacggtccttacccgtaaaggttccgtacgggtaccgtacgggtacccgtaacggtacccctacccggtcggggtaccacgtacccgaacccgggtacctacccgaacgtaccgtacgggaccgacgggacggtaccgtaatttacgttacgtcggacgtctaattccgagttcgggtatcggaaccgacgtaaccctaaacgtcgtacggtaggacccgttaggttaccggggacgggtaacgggaacccgttaagggttaccggtacccggttacccggttacgggacctaacccgggg

SEQ ID NO: 37338 - DNA, 726 bp, Homo sapiens
  misc_feature: GYAE6OF02IWZKP.52.63.F08.1.454.CMB.1.raw
  modified_base (206)..(206): a, c, t, g, unknown or other
  misc_feature (206)..(206): n is a, c, g, or t
  modified_base (279)..(279): a, c, t, g, unknown or other
  misc_feature (279)..(279): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgcctcagtgtctgccggcccggganagcaggtcaccatctcctgctcgtaggaacgcacgacccagcagttcgggataattatgtcctcgtggtaccngcacgctaccgaaggaaccaaccccaatccanactctancgacaatcgataacgccgtaaccctagtaacggtaacttccgtacggtaccttaacgttttcgtacggtaccttacccaaaggttcccgtagggtaccgtaacgggtacctaaccggaccctaaccccggttcggggacctaaccgttccgaacccgggttaacctacccggaagtaaccgtcgggtaccgtaacgggtaacggaccgtaacggtttaacttaaccggtcgaccgtacgtacgtacgtaacggtcgggttaacgccggtaacctaacggtacccttaaaacgtccgttacggggtaacggtaaccggtacggtttaacccggggaacccgggttaacgggaaccttacgggttaacccggtacccggtttaccgggtaccggttaccggaaccccggg

SEQ ID NO: 37339 - DNA, 767 bp, Homo sapiens
  misc_feature: GYAE6OF02HBISO.52.63.F08.1.454.CMB.1.raw
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
  modified_base (279)..(279): a, c, t, g, unknown or other
  misc_feature (279)..(279): n is a, c, g, or t
tcagcgcagtacgacacgaccggtgctcgatttagcgatcgtataagggggaagctctgcttcagctgtgagcgcagaaggcgagacgtcggacaatctcatcatcgactgccctccctcctcctccctacctacccttctactacttccacgtcgacacggtacgggtccgtcgggaccctagtcgttggttcgacgcgacgcccgcctacgngtcgtcgtcggcccgggacccggacncgcgacggtccaacctctcctcgtcgtccttcgaggacncgaaccgaccagactaggttagggtaattaattacgtcgttcctaccgtacggtaccacgacaccgtccctaccgaacggaaacccccaaacccctaactcctactactactacgtacgaactaacgtagaaacgtacggacccgtaccctaaggtaacgttaacttccgtacgtaaccgtttacgtttcggtcgtacctaacgtaacgtcgtacggtacgtacggtaccgaccgtaccccgtacgggtgaacctacctaccggaaccggtacctaccggacggtccgtacgggaacccgtaacgggacggtacctttaatttaaccggtcggtacggaccttacgaacgtacgtaggggtacggtagtaccggaccgttaacgaacccttaagcggttaggtcggtaacttccggggtaccggggaacgggtaacgtacggttaaccgggttaccgaccccgggtttagtaccggtaccaacccggg

SEQ ID NO: 37340 - DNA, 646 bp, Homo sapiens
  misc_feature: GYAE6OF02JMCY0.52.63.F08.1.454.CMB.1.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (570)..(570): a, c, t, g, unknown or other
  misc_feature (570)..(570): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgcacagggtcctgggcccagtctggtttgacgcagcccgcctcagtgtctgccggccccgggacagcaggtcaccntctcctgctgtggaancacgacccagctagtgggatatatcgtctcgtaggtaccagtcagcctaccgaacggaacccaaacccccaaactccacactctatcgaacatacgaataacgccgtacctagaacggtacttccgtaacgtaccgtattttcgcggtactacctaagtcgtacggactagggtaccacgtcccgtacgtcgggacctacgtaccgaccggtacctaccgagtaccggtaccggacgaaccgggtacggtaaccggtaactttaaccggtaacgtccggtccaaccgtattaccgtaggtacggtacgtacgggacctaacggtaaccgtaacgngttacgggcggtaactacgggttcggaaccggtacgacggttacgtaccggttacccggtataccggtgaacccgg

SEQ ID NO: 37341 - DNA, 573 bp, Homo sapiens
  misc_feature: GYAE6OF02JTQ3Y.52.63.F08.1.454.CMB.1.raw
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
tcagcgcagtacgacacgaccggtgctcgatttagcgatcgtataagggggaaggctctgcttcagctgtgagcgcagaaggcaggactcgggacaatcttcatcatgacctgctccctctcctcctcacccttctcattcactgcacaggtcctgggcccagtctggtttgacgcagccgccctcagtgtctgcggcccccggganagcaggtcaccatctcctgctntggaancaagacccagcagttgggagtaattatcgtctcctggtaccngcagctccagaaccaacccccaatccnatctangacatgatacgcacctnagactcngactatttcngctcagtctgcagcacgccaccgtggcatccacggctccagctggccgacgacgccgtattacgtacgtgaccgtcgaacttcggacgtacgggcttacggaccgtaccgtaacccttaaacggcgttacgggtacgggtacccgtacggttacccggggaccgggtaacggggtaaccctaacgggtttcccggaacccgttcccggtaagggttccccaaaccgggg

SEQ ID NO: 37342 - DNA, 635 bp, Homo sapiens
  misc_feature: GYAE6OF02I2M8L.52.63.F08.1.454.CMB.1.raw
  modified_base (311)..(311): a, c, t, g, unknown or other
  misc_feature (311)..(311): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgcggccccgggacagcaggtcaccatctcctgctctggagcagacccagcagttgggagtaattatgtctcctggtaccagcagctacccagaaccaaccccaaactcctcatctancgacaatgataacgcgaccctacgaggaacttcctcgaccgtactttttactcggtctcccaaggtctcgggacaggtccaagccctacccgtcgggacctaacgtccaacccggtacctaccgacggtaccgtaggtccggacgacggacccgtaatttaccgttaaccgttcggacccggctaacttcgacgttaggggtacgtcgggaccacgtacccgttaaaccgtacgttaggtcgggacctaaggtttccggggaccggtaacggggaacccgtaaggtttccggaaccccggttacggtacgggttccgaacccgg

SEQ ID NO: 37343 - DNA, 642 bp, Homo sapiens
  misc_feature: GYAE6OF02F4HIJ.52.63.F08.1.454.CMB.1.raw
  modified_base (205)..(205): a, c, t, g, unknown or other
  misc_feature (205)..(205): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgcacagggtcctgggcccagtctggtttgacgcagccgcctcagtgtctgcggccccggganagcaggtcaccatctcctgctctggaagcacgacccagcattcgggagtaattatgtctcctggtaccagcagctcccgaggaaccaacccccaatcctcactctatagacaatgataacgccgaccctnaaggacttccgngtacgtacttttcncggtcttacctagtctcggcaggtcacgcccaccgtgggaccacgtccgaccggactcccgaggtaccgtgggaccgtaacggaccggacctaacgttttacgttaccgtcggaccttacgacgttaccgaggtttcgggaacgttcgggaaccgaacgaaccccttaaagtccgttacgggtaaccggccgttaacggtcccgggggacgggtaaaccggggtaccgttaacggttacccgggaacccggtttaccggttacgggacccgtaaccccggg

SEQ ID NO: 37344 - DNA, 606 bp, Homo sapiens
  misc_feature: GYAE6OF02GGNMM.52.63.F08.1.454.CMB.1.raw
  modified_base (206)..(206): a, c, t, g, unknown or other
  misc_feature (206)..(206): n is a, c, g, or t
  modified_base (340)..(340): a, c, t, g, unknown or other
  misc_feature (340)..(340): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgcacagggtcctgggcccagtctggtttgacgcagccgccctcagtgtctgcggccccggganagcaggtcaccatctcctgctctggaacgcagacccagccattgggacgtaattatgtactcctggtaccagcagctcccaggaaccaacccccaaatcctacagtcctatcgacaatcgataagccgaccctnacggtaaacttccgtagtacccgtagttttccagggtcctacccgaaaggttccgtacggacgtacggttcacggtcccgtaccctggggacctagtccaacccgggtactccgaagtaccgttcggacgtaacgacggcccgtatttacgttactcggacgtctaagtctacgtgggactcgggaactacggcctaacgctggtcggactacgttcggacggaaggtaccgtaacggttcgaaccggttcctaggtctaaccggg

SEQ ID NO: 37345 - DNA, 665 bp, Homo sapiens
  misc_feature: GYAE6OF02IM0KT.52.63.F08.1.454.CMB.1.raw
  modified_base (209)..(209): a, c, t, g, unknown or other
  misc_feature (209)..(209): n is a, c, g, or t
tcagcgcagtacgacacgaccggtgctcgatttagcgatcgtataaagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgccggccccggganagcaggtcaccatcctcctgctcgtggaagcacgacccagcagttggataattatgtctcgtgtaccagcagcctaccgaacggaacccaacccccaactccctacacttactatacgaacaatagaataacgccgaaccctgaacggtaacttccgtagtaccgttattttccgcgtcctaccgtaagtctggccgtaggtaccacgtccccaccggtggactactccgacccggacctaccgacggtaccgtcgggaccgaaccggtacggaccgttaatttactaacgtcggaccgactaacgtcgtaggttcgggaagtcgggaaccgtaccgtaaccgttaaccgtacggtcgggtacggtacctacgggttacggggacccgggtaacgggtaacccgtaaggtttacccggaaccccggtttaccggtaacgggtaccgtaaccccggg

SEQ ID NO: 37346 - DNA, 613 bp, Homo sapiens
  misc_feature: GYAE6OF02I6WZE.52.63.F08.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgccggccccgganagcaggtcaccatctcctgctctggaancacgacccagcattggagtatatgtctctgtacagcanctccagtaaccaaccccaatccncatctanagacatgactacgccgaccctanaggtaacttccagtacctntttcgtcggtacctacgtaacggtccgtcgggactacggtccacgccctacccgtcgggtaccacgtaccgacccggtacctaccgacgtacgtcgggaccgacggacggtcccgtaattaccgttaccgtagcccgtacgtagtccgtacggtacgggtacgtcggaccgtacgtaccctaacgtacgttcggtcggacgttacggtcgggaaccgggtacgggaaccgtacggttaccgaccgtaccggtacggtactaacccggg

SEQ ID NO: 37347 - DNA, 657 bp, Homo sapiens
  misc_feature: GYAE6OF02GKXWX.52.63.F08.1.454.CMB.1.raw
  modified_base (206)..(206): a, c, t, g, unknown or other
  misc_feature (206)..(206): n is a, c, g, or t
  modified_base (555)..(555): a, c, t, g, unknown or other
  misc_feature (555)..(555): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgcacagggtcctgggcccagtctggtttgacgcagccgcctcagtcgtctgcggccccggganagcaggtcaccatctcctgctctggaagcacgacccagcagtgggataattatcgtctcctaggtaccagcacgcctcccgaggaacccaacccccgtaaactcctacattcctatacgaacaatcgtaactaacgcccgtaaccctagaacggtaactttccgtacgtaacccgttattttccgtcggtacctacctaaggttcgtcggtacgacgggttcaaccggtcccgtacccgtcgggtacctacggtaccgacccgggtacctacccgacgtaacgtccgggaacggtaaccggcggtacctattaccgtctacggcccgactagtcgtacggtgggtaacnccggacaccgtaacccgtaagtcgtcggtacggcttaacgggtccgggacggtacggaaccgttggtacccggtcccggttacgtacggtaggtaaccccgg

SEQ ID NO: 37348 - DNA, 822 bp, Homo sapiens
  misc_feature: GYAE6OF02I2K6N.52.63.F08.1.454.CMB.1.raw
  modified_base (210)..(210): a, c, t, g, unknown or other
  misc_feature (210)..(210): n is a, c, g, or t
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgcacagggtcctggcccagtctggtttgacgcagcccgccctcgagttcgtctgccggccccggganacgcaggtccaccattcctcctgccttcgtagggaacgccacgacccagtcagttgggagttaattacgtcgttaccttccgttaggtaacccagtccgacgccctacccgaacggaacccaaacccccctaaacgttccctaccaacgttacctactacgaactaaagtggtaactaacgacccgtaccctaaggaacggttaacttcccgttagtaacccgttattttccgacggtcctacccgtaagggttcctacgggacgttacggaccacccggtacccgtacccggtacgggaccctacgtccggtaaccccggtacgtacccctaacgggtaccgttaacgggtaccgaaccggggtaccggtaccgttaaacgtttaacctttaccggccgggtaccgtaccgtaacgttaccgttaagggttcgggaacggttaccgggtaaccgtaccgttaaccccggttaaacgtccggttacgggtaaccgggttaccgttaacgggtacccgggggaccggggttaaaccgggaaacccggtttaaccgggttttaaccggtaaaccccgggtttccccggtttaaggggaccccgtaaccccgggg

SEQ ID NO: 37349 - DNA, 708 bp, Homo sapiens
  misc_feature: GYAE6OF02JOXKW.52.63.F08.1.454.CMB.1.raw
  modified_base (307)..(307): a, c, t, g, unknown or other
  misc_feature (307)..(307): n is a, c, g, or t
  modified_base (700)..(700): a, c, t, g, unknown or other
  misc_feature (700)..(700): n is a, c, g, or t
tcagcgcagtacgacacgaccggtgctcgatttagcgatcgtataagggggaaggctctgcttcagctgtgagcgcagaaggcaggactcgggacaatcttcatcatgacctgcctccctctcctcctcacccttctccattcactgcacagggtcctcgggcccagtccttggtttcgacgcacgcccgtccctacgagttgtctcggccgggacccccgggacacggtcgaacggtccgaccaacttccctccgttcgccgttccgaggaacgccaacgtacccacgcagttggtaagttaattntcgtccttctcggtaccagcacgccctaccgaacgaaccccctaacccccaaacttcccactactctaacagtaccaaatcgaactaacgaccgtaccctaggaacgttaacttccgtaacccatttacgttttccgtaggacctaccctaggttactgggtaccagggtacctacgccccgtaaccgtcggtacgaccctcggaaaccgtcctaacccggacgttacgccgggaccaaacccgggtgtacccgttactttaaacgttccggacctaccgcgtaactcgtaacgtcgggtacaggtaccgacttacctagtacgttacggagtccggtaacgtacgggtaccggtaacgtcggttaacgttccggaaccgttacgtaccggtnaacccggg

SEQ ID NO: 37350 - DNA, 756 bp, Homo sapiens
  misc_feature: GYAE6OF02H4MVQ.52.63.F08.1.454.CMB.1.raw
  modified_base (189)..(189): a, c, t, g, unknown or other
  misc_feature (189)..(189): n is a, c, g, or t
  modified_base (747)..(747): a, c, t, g, unknown or other
  misc_feature (747)..(747): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacgagggtcctgggcccagtctggtttgacgcacgccgccctnagtcgtcgtggcccgggccccgggacacggcaggtccaacctattcctccttggccttaccgtagggaaacgccgaacggacccaggtcctaagtttcggggaagttaatttagcgttcctcgtaggtacccaggcaacgtccctaccgacgtaaaccccaaaccccctaacttccacgtactacctttaagaccgaactaaagtacgtaaagtaaccggccctaccgtacgtaacggtaactttcccgtaaccgggtaccctttaactttccggttcggaacccttacccggaagttccttgggacccgttaacggccgacccgtacccctaccggggttaggaccctaggttacccggaacccggtttaacacccgaacggttaaccggcgggaaacccgggtacggacccggtaacgttactttaccgttacgtccggactaccggtacgttacgacggttaacgggcttaacgccgtaaccggtaacccttaagcggttcggacgtcggttacgccgggtaggacgtacgtaagtcccgttaacgcggttacgnaaccccggg

SEQ ID NO: 37351 - DNA, 860 bp, Homo sapiens
  misc_feature: GYAE6OF02G3RIP.52.63.F08.1.454.CMB.1.raw
  modified_base (696)..(696): a, c, t, g, unknown or other
  misc_feature (696)..(696): n is a, c, g, or t
tcagcgcagtacgacacgaccggtgctcgatttagcgatcgtataagggggaagctctgcttcagctgtgagcgcagaaggcaggactcggacaatcttcatcatgacctgctcccctctcctcctcacccttctcattcactgcacaggtcctcggcccagtctggtttcgacgcacgcccgtccctcagttcgtcgtcggccgggccccgggacacgccgacggtccaacctacgttcctccgtacggtccttacgtacgggaagaccgaccggaacccctaggtaccgtaaggttagggggtaacttaaagtttacgtccggttaccgttcccggttacgggtaacccacggtaccgaaccggtcccctaccccggaaaccgggtaaaacccccaaaaccccccctaaacctccctaactacttaccttaacgtaacgtaaactaaacggttataaacgttaaaccggacccgtaacccccgttaagtaaccggtttaaacccttaccggttaaccggttaacccgttttacgttttacccggtacggtacccttaaccgttaccggttaccgtcgggtaactaacggggtccaacccggttcccgaacccgggttggacctacggtacccgaacccggacctacggagaccgcgggacccgaacggtggtaacccgttattaacgttaccgngacccgtgttaaccacggttagggtacgggtacgtacgaccgtaaccgtaacacgttcggttcgggaccgttaccggttacgggtaacccgggtaccgggaaggtaacccgttaacggggttcccgtaacccgggtttacggtaccggtccccggtaacccggg

SEQ ID NO: 37352 - DNA, 896 bp, Homo sapiens
  misc_feature: GYAE6OF02FK1CU.52.63.F08.1.454.CMB.1.raw
  modified_base (209)..(209): a, c, t, g, unknown or other
  misc_feature (209)..(209): n is a, c, g, or t
tcagcgcagtacgacacgaccggtgctcgatttagcgatcgtataagggggaagctctgcttcagctgtgagcgcagaaggcaggactcgggacaatcttcatcatgacctgctcccctctcctcctcacccttctcattcactgcacagggtcctgggcccagtcgtggtttgacgcagccgccctcagtgtctgccgggccccgganacgcaggtccaccgatcctcctgctcgtggaacgcgacgacccagtaccgtagttaggggtaattaagttatcggttccttcccgttacgggttaaccccacggacctaacggtcctaacccccgaacggaaaaccccaaaaccccccgtaaaccttccctacctaacttacccgtaatacggaaactaacgttacgtaactaacgggccccgtaaccccttaaccggaacgggtttaaacttacccggttacgggttaaacccgtttaacgttttttaccggtacggggtaccctttaccgtaaacggtttccgtacggggtacccaacggggtttacccgaaccgggtccccctaaccccggggttaccgggtaaccggtaacccttaccccgggaaaccccgggttacccttaacccgggaaccgggtaccggttaccggggacccgggtaaacgggttaacccgggtacccggttaacgttttaaccgttaccgtcgggtaccgtaccgtaagtaccggtaagttccggggtactaccggggaactaacccggtaccgttaaaccgtaccggttacggtacgggacccgtacgggttcccggggtaccggggtaacgggtaacccggttaacgggttacccggttaacccgggttaccgggttaccggtacccggaacccggg

SEQ ID NO: 37353 - DNA, 742 bp, Homo sapiens
  misc_feature: GYAE6OF02HX28R.52.63.F08.1.454.CMB.1.raw
  modified_base (215)..(215): a, c, t, g, unknown or other
  misc_feature (215)..(215): n is a, c, g, or t
  modified_base (638)..(638): a, c, t, g, unknown or other
  misc_feature (638)..(638): n is a, c, g, or t
  modified_base (659)..(659): a, c, t, g, unknown or other
  misc_feature (659)..(659): n is a, c, g, or t
tcagcgcagtacgacacgaccggtgctcgatttagcgatcgtataagggggaagctctgcttcagctgtgagcgcagaaggcaggactcgggacaatcttcatcatgacctgcctcccctctcctcctcacccttctcattcactgcacgacgggtcctgggcccagtctggtttgacgcagcccgccctcagtgtctcggccgggccccggganagcacggtccacctatcctcctagcctcgtaggaacgccacgacccagctagttagggaattaatttagcgttcctaccgtaggtaccagcacgtccctaccgaacggtaacccaaccccctaagtccctacgaacttactactacgaactaacgtagtaacgtaacgcccgtaaccctagaacggttaaaccttccgtaggttaacccgttacttttccggaccgtacctaccgtaaacggtttccgacgggtaccgtaacgggttccgaacccggacccgtaaccccgggttgggtacctaaacccggttcccgaaacccgggtacccttacccgaacggtaccggttacgggtaccgggaaccggtacggtaacccttaagtttaccgtacgtcgaccgtctagtacgaggtcgggtacncggacctaacgaccttaacgngtacggtcggtacgtacgggtccgggaaccggtacgggtaaccttacggttaccggacccgttacggtacgtaccaacccggg

SEQ ID NO: 37354 - DNA, 762 bp, Homo sapiens
  misc_feature: GYAE6OF02H3GDG.52.63.F08.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagcgcagtacgacacgaccggtgctcgatttagcgatcgtataagggggaagctctgcttcagctgtgagcgcaggaaggcaggactcgggacaatcttcatcaatcgacctgcctccctctcctcctcacccttctcattcactgcacgacgggtccgtgggcccagtcgtggtttcgacgcacgcccgccctangttgttccgtcggaccgggccccggganacggcaggtccacacttcctcgtcgccgtacgtggaacaccgacgtaccgacgacgtaggttaggtaacgtatttacgcgtaccgttacgtacgtacctaggccaacgtaccctaacccgaaaccgggaaaaccctaaaaccccctaaccttcccgtaactaacgttactaacgtacgaactaagtaagaactacgacccgtaaccgactaacggttactaaccgtacgtaacgttcgttttacacggttacacgtacgtacgtaccgacgtacgtcgacccgtaccctaccggtacggtaccgtaacgaccgaccgtacgaaccgtacgttacggccgggaaccgacgtaaccgggtacctaaatttaccgtaacgtccgacgtacgtagttaccgaaagggttccggtaaacggtacggttaccgaaaccggttaccttaaacggttccgtaacgggtaccggttaccggtaggtaccgggaacgggtacgaacgttacggtacggtaacccgtacggtacgacggtaaaccgg

SEQ ID NO: 37355 - DNA, 743 bp, Homo sapiens
  misc_feature: GYAE6OF02J1RAP.52.63.F08.1.454.CMB.1.raw
tcagcgcagtacgacacgaccggtgctcgatttagcgatcgtataagggggaagctctgcttcagctgtgagcgcagaaggcaggactcgggacaatcttcatcatgacctgctccctctcctcctcacccttctcattcactgccacacgggtcctcgggccctacgtcttggtttgaccgcgacgcccgccctacagttgtctcggccgggccccgggacacgcgtacgggtccacccattcctccctggccttcgtacgggaacgaccaacgaccccacgacgtacggttggggtaattaactttacttggtccttaccgttacggaaccaggccaacgtccgtacccgaacggaaacccccaacccctaacttccctacagttacctataacgtaacaacgtagaacaacgaccgaaccctacgaacggtaacttccgtacgtaccgttactttacgtcggtacctaacccgtaaggttccgtcggtacctacgggtaccaccggtaccccctaaccgggtacggtcctacttacccggaaaccgtccgtacctacgtacggtacggtacgacggttaccggcgttatttaccgtacgcgtaccgctaacgtgaacgggttcggaagtccgaacgtacgttaaccgacacggttcggtcgacttaccggggtacggaccgggaacgttacccggtaggttacccgttaaccggttaccggtacgttacccgaacccggg

SEQ ID NO: 37356 - DNA, 527 bp, Homo sapiens
  misc_feature: GYAE6OF01CG8IG.53.33.C11.1.454.CMB.1.raw
  modified_base (366)..(366): a, c, t, g, unknown or other
  misc_feature (366)..(366): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaaagaacacactgtatctgacaaatggaacagcctgaganctagaagacacggctgtgtattactgtgcgagtgagatgtcgttactatgatgcagtggtttggtaccgttcgacccgtgggccgacggacctgtccaccgtctccgtcacgctcccaccgaacggccctacgtccgtccttccccctggtcccgtccccg

SEQ ID NO: 37357 - DNA, 579 bp, Homo sapiens
  misc_feature: GYAE6OF01BJJC2.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtggggtggcacttatctcatctgatggaagagatgcctattacgcagactccgtgaagggccgattcaccatctccagagacaattccaagaacacactgtatctagacaaatggacagcctagagagctagaacgacacggctgtgtattactgtgcgagtgagattgtcttactatgtatcgcgagttggtttcgggtacccgttcggaccccgttcgggggcccgacgggtaaccccgtcggtaccgtacccgtccgtcccgtctacgtccttccccgaaccgtaacgggcccctaacgttcccggttaccctttccccccgtgggcccgtcccccg

SEQ ID NO: 37358 - DNA, 533 bp, Homo sapiens
  misc_feature: GYAE6OF01EGQ4L.53.33.C11.1.454.CMB.1.raw
  modified_base (327)..(327): a, c, t, g, unknown or other
  misc_feature (327)..(327): n is a, c, g, or t
  modified_base (487)..(487): a, c, t, g, unknown or other
  misc_feature (487)..(487): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcactttatctcatctgatggaagagatgcctattacgcagactccgtgagggccgattcaccatctccagagacaataccnaaagaacacactgtatctgacaaaatggaacagcctgagagctagaagacacgggctgtgttattactgtgcgaagtgagatgtcttactatgatgcctaggttggtttcggtacccgttccgacccgtgggccagggaccctggtccacccgtctcctnacgcctccgaccgacggcccactcccggtccttcccccgtggcccg

SEQ ID NO: 37359 - DNA, 573 bp, Homo sapiens
  misc_feature: GYAE6OF01BU3J1.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaaggccgattcaccatctcagagacaattccaagaacacactgtatctagacaatggaacagcctgagagctagaagacgacggctgtagtattactgtgcgagtagagtatgtcttactatgtatgcgtagttggtttacggttaccgttccgtaccccggtagggtaccgacgggtaacccgtggtaccgtacccgtcctcccgtacgacgtccctacccgaacccgtaaccggccctacgttcccggtaccctttcccccgtgggtccccgtccccg

SEQ ID NO: 37360 - DNA, 559 bp, Homo sapiens
  misc_feature: GYAE6OF01APJY5.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgacaaatggacagcctgagagctgaagacacggctgtgtattactgtgcgagtgagatgtcttactatgatgtcctaggttggtttcggtacccgttccggaccccgttggggacccgacggggtaaccccgtggtcctacccgtctcccgtcacgtccttcccgacccgaacgggccctacgttccggttcccttcccccgtcggcccgtccccg

SEQ ID NO: 37361 - DNA, 579 bp, Homo sapiens
  misc_feature: GYAE6OF01CBABX.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctcagagacaattccaagaacacactgtatctgacaaatggacagctagagagctagaagacacggctgtgtaattacgtgtgcgagtgagattgtacttactatgatgcctaggttcggtttcgggtacccgtttccggaccccggtggggtacccgacggggtaaccccttgggtccacccggttcctcccgttcgacgtccttcccgaacccgtacgggacccctacgttccgggtacccctttcccccggcggtccccgtccccg

SEQ ID NO: 37362 - DNA, 524 bp, Homo sapiens
  misc_feature: GYAE6OF01C6MXU.53.33.C11.1.454.CMB.1.raw
tcagcgcgtatacacacgaccggtgctcgatttagagtgagctcgttgggtttgggctgagctgggtttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaaggccgattcaccatctcagagacaattccaaagaacacaactgtaatctagcaaatggacagcctgagagctagaagcacggctgtgtattactgtgcgagtgagatgtctactatgatgcagttggttggtaccgttcgacccgtggggccagggaacccgtcggtcaccgtctccctcagcttccaccaacgggcccactccggtccttcccccgtggtccgtccccg

SEQ ID NO: 37363 - DNA, 560 bp, Homo sapiens
  misc_feature: GYAE6OF01DP77H.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctatacgcagactcgtgaaggccgattcaccatctccagagacaattccaaagaacacactgtatctgacaaatggacagcctgagagctgaagcacggctgtgtattactgtgcgagtgagatgtcttatatgatgcgtagttggtttcggttacccgttccggtaccccgtcggggacccgacgggtaacccgtcggtaccacccgttcctcccgtcgacgtcccttcccgaacccgtacgggacccctacgttcccggtcccttcccccgtggcccgtccccg

SEQ ID NO: 37364 - DNA, 632 bp, Homo sapiens
  misc_feature: GYAE6OF01A4X3M.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattccaccatcctccagagacaattccaaagaacacactgtatctgacaaatggacagcctagagagctagaagacacggctgtgtattacgtgtgcgagtgagtatgttacttaactatgtatgtcctaaggtttcgggttttacggttacccggtttcccggacccccggttgggggtaccccgtaacggggtaaccccgttcgggttacccgtacccggttcccgttaccccgtctaccggtcccttaccccggaacccggtaaaccggggtcccctaacggttccccggttacccctttccccccggtcgggccccgttccccccgg

SEQ ID NO: 37365 - DNA, 554 bp, Homo sapiens
  misc_feature: GYAE6OF01EOQLJ.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgacaaatggacagcctagagagctagaagacacgctgtgtattactgtgcgagtgagatgtacttactatgtatgctaggttggtttcggttaccggttccgtaccccggtcgggccgacgggacccgtgggtccaccggtcctcccgtctacgccttcccaaccgaacgggcccctacgtaccggtcccttcccccgtcggccgtccccg

SEQ ID NO: 37366 - DNA, 542 bp, Homo sapiens
  misc_feature: GYAE6OF01AM2OA.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgacaaatggacagcctgagagctagaagacacggctgtgtattactgtgcgagtgagatgtacttagtatgatgctagtggtttcggttaccgttccggtaccccgtcggggtcccgacgggaacccgtggtcctaccgtcctccgtcagccttccaaccgacggccctactccggtccttccccgtcggccgtccccg

SEQ ID NO: 37367 - DNA, 643 bp, Homo sapiens
  misc_feature: GYAE6OF01DA5H9.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtctaccctttgcacgtgggtccgcaggctccgaggcgaaggggctgggagtgggtggcacttatctcatctgatggaagagatgacctattacgcagactccggtagaacgggccgtattccaacctatcctaccgaagtacgaactaattacccaaagaacaacactagtatactgacaaatcggaacagacctagacgagctagaacgacgacggcgtagtagttaattacgtgtggacggagtagagtagttgtacttaactagtgtatcgacgttaggtttcgggtttaccggtacccggttaccggaccccgggttggggacccgtacggggtaacccgttcgggtacccgtaccccgttctacccgttcgacgtcccgttcccgaaccgtaaacccgggtccctaccgttcccggttcccttcccccgtcgggcccgtccccgg

SEQ ID NO: 37368 - DNA, 734 bp, Homo sapiens
  misc_feature: GYAE6OF01AGE7Z.53.33.C11.1.454.CMB.1.raw
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccaggcctgggaggtccctgaaactctcctgtgcagcctctggattcgtctcaagtgtcctaccctttgccacgtgggtccgccagggcctccgagggcgaagggggctgggagtggggtgctacttatctcatctgataggaagagatgcctattacgcagacctccgtaggaagggccattccaccatcctacagagacaattaccaagaacacactgtanctgacaaagtcggacngtccgagagagntaggaagacgacggtctagttagttacgttacgtggtagacgtaggttagaaggttattggttacctttaacgtagttaggtacttcgggtacccgttaagggttttccgggttttaccggggtttaccccggtttacccgggaccccccgggttacggggggtaccccccggtaacgggggttaacccccgttacggggttacccgtaaccccgttcccgttaccccgttccgtaacccggtccccgttaaccccgaaccccggtaacccgggtcccccttaccgggtttcccccgggttacccccgtttacccccccgggttcggggcccccgttaccccccggg

SEQ ID NO: 37369 - DNA, 552 bp, Homo sapiens
  misc_feature: GYAE6OF01AL3H7.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctagaagacacggctgtgtattacgtgtgcgagtgagatgtacttactatgtatcgaccgtagttgggtttcggtacccgttccggaccccgtggggcccagggaaccctggtccaccggtctcccgtcacgtccttcccgaccgaacgggccctacgtccggttacccttcccccgtggcccgtcccg

SEQ ID NO: 37370 - DNA, 638 bp, Homo sapiens
  misc_feature: GYAE6OF01CGFP2.53.33.C11.1.454.CMB.1.raw
tcagcgcgtatacacacgaccggtgctcgatttagagtgagctcgttgggtttgggctgagctgggtttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtggggtgcacttatctcatctgatggaagagatgcctattacgcagactccgtgaaggccgatcacatctcagagacaattccaagaacacactgtatctagacaaatggacagcctagagacgctagaagacacggtctgtgtatacgtgtgcgagtgagatgtacttactatacgtagtcgtacgtaggtttacgggtttacgggttacccggttaccggtacccccggttcggggtaaccccggtaaccggggtaaaccccgttcgggttacccgtaccccggttacccgttcccgtaccgtaccggtccccgtttaccccgaacccgtaaaccgggtccccctaaccgttacccgggttcccctttaccccccggtcgggtcccgttaccccccgg

SEQ ID NO: 37371 - DNA, 758 bp, Homo sapiens
  misc_feature: GYAE6OF01CMLG0.53.33.C11.1.454.CMB.1.raw
  modified_base (280)..(280): a, c, t, g, unknown or other
  misc_feature (280)..(280): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtcccgccaggcctccgagggcgaagggggctgggaggtggggtggctacgttatctcatctgatggaanagatgcctattacgcagacgtccgtaggaacgggccgtattccaccatcctaccagagaacaattccaaagaaccactactgtaatctagaccaaagtcggaacacgaccgtagaacgacgacgtaaggaacgacgaccgggtacgttaggttacgttaacgtttacgtggtacggtacgggtaaggttggtaagtagttcgtttaccgtttaacgttagtacgtacgttcgggtaccgttaaggggtttcgggtttttaccgggtaacccgggtttaccccgggtaccccgggttaccgggggtaccccggtaaccggggtaaccccggttcgggtacccgttaaccccggttcccttacccgttaccgtaccggttacccgtttaaccccggaacccggtaacccgggtccccgttaaccggttccccgggtttaccccgtttaccccccggtcggggtacccccgttcccccggg

SEQ ID NO: 37372 - DNA, 601 bp, Homo sapiens
  misc_feature: GYAE6OF01D3SRQ.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccattcaccatctccagagacaattaccaaagacacactgtatctgacaaatcggacagcctgagagcgtagaagacgacggcttagtgtattacgtgtgacgtagtgacgtattcgtacttactagtgtatcgcgtaggtttgggtttacgggttacccgttccggtaccccgtggggacccgtacggggtaaccctcgggtaccgtacccgtccttacccgtccgacgtcccttaccccgaaccgtaacgggaccccgttacgtcccggttaccctttccccccgtcggtccccgtccccg

SEQ ID NO: 37373 - DNA, 625 bp, Homo sapiens
  misc_feature: GYAE6OF01DAAHN.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtctaccctttgcacgtgggtccgccaggcctccgagggcgaagggggctgggaggtgggtggctacttatctcatctgatggaagagatgcctattacgcagactcgtagaaggccgattcaccatctcagagacaataccaagaacacactgtatctgacaaatgacagcctagagagctagaacgacgacggctagtagtattactgtgcgtagtgagtattgtacttactagtgatgacgttaggttcgggtttaccggtaccgttcccggaccccggttggggacccgaacggggtaaccccttcgggtaccctacccggttcctacccgtcgtaccggttcccttaccccgaaacccggtaaccgggccccctaacgggtttccccggttacccccttccccccggttgggcccccgttacccccgg

SEQ ID NO: 37374 - DNA, 761 bp, Homo sapiens
  misc_feature: GYAE6OF01CQ8KB.53.33.C11.1.454.CMB.1.raw
  modified_base (264)..(264): a, c, t, g, unknown or other
  misc_feature (264)..(264): n is a, c, g, or t
tcagcgcgtatacacacgaccggtgctcgatttagagtgagctcgttgggtttggggctgagctgggtttcctcgttgctcgtttaagaggtgtccacgtgtcacgtgcagctggtgcagtctggggaggcgtggtccagcctgggaggtccctgaaactctccgtgtgcagcctctggattcgtctcaagtgtctacccttgcgacgtgggtccgccgacggctccgaggcgaacggggtctgggagtgggtggtctacttanctcatccttgagtgaagagtatagcctattacggcagtacgtcccggtagaacggccgtatttaccggacctaagttccgtaccgaagggacggtaacctaaacgtttccccaaaaggaaaccctacgtaaccgttacggtaagttacgttacgtacgaaaagtttacggaaccggagtacccgttagaacggtacggtacttacggaacggaccgaccggtacctcgggtagttacttaacgttacgtacgtacggagtaggtaagttataggtacttacttaagtgtaagtcgtaccgtaagttagggtttacggtaaaccgttcgtaccccgtggggtacccggtacgggtaacccggttcggtaccgtaaccggttcccgtaccgttaccggacgttaccgtttccccggaaaccccgtaaccgggttaccccgaacggttttaacccggtccccggtttaaccccgtccggggtaacccggttaccccccgg

SEQ ID NO: 37375 - DNA, 613 bp, Homo sapiens
  misc_feature: GYAE6OF01AWIM3.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtcccgccaggctccgaggcgaaggggctggagtgggtggctacttatctcatctgagtggaagagatcgctattacgcagactcgtagaacgggccattccactatcctaccgagacgacaattaccaaagaacacactgtactactagacaaatggaacagcctgagagcgtagaagacgacggtctagtagttattacgtgtagcgagtagagtatagttacttatagtgtatgtccgtaggttggtttcggtacccgttaccggtacccgtcggggtacccgtacgggtaacccgtcggtaccgacccgttcgtaccctcgtactccgttacccgaacccggtaacgggtacccctacgttaccccggttcccgtttcccccgtggtccccggtccccg

SEQ ID NO: 37376 - DNA, 757 bp, Homo sapiens
  misc_feature: GYAE6OF01CHNUU.53.33.C11.1.454.CMB.1.raw
  modified_base (459)..(459): a, c, t, g, unknown or other
  misc_feature (459)..(459): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggacggtccctagaaactctcctgtgcagcctctggattcgtctacaagtcgtccttaccctttgctacgtcgggtccgccaggcctccgaggcgaaggggctgggaggtgggtcgctacttatctcattcgtggaagtgggaagagtagtcgtaccttaagttacgacaacgtaccgttacccggtagggaacggaccgtatttaccgaacctactaccgtaccgaagaacgtaaaccctaacttaacccgaaaaagtaaaacctacgtaaccttaggttaacctccgttaacgaaaccaaagtcggaaacnggtaccgtagaacgtagtacgaaagaacgaccgtgtcgttagttatacgttagtgtcgacgtagtagtagtagttacttaacgttagtagtacgtacgtcggttacggtttagggtttaccggttcccggttaaccccggtacccggtacccggggtacggtaacccgggtaccgtaccggttaccggtacccgttccgtacccgtccgtaccgtaccgttacccgtaacccggaacccggtaccgttaccccgttcggttaccccggttccccgtcccgggtccgtccccgtcccgg

SEQ ID NO: 37377 - DNA, 626 bp, Homo sapiens
  misc_feature: GYAE6OF01BU48K.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtctaccctttgcactgggtccgccaggctccgaggcgaaggggctgggagtggggtggctacttatctcatctgagtggaagagatgcctattacgcagactccggtagaacgggccgtattcacctatcctccagagacaattaccaaagaacacacttgtatctgacaaagtggacagcctaggacgagctagaacgacgacggcttagtagtattactgtgcgtagtgagtagtgttacttactatgtatcgcctaggttggtttcgggtaccgttcccggacccggttcggggacccgacggggtaacccgttcgggtacccgtacccgttcccttcccgtccgtacgtcccgttccccaacccggaaccgggtaccccctaacggttccccggttacccctttccccccggtcgggtcccgtccccgg

SEQ ID NO: 37378 - DNA, 609 bp, Homo sapiens
  misc_feature: GYAE6OF01ECBSN.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaaagaacacactgtatctgcaaatggacagcctgagagctagaagacacggctgtgtattactgtgcgagtgagagttgtcttatatgtatgcctaggttggtttcgggtaccgtttcccggtaccccggttcgggggacccgacggggtaacccccgtgggttacccgaccccggttccttaccccgtccgtacggtcccgtttaccccgaaccccgtaaacggggccccctaaccgttcccggttaccccgtttcccccccgttcgggccccgtcccccgg

SEQ ID NO: 37379 - DNA, 625 bp, Homo sapiens
  misc_feature: GYAE6OF01BXF5Y.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcgaaggggctgggagtggggtggctacttatctcatctgatggaagagatgcctattacgcagactccggtaggaacgggccgtattcaccatcctccagagactaacttccaaagaacacactgtatctgacaaagtggaacacgcctgagagcgtagaagaccgacggcttgtagttattacgtgtgcgtagtgagtattggtacttaacttatgacgtgaccgtaggtttcgggtttcgggttaccccggttaccggtacccccggttggggacccgtaaccggggtacccgtcgggtaccgtacccggttccttcccgtcacgtcccttacccgaacccgaaccgggtcccctaacgttccccggttccccttcccccgtcgggcccgtcccccg

SEQ ID NO: 37380 - DNA, 665 bp, Homo sapiens
  misc_feature: GYAE6OF01B3F0N.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccgccaggctccaggcgaaggggctgggagtggggtggctacgttatctcatctagatggaagagatgacctattacgcagactccgtagaacgggccgtattccacatctccagacgacaattaccaaagaacacactagtatctagacaaagtgacagcctagagagactagaaagaccgaacgtcgtaggttagttaacttacgtgtgtacggaagtaggagtattcggttacttactaagtgtaatcggaccgtaggttcgggtttacggtacccggtttaccggaccccggttcgggacccggtacgggtaaaccccgtcgggttacccgtacccggttaccgtcccgtacgtaccgttcccgttaaccccgaacccggtaaccgggtacccccgtaacggtttcccggttaccccgtttcccccggtcgggtccccgttacccccgg

SEQ ID NO: 37381 - DNA, 661 bp, Homo sapiens
  misc_feature: GYAE6OF01AES1I.53.33.C11.1.454.CMB.1.raw
  modified_base (91)..(91): a, c, t, g, unknown or other
  misc_feature (91)..(91): n is a, c, g, or t
  modified_base (213)..(213): a, c, t, g, unknown or other
  misc_feature (213)..(213): n is a, c, g, or t
tcagcgcgtatacacacgaccggtgctcgatttagagtgagctcgttgggtttgggctgagcgtggtttcgtcgtagctctttaagaggtntcagtgtcacgtgcagctggtgcagtctgggggaggcgtggtccagcctgggaggtccctgaaactctcctgtgcacgcctcgtggattcgtctcaagtgtctaccctttgcactgggtccnccaggcctccgaggcgaaggggctgggagtgggtggcacttatctcatctgatggaagagatgtcctattaccgcagcctccggtaggaacgggcctagttccaccatcctaccaggacactaacttaccaagaacactactgtactctagacaaagtggacagccgtagagagctagaacgacgacggtctaggttagttacttacgtggtaggacggtagtagagttattacggttaccttactagtcgagtcgtacgttagggtttacgggtttccggtacccgttcccgggaccccggttacggggacccggtaccggggtaaccccgttggtaccccgttaccggtcccttacccgtccgtaccgttacccgttaccccgaacccgacccggtcccgttaccggttcccggtaccccgtttccccggccggtcccgtccccgg

SEQ ID NO: 37382 - DNA, 562 bp, Homo sapiens
  misc_feature: GYAE6OF01EYONQ.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtcccttaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaaagaacacactgtatctgacaaatggacagcctagagagctagaagacgacggctgtgtattacgtgtgcgagtgagatgtacttactatgatgcctaggttggtttcggtaccgttccggtacccgtgggacccgacgggacccgtcggtcctaccgtcctcctacgtcgtccttacccgaccgaccggacccgtacttcccgggtacccttcccccgtcggcccgcccgtccg

SEQ ID NO: 37383 - DNA, 583 bp, Homo sapiens
  misc_feature: GYAE6OF01E1JMD.53.33.C11.1.454.CMB.1.raw
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
tcagcgcgtatacacacgaccggtgctcgatttagagtgagctcgttgggtttgggctgagcgtgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaacggggccattccacatctccagagacaattccaagaacacactgtatctgacaaagtggacagcctgagagctagaagacacgctgtntattactgtgngtagtgagtatgtactactatgtatgcctagttcgggtttcggttacccggttccgtacccggtcgggcccgtaacggggtaccccgttcggtcctacccggtacctcccgtacgtacgtcccttcccgaacccgaacgggtacccctacgttcccggttccctttccccccggtggtcccgtccccg

SEQ ID NO: 37384 - DNA, 534 bp, Homo sapiens
  misc_feature: GYAE6OF01BT3MU.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtggggtggcacttatctcatctgatggaagagatgcctattacgcagactccgtgaagggccgattcaccatctccagagacaattccaagaacacactgtatctgcaaatggacagcctgagagctagaagacacgctgtgtattactgtgcgtagtgagatgtcttactatgatgctaggttggtttcggtaccgttccgacccgtgggccacgggacccgtggtccaccgtctccgtcagccttccaccgaacggccctacgtccggttcctcccccgtcggcccgtccccg

SEQ ID NO: 37385 - DNA, 785 bp, Homo sapiens
  misc_feature: GYAE6OF01DKDAP.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtgggtccagccgtgggacggtccctgaaactctcctgtgcagcctcgtggtattcgtctcgaagtcgtccttaccctttgccacgtcgggtcccgccaggcctccgaggcgaagggggctgggaggtgggtgctacgttatctcatctagatgggaagagatgaccttaagttacgcagacgtccggtaggaaggccgtattccgaacctactaccgtaccaaggaacgaactaacttaaccaaagaaaccactacgtagttaactactagaactaaaagtcggaaccaggtccgtaggaacggacgtacgtaacggaacgaaccgtacggtcgttaggttagttaacgttactaggtacggacggtaaggtaggtaagtacgttcgttacctttaagtaacgtgtaacgtcgtaccgttaagggtttccggggtttaccggttaaccccggggttaccccggtacccccggggttacggggaaccccggttaaccggggaaccccgtttacgggtacccccgtaaacccgttcccgttaccccgtaccgtaaccgtccccgttaccccgaacccggtaaacccggggcccctaaccgggtttcccccggttaccccccggtttcccccggtacggtccccccggttacccg

SEQ ID NO: 37386 - DNA, 620 bp, Homo sapiens
  misc_feature: GYAE6OF01B1M4E.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaacgggccgattcaccatctccagacgacaattaccaagaacacactgtatctgacaaatcggacagcctgagagcgtagaacgacacggctgtgttattactgtgcgtaggtgagtattgtcctttatatgtatgccgtaggttgggtttcggttacccggttccggacccccggttcgggggtacccgtaaccggggaacccgttcgggttaccctacccggttccgttcccgtccgtacgtacccgttaccccaacccggtaacggggacccccttacggtccccgggtttaccccttccccccggtcgggtccccgtcccccg

SEQ ID NO: 37387 - DNA, 620 bp, Homo sapiens
  misc_feature: GYAE6OF01EWSM8.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctggggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagactaattaccaagaacacactagtatctgacaaatggacagcctagagagctagaagacacggctgtgtattactgtgcgagtgagtatgttacttactatgtatgtcgtaggttcgggtttacggttaccggttccggtaccccggttcggggacccgtacggggtaacccgtcgggtacccgtacccggttccttcccgttaccgtacgtcccgttaccccgaaccccggtaaacccggggacccctaacggttccccggttacccccgtttccccccggtccgggtcccgtcccccgg

SEQ ID NO: 37388 - DNA, 774 bp, Homo sapiens
  misc_feature: GYAE6OF01ELP0V.53.33.C11.1.454.CMB.1.raw
tcagcgcgtatacacacgaccggtgctcgatttagagtgagctcgttgggtttgggctgagctgggtttcctcgttgactcttttaagaggtgtccagtgtcacgtgcagctggtgcagtctgggggaggcgtggtccagcctggggaggtccctgaaactctcctgtgcagcctctggattcgtctcaagtgtctaccctttgcacgtgggtccgccaggcctccgaggcgaagggggctgggaggtggggtgctacttatctcatctgatggaagagatgcctattacgcagactccgtaggaacggccgtattccacctatcctacagaagaacctaacttacccaaaagaaccacctacgtagttaatcgtagaacaaagtcgggaaccagtccgttagggaagtacggcctaaggaacgaaccggtacggtaccttaggtagtttaacgtttacgttgggttacggcgggtaaggtagggtaagttacgtttacgtttaccgttttaacttaggttagtacgttacggtaccggttaagggttttcgggtttaacccgggtttacccggttaccccgggttaacccccgggttcgggggtaaccccggtaaccggggttaccccggttaccgggtacccgttacccggttcccttacccgtaccgttacccggtaccccgttaccccggaaacccggtaacccggggtccccttaccgggtttccccggttcccccgtttccccccggtcgggtcccccgtacccccgg

SEQ ID NO: 37389 - DNA, 788 bp, Homo sapiens
  misc_feature: GYAE6OF01BIQT5.53.33.C11.1.454.CMB.1.raw
  modified_base (176)..(176): a, c, t, g, unknown or other
  misc_feature (176)..(176): n is a, c, g, or t
  modified_base (497)..(497): a, c, t, g, unknown or other
  misc_feature (497)..(497): n is a, c, g, or t
tcagcgcgtatacacacgaccggtgctcgatttagagtgagctcgttgggtttgggctgagcgtgggtttcctcgttgctctttaagaggtgtccagtgtcacgtgcagctggtgcagtcgtgggggaggcgtggtccaggcctgggaggtccctgaaactctcctgtgcagcctntggattcgtctacaagtcgtccttacccgtttgcctacggttgggtcccgccgagggtcctaccgagggccgaagggggctagggtaggtggggtcggctactttatcctacatcgtgagtggaagaggtatgaccttattacgcagtacctccggaggaaacggggcctattccgaaccatcctaccgaagaacgaacctaaacttaccaaaacgaacacgacctgtaactcgtagactaaagtcgggaacacgtcgtaggagagtacgtagaacgactgggtacttaggtagttacttcgtggtcggtagtacgggtanagttaacgttgttaacctttagtacgtagtcggtacgtcggttacgggttttacgggttccgggtttaaccccggttacccgggaccccgggttaccggggtaacccgggtaacccggggttaaccccgttcgggtaaccccgttccccggttaccgttaccccggtaccgttacccggtaccccgtttaacccggaaaccccgggttaaaccccgggcccccgttaacggtttccccccgggttaccccctttacccccggggtcccgggtccccgggttaaccccccgg

SEQ ID NO: 37390 - DNA, 526 bp, Homo sapiens
  misc_feature: GYAE6OF01AVRA2.53.33.C11.1.454.CMB.1.raw
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (517)..(517): a, c, t, g, unknown or other
  misc_feature (517)..(517): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtggggtggcacttatctcatctgatggaagagatgcctattacgcagactccgtgaagggccgattcaccatctccagagacaattccaagaacacactgtatctgacaaatggacagcctagagagctagaagacacgctgtgtattactgtgcgagtgagntgtnttactatgatgcgtgttggtttcggtaccgttccgacccgtgggaccgacgggaccctggtccaccgtctccgtcagtctcccgacacggccctacgtccgtcctccccgngccgtcccg

SEQ ID NO: 37391 - DNA, 543 bp, Homo sapiens
  misc_feature: GYAE6OF01A2GQB.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgcgcagctggtgcagtctgggggaggcgtggtccagcctgggaggtccctgaaactctcctgtgcagcctctggattcgtctcaagtgtctaccctttgcactgggtccgccaggctccaggcaaggggctgggagtgggtggcacttatctcatctgatggaagagatgcctattacgcagactccgtgaagggccgattcaccatctccagagacaattccaagaacacactgtatctgacaaatggacagcctgagagctagaacgacacggctgtgtattactgtgcgagtgagtatgtcttactatgatcgcgtaggttgggtttacggtacccgttccggaccccgtggggcccacgggacccgtggtccaccgtctccgtcacgtcctccaccgacggccctacgtccgtcccttccccgtggcccgtcccg

SEQ ID NO: 37392 - DNA, 631 bp, Homo sapiens
  misc_feature: GYAE6OF01A5HN5.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccttgcactgggtccgcaggctccaggcaaggggctggagtgggtggctacttatctcatctgatggaagagatgcctattacgcagactccggtagaagggccgattccaccatcctccgagacgacaacttaccaaagaacacactgtatctagacaaatggaacagcctagagacgactaggaacgacgacggtcttagtgtaacttacgtgtacggacgtaggtgaagtattgttactttaagtagtgacttcgccgttaggtttacggggtttacggtacccgggtttcccgtaccccgggtggggtacccgtaaccggggacccttcgggtccctaccggttccttaccgtaccacggtcccttacccgaacccggaccgggtcccctacgtttccccggtaccccttccccgtgggcccgtaccccgg

SEQ ID NO: 37393 - DNA, 747 bp, Homo sapiens
  misc_feature: GYAE6OF01DDIHT.53.33.C11.1.454.CMB.1.raw
  modified_base (224)..(224): a, c, t, g, unknown or other
  misc_feature (224)..(224): n is a, c, g, or t
  modified_base (453)..(453): a, c, t, g, unknown or other
  misc_feature (453)..(453): n is a, c, g, or t
tcagcgcgtatacacacgaccggtgctcgatttagagtgagctcgttgggtttgggctgagctgggttttcctcgttgctcttttaagaggtgtccagtgtcacgcgcagctggtgcagtcgtgggggaggcgtggtccagcctgggaggtccctgaaactctcctgtgcagcctcgtggtacttcgtctcaagttgtccttaccctttgcacgtggggtcccnccaggcctccgaggccgaaggggctagggaggtggggtgactacgtttatcctcattctgaagtagggaaagagatcgccttaatacgcagaccttcggtaggaacgggcctattccacctatcctaccgagacaactaacttaccaaagaaccactacttagtactcgagaactaagtacggaacgacgacgtaggaacgacgacgtacggaaacgaccgtacgggtnttagttacgttaactttacgttggtacggtacggtaagttaggtaagtagtttacgttacgtttaacgtagtgtaacgtcggtacggttcggtttacgggttttaccggttacccggttacccggtacccggtacggggtaacccggtaccgggttaacccgttcggtaacccggttcccgttcccgtacccgtacgtacccgttacccgttacccgaaccccggtaacccgggaccccttacccgggttccccgtttacccccgttccccggtcccggcccccgttaccccgg

SEQ ID NO: 37394 - DNA, 534 bp, Homo sapiens
  misc_feature: GYAE6OF01DM32A.53.33.C11.1.454.CMB.1.raw
  modified_base (368)..(368): a, c, t, g, unknown or other
  misc_feature (368)..(368): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaaggccgattcaccatctcagagacaattccaagaacacactgtatctgacaaagtggacagctgagagctgaanacgacggctagtgtattacgtgtgcgagtgagatgtacttactatgatgcgagttggttcggtaccgttcgacccgtcgggaccgacgggtaccgtcggtcctaccgtctcctcgacgtctccaaccgacggccctagtacccgtcctccccgtcggccgtccccg

SEQ ID NO: 37395 - DNA, 680 bp, Homo sapiens
  misc_feature: GYAE6OF01ENZZI.53.33.C11.1.454.CMB.1.raw
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
tcagcgcgtatacacacgaccggtgctcgatttagagtgagctcgttgggtttgggctgagcgtggtttccgtcgttagctctttaagaggtgtccagtgtcacgtgcagctggtgcagtcgtgggggaggcgtggtccagccgtggggaggtccctgaaactctcctgtgcagcctctggattcgtctcaagttgtctaccctttgctacgtgggtcccgccaggcctccgaaggcgaagggctggagtgggtgcacttatctcatctgagtggaagagatcgcctattacgcagactccgngagggcctatcacatcncagagacaatccaaagacacgtactatatctagactaaagtggacagaccgtagaggacaccgtagaaacgacgaacggtcttaggttagttaacgtttcgtaggtcggacggtaaggtaggtaagtagttcggtttactttaacgtagtagtacgttcgacggttaagggtttgggttttaccggttacccggttcccggttaaccccggttcggggaaccggtaacccgggtcccggttccggtacccgtacccgttccgtacccgttccgtacgtacccgttacccgaaccggtacccggtcccctaaccgggtttcccgtacccccgtttccccgggtccggtaccccgtccccgg

SEQ ID NO: 37396 - DNA, 746 bp, Homo sapiens
  misc_feature: GYAE6OF01DPMVU.53.33.C11.1.454.CMB.1.raw
tcagcgcgtatacacacgaccggtgctcgatttagagtgagctcgttgggtttgggctgagcttgggttttcctcgttgcttcttttaagaggtgtccagtgtcacgtgcagctggtgcagtcgtgggggaggcgtggtccagccgtgggacgtccctagaaactctctgtgcagcctcgtaggtacttcgtctacaagtcgtccttacccgttgcctacggttcgggcccgccgaggtcctccgagggacgaagggggtctaggggaggtcgggtgacctacgtttatctacgattcgtaggagtaggaagagtagtcgtacctagtacgcgagtaccgtaccggtaggaacggtcctatccgaacctactcctacgaagtaacaactaaccttaaccgaaaacgaaccactaacgtcgtaactacgtacgaactaaaggcgaaccgtacgtcgtagaagtacgacgtaacggaacgaccgtacgtacgttagttacgtaacgttcgtaggtggtacggtagtaggacttacgttcgtaacgtttagtagtcgttacgtacggtcgtttaagggtttccggttaacccgggttacccggttaccccgggtaacccgggttcgggaacccggttaaccgggtaccgtcggtacccgaccggttcctacccgtcgtacgtacccgtaccccgtacggtaaccccggtccttaccggtcccgttccccgtaccggccgtcccgtcccg

SEQ ID NO: 37397 - DNA, 661 bp, Homo sapiens
  misc_feature: GYAE6OF01DBHKL.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaagggctggagtgggtggcacgttatctcatctgatggaagagatgctattacgcagactcgtagaacggccgattcaccatctcagagaacaatcaaagaacactatgtatctagacaaagtggacagacctgacgagctagaacgaacgacggacgtgttacggttaattacgttggtggtacggtagtaggagtattcgttactttacgtagtcgagttcgtacgttagtttcgggtttacggttacccggttccggtaccccggttaccggggaccgtaccggggtaacccggttccggttacccgaccccggttccgtcccgtacccggtaacgttccccgttaaccccgaacccgggtaacccgggtccccgttacggttaccccggttccccgtttccccccgtcggggtcccccgttacccccggg

SEQ ID NO: 37398 - DNA, 577 bp, Homo sapiens
  misc_feature: GYAE6OF01CRYSU.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtggggtgcacttatctcatctgatggaagagatgcctattacgcagactccgtgaacggcgattcacatctccagagacaattcaaagaacacactgtaatctagacaaagtggaacagcctgagagctagaagcgacggctgtagttattacgtgtgacgtagtgagtatgttacttactagtgatcgacgtaaggttgggtttacggttaccgttccggacccgtcggggacccgacgggtaacccgttcggtacctaccggtcctcccgtcgacgtccttacccaccggaaccggcccgtacgtcccggttcccttccccgtggtccccgtcccg

SEQ ID NO: 37399 - DNA, 549 bp, Homo sapiens
  misc_feature: GYAE6OF01CCZFL.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctgggagtggggtggcacttatctcatctgatggaagagatgcctattacgcagactccgtgaacgggccgattccaaccatcctccaagagaacaattccaaagaacacactgtatctagacaaatggacagcctagagagctagaacgacgacggctgtagtattacgtgtgcgagtgagtatgtacttatatgatgcgtaggttggtttcggtaccgttccgacccgtgggaccagacgaccgtcggtccaccgtctccacacgtcctaccaccgacggcccacgttcccggtcccttccccgtcggtccccg

SEQ ID NO: 37400 - DNA, 625 bp, Homo sapiens
  misc_feature: GYAE6OF01D568J.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcgaaggggctggaggtggggtggctacttatctcatctgatggaagagatgcctattacgcagactcgtgacgggccgattcaccatctcagagacaattccaaagacacactgtatctagacaaatggaacagcctgagagctagaacgacgacgctgtagtattacgtgtgacgtagtgagtattgtacttactatgtatcgcgtaggttcgggtttacggttacccggttcccggtaccccggttcggggacccggtaccggggtaaccccgtcgggttacccgtacccggttccttcccgtcgtacgtacccgttaccccgaacccggtaaccgggtacccccgtacgttccccggttaccccgtttccccccggtcgggtccccgtacccccgg

SEQ ID NO: 37401 - DNA, 956 bp, Homo sapiens
  misc_feature: GYAE6OF01DL8JE.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtctacctttgcacgtgggtccgccaggcctccgaggcgaaggggctgggaggtggggtcggctacgttatctcattcgtgagtggaagagatcgaccttagttacgcacgtaccgtccggtaggaacgggccgtattccaacctactccgttaccgaaggtaacgtaaacctaaacttacccgaaaaggaaacctaacgtaaccgttagtaacttcgtacgaacctaaaacggtcggaacctaacggtccgttacggaaacggtaacggtaccgttaaacggaaaccggtaaccggtacccgggtcgttacgggtaccggtaacgttaaaccgttttaccggtagggttacgggaccgggttaaagggttgggtaaacggtttacgtttaccggtttaaccgttttaaaccggtttaagtaacgggtttaaccgtttacgggtaacccgggttttaaggggtttttacccggggggttttttaccccggggtttaaacccccgggtttacccccggggttaaccccccgggggttaccggggggtacccccgggttaaaacccgggggttaccccccggtttacgggtaaccccccggttaacccggtttcccccgttaaccccgttaccggtaacccggttttccccccgttaaacccccggaaaccccgggtaaaccccggggttccccccttaaccggggttttaccccccgggtttcccccccgtttaaccccccggggtccgggttaccccccccggg

SEQ ID NO: 37402 - DNA, 776 bp, Homo sapiens
  misc_feature: GYAE6OF01CNGGR.53.33.C11.1.454.CMB.1.raw
tcagcgcgtatacacacgaccggtgctcgatttagagtgagctcgttgggtttgggctgagctgggtttcctcgttgctcttttaagaggtgtccagtgtcacgtgcagctggtgcagtctggggaggcgtggtccagcctgggaggtccctgaactctcctgtgcagcctctggattcgtctcaagtgtctaccttgcacgtgggtccgccaggctccgaggcgaaggggctggaggtgggtggctactagtctcatctgaatggaagagagtgcctattaacgctaggaactcccggtaggaacgggccgtatttccaccgtatcctcccaagtaagaactaattaccaaagaaaccacgtaaccttagtaactactaggaccaaaattacgggaccaagccgtagacgacgtactaggaaagaccgaacggtcttaggtacgttaagttaccgtaggtgtaccggtaaggttcgaaacgggtagttacggttacgtttaaacccgttagttacggtaattaccggacggtttaacgggttacggggtttttccgggtttaaaccccgggttccggtaacccccgggttacggggggtacccgttaacccgggggtaacccgtttcgggtaacccgtacccggtttaccgttaccccgtaccggtaccgttacccggttaccccgtaaacccgggtaaaccccggtacccgtaaccgttttccccgggtaccccggtttaccccccgttcggggtaaccccccgttccccgggg

SEQ ID NO: 37403 - DNA, 790 bp, Homo sapiens
  misc_feature: GYAE6OF01BLGMJ.53.33.C11.1.454.CMB.1.raw
tcagcgcgtatacacacgaccggtgctcgatttagagtgagctcgttgggtttgggctgagctgggttttcctcgttgcttcttttaagaggtgtccagtgtcacgtgcagctggtgcagtctgggggaggcgtggtccagcctgggaggtccctgaaactctcctgtgcagcctctggattcgtctctaagtcgtccttaccctttgcctacgtcgggtcccgccgaggcctccgaggcgaaggggcgtgggaggtcgggtggctacttatcctcatcgtagagtaggaagagatcgaccttaattacgactaacggaccgtccggtaggaacggggaccgtattcccaaccgtactcctaccgaagaacgtaactaaacgttacccaaaagaaccaccgtacttagtactactagaaccgtaaagtacggaacacggtacccgtaggaacgtacggtacgtaaggaaacggaaccgtacgggtacttaggttagttaacgtttaccgtggtacggagggtaacgtaagggtactaaggttttacggttaacttttaacgttagtaggtaacttccgggtacgtttaagggtttccgggtttaccggttaccccggttaccccgggtaccccgggtacggggtccccggtaacgggtaaccccgtccgggttaccgtacccggtcccgttcgtaccgtacccggttaccctaccccggaaccggtacccggccccgttacccggttaccccggtttcccccgtccccggtcgggccccccgttacccgg

SEQ ID NO: 37404 - DNA, 605 bp, Homo sapiens
  misc_feature: GYAE6OF01DZ7IM.53.33.C11.1.454.CMB.1.raw
  modified_base (253)..(253): a, c, t, g, unknown or other
  misc_feature (253)..(253): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctacctttgcactgggtccgccaggctccaggcaaggggctgggagtgggtggcacttanctcatctgatggaagagatgcctattacgcagactccgtaggaacgggcctattcaccatctccagagacaattccaaagaacacactgtatctgacaaagtgacagcctagagagacgtaggaaacgacgacggtctggtagttattacgtggtgacgaggtagagtagttcgtacttactagtcgatcgtcgtaggttcggtttacggtacccgttccggtaccccggttggggacccgtacgggacccgttcggtaccgtacccgttcctccgtcgtaccgtccgttacccgaccggtaacggccccgtacgttcccggttaccctttcccccgtggtccccgtccccg

SEQ ID NO: 37405 - DNA, 777 bp, Homo sapiens
  misc_feature: GYAE6OF01DHK2W.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggaggtccctgaaactctcctgtgcagcctctggattcgtctacaagtcgtcctaccctttgctacgtcgggtcccgcgtaggcctccgagggcgaaggggctgggaggtgggtgctacttatctcatctagagtaggaagagatcgtacctagttacgcaggtaccgtccggtaggaacgggtcccgtacttccgaacctacgtcctaccgaagaacgaactaaaccttaccaaacgaaacctaactacttacggttaactcgttaagaacgtaaagtcggaactacgaccgtaggacgaacggtacgtaaacggaacggaccggtacggtcgtttacggtttaacgttaacgtttacgggtggttacgacggttaaggtgtaacgtagttacggtttaccttaagtagttgtaacgttcggtaccggtttagggttttaccgggtttacccggttaccccgggttcccggttaaccccgggtcggggtaaccccggtacgggtaaccccggttccgggtaacctaccccggttccgtacccgttacggacccttaccgtaccccgacccggtaacccgggtcccctacggttccccgtccccgtttccccggtcggccccgttccccgg

SEQ ID NO: 37406 - DNA, 583 bp, Homo sapiens
  misc_feature: GYAE6OF01B71QA.53.33.C11.1.454.CMB.1.raw
  modified_base (314)..(314): a, c, t, g, unknown or other
  misc_feature (314)..(314): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccgaggcaaggggctgggagtgggtggcacttatctcatctgatggaagagatgcctattacgcagactcgtgaggccattcacatctcaganacatcaagaacacactgtatctgacaatggacagcctgagagctagaagaccgacggctagtgtattactgtagcgtagtgagtattgtctttactatgatcgacgtaggttacggtttcggttaacccgttccgaccccggttcggggacccgacgggtaaccccgttggtacccgtacccgttcctcccgtcgtaccgtccgttacccgacccgaaccgggccccgtacgttacccggttcccttcccccggtcggtcccgtccccg

SEQ ID NO: 37407 - DNA, 647 bp, Homo sapiens
  misc_feature: GYAE6OF01AXB4U.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccgccaggcctccaggcgaaggggctgggaggtggggtggcacttatctcatctgatggaagagatgacctatacgcagacctcgtggaacgggccgtattcaccatcctccaagacgaacaacttaccaaagaacaacactagtaactcgtagacaaagtcggaacagcctaggaagagactaggaacgaccgacggtcttaggttagtactttacgtggtagacggtaagtagaagtagttcgttactttaacgtagtacgtagtcgtccggttaaggtttcgggttttaccgggtaacccggtttcccggtaccccggtaggggtacccgacgggtaacccgtcggtaccgtacccgtcctacccgtcaccgtcctacccgaaccgaaccggaccctacgtcccggttacccttccccgcggtcccgtcccg

SEQ ID NO: 37408 - DNA, 601 bp, Homo sapiens
  misc_feature: GYAE6OF01CIXTW.53.33.C11.1.454.CMB.1.raw
tcagcgcgtatacacacgaccggtgctcgatttagagtgagctcgttgggtttgggctgagctgggtttcctcgttgctctttaagaggtgtccagtgtcacgtgcagctggtgcagtctgggggagcgtggtccagcctgggaggtccctgaaactctcctgtgcagcctctggattcgtctcaagtgtctacccttgcacgtgggtccgccaggcctccgaggcaaggggctgggagtgggtgcacttatctcatctgatggaagagatgcctattacgcagactccgtgaacgggcctatcaccatcctccagacgacaattccaaagaacacactgtatctgacaaagtggactagacctgagagctagagacacgcgtgtgtattacgtgtgcgtagtgagtatgtacttacgtattacgacgtgacctaggttacgggtttcggttacccggtttccggacccggttacgggacccgtacggggtaacccgtcggttccgtacccgttaccctccgtccgtacggttccttcccgacccgtaaaccgggtcccctaacggttccggttaccctttcccccgtgggcccgtccccg

SEQ ID NO: 37409 - DNA, 657 bp, Homo sapiens
  misc_feature: GYAE6OF01C68HG.53.33.C11.1.454.CMB.1.raw
  modified_base (218)..(218): a, c, t, g, unknown or other
  misc_feature (218)..(218): n is a, c, g, or t
  modified_base (329)..(329): a, c, t, g, unknown or other
  misc_feature (329)..(329): n is a, c, g, or t
  modified_base (370)..(370): a, c, t, g, unknown or other
  misc_feature (370)..(370): n is a, c, g, or t
  modified_base (402)..(402): a, c, t, g, unknown or other
  misc_feature (402)..(402): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtctaccctttgcacgtcgggtcccnccaggcctccgaggcgaaggggctggagtgggtggcacgttatctcgatctgataggaagagatgacctagtacgacagcgtcggtaggaacggccgtattccaccatccncagacgactaattaccaaagtaacactactagtactcgtanactaaagtacgacagcctagagacgatagganacgacgctggttatattacgtgtcggacgtagtgagtagtcgttacttaagtactagacttcggtaccgttagggtttacggttttcccgggtacccgttcccgggtaccccgggtacggggtacccgtaccggggtaccctcggtacccgtacccggttcctcccgtacgtaccgtcccgttacccggaacccggaacccgggtcccctaaccgttcccgggttccccttcccccggtcggtccccgtaccccg

SEQ ID NO: 37410 - DNA, 723 bp, Homo sapiens
  misc_feature: GYAE6OF01C7543.53.33.C11.1.454.CMB.1.raw
  modified_base (217)..(217): a, c, t, g, unknown or other
  misc_feature (217)..(217): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctagaaactctcctgtgcagcctctggattcgtctcaagtcgtctacccttgcacgtgggtccncgaggctcgaggcaaggggctggaggtgggtgactacttatctacatctgaagtaggaagagagtcgtacctaatacgcgacgtacgtccggtaggaacggccgtacttccacctatctaccgagaacgaacaacttaccgaaagtacactactagtactaccgtagaacgtaaagcggtaacgacgtaccgtagaacggtaaggtaccaaggaacggtacgacgggtacttaggttacgtaagttacgtggtaggtacgtaggtagaacgttagttcgttaacgttacttagtagtacgtcgtacgtagggtttaccgggtttacggttacccggttcccgggtaaccccgggttcgggtaacccggtaccgggtaaccggttaccggtacccggtaccgttacctacccggttaccaccggttaccctacccgaaacccggtacccggttacccgtaacccggtttacccgtcccccgttccccggccggtcccgtaccccggg

SEQ ID NO: 37411 - DNA, 730 bp, Homo sapiens
  misc_feature: GYAE6OF01B99Z5.53.33.C11.1.454.CMB.1.raw
  modified_base (484)..(484): a, c, t, g, unknown or other
  misc_feature (484)..(484): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggacggtccctagaaactctcctgtgcagcctctggattcgtctacaagtcgtctaccttgcacgtcggccgccaggctcgaggcgaaggggctagggaggtgggcgctacttatctacatcgtagagtaggaagagtagtcgtacctagttacgacgacgtaccgtccggtaggaacgggtccgtacttccaacctacttaccaccgaaggaacaaacctaaacgttaaccgaaaacgtaacactaccgttagtactacgtagaaacgtaagtacggaaccacgtaccgtaggaacgtacgacgtacgaacgacggacgtcgttagtagtacttagngtacgacggtagtagagtattacgttacttacgtatacgtagtcgtacgtagggtttacggttccggttaaccgtcccgggtacccggtacgggtaccccggtaacggtaccccgttaggtcccgtaaaccccgttccgtacccgacggttaccccgtaccgttaacccccggaaccggaaccccgggtcccttaacccgggttccccggttcccccgttccccggcggtcccccggttaccccgg

SEQ ID NO: 37412 - DNA, 564 bp, Homo sapiens
  misc_feature: GYAE6OF01B2VN8.53.33.C11.1.454.CMB.1.raw
  modified_base (414)..(414): a, c, t, g, unknown or other
  misc_feature (414)..(414): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (511)..(511): a, c, t, g, unknown or other
  misc_feature (511)..(511): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtcttaccctttgcacgtgggtccgccaggcctccgaggcaaggggctgggagtgggtggctacttatctcatcgtgactggaagagatggaccttattaaccgcaacgtacctccggtagaacggggtcccgtattccaccatcctccagacgacaattccaagaacacactgtatctgacaaatggaacagtcctagacgagactagaagacgacgctgtntattacgtgtgcgtagtgagtattgtcttanatnatgctgttggttcgtacgttccgccgtcgggaccacgggtacctcgtcctaccgtctcctcgngtcctccgaccgtacggccctcgtccggtacccttccccgtggtcccgtcccg

SEQ ID NO: 37413 - DNA, 793 bp, Homo sapiens
  misc_feature: GYAE6OF01EEP48.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgcgcagctggtgcagtcgtgggggaggcgtggtccagcctgggaggtccctgaactctcctgtgcagcctctggattcgtctcaagtgtctaccctttgcactcgggtccgccaggctccaggcaaggggctggagtgggtgcacttatctcatctgatcggaagagatgccttaagttacgcagaccttccggtaggaacgggccgtattccaccgatccgtaccaaggacgtaacctaaacgtttaccgaaaacggaaacctaaccgaaccgttagttaacgttaccgttacggtaaacctaaaaacggtttcgggaaaccgtaacggtaccccgttagggaacggaacggtaccgttaacgggaaaacgtaccggtaaaccgggtccgttacgggttttaacgtttaacgttttaacccggttaggttacgggtaaccgggttaagggttagggtaacggtacgtttacggttacgttttaaaccgttaagtacggttaagttccggtacgtacgggtttagggttttaccggtacccggttccggtaccccggtcggggtaaccgaccggggtaacccgtcggtacccgtccgtccgttccctacgtacgtccgtttacccgaacccgtaccgggaccctaccggttacccggttccccgtttcccccgtcggtcccgtacccgg

SEQ ID NO: 37414 - DNA, 661 bp, Homo sapiens
  misc_feature: GYAE6OF01B2U4S.53.33.C11.1.454.CMB.1.raw
  modified_base (361)..(361): a, c, t, g, unknown or other
  misc_feature (361)..(361): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcgaaggggctggagtgggtggcacttatctcatctgatggaagagatgcctattacgcagactccgtgaggccattcacatctcagagacaattaccaagaacacactagtatctgacaagtggacagacctganagcgtagaacgacgtacggcttgtagtattacgtagtcgacgtagtgagtagttcgtacttacgtagtcgtaagtcgacgtagggttcgggttttacggttaccccgggttaccgtacccccgggtcgggggtacccggtaacggggtaaccccgtcgggttacccctacccggttcccgttaccccgttacgtaccggttaccccttaccccgaaccccggaaaccgggtccccccgtaacggtttcccccgggttaacccccctttccccccgggttcgggtcccccgttacccccgg

SEQ ID NO: 37415 - DNA, 634 bp, Homo sapiens
  misc_feature: GYAE6OF01A4059.53.33.C11.1.454.CMB.1.raw
  modified_base (327)..(327): a, c, t, g, unknown or other
  misc_feature (327)..(327): n is a, c, g, or t
  modified_base (435)..(435): a, c, t, g, unknown or other
  misc_feature (435)..(435): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtggtccgccaggctccgaggcaaggggctgggagtggggtggcacgttatctcatctgatggaagagatgacctattacgcagactccgtagaacgggccgattccgaccatcctcaganacaattaccaaagaacacactgtactcgtagacaaatcggaactacgccgtagaacgtagactagaagacgacggtcttgtagtacttacgtgtagacgagtagtagnttgttactactagtgtatcgtacgtaggtttcgggtttaccggtaccgttacccgacccggttacggggtaccgaccgggtacccgtgggttacccgtacccgttaccgtcccgtctacgtacccgttacccacccggtaacccggcccgttaccggttacccggttcccccgttccccggtcggtccccgtaccccgg

SEQ ID NO: 37416 - DNA, 682 bp, Homo sapiens
  misc_feature: GYAE6OF01BXC7U.53.33.C11.1.454.CMB.1.raw
  modified_base (390)..(390): a, c, t, g, unknown or other
  misc_feature (390)..(390): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcgaaggggctgggagtggggtggcacttatctcatctgatggaagagatgcctattacgcagactccgtgaagggccagttccaccatcctccagagacaattccaaagaaccacactgtatctgacaatggacagcctagagagctagacgacgacggctgtntattacgtgtgcggtagtggagtagttcgttactttaacctaagtacgtagttacggaccgttagggttcgggttttaccgggttaccccgggtttcccggtaacccccgggttcgggggaccccggtaaccggggtaaccccgtttcgggtacccgtaccccggttcccgttccccgttccgtaccgtaccctttacccccggaaacccgtaacccggggtacccccctaacggtttcccccgggtttccccgtttaccccccccggttgggtccccccgttaccccccgg

SEQ ID NO: 37417 - DNA, 622 bp, Homo sapiens
  misc_feature: GYAE6OF01DJP4N.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccgccaggctccgaggcgaaggggctggagtgggtgctactatctcatctgatggaagagatgctatacgcagactcgtagaacggccgattcaccatctccagacgacaattccaagaacacactgtatctgacaagtacggacacgcctagacgagactagaacgacgacggtctagtgttattacgtgtcgacgtagtgagtattcgttacttactagtagtatcgtcgtaagtttcgggtttaccggttacccggttccggtaccccggtcggggacccgacgggtacccgtcgggtacccgtacccgttcctcccgtccgacgtcccgttacccgaaccggtaaccgggtccccgttaccggttacccggttccccgtttacccccggtcggtccccggtccccg

SEQ ID NO: 37418 - DNA, 715 bp, Homo sapiens
  misc_feature: GYAE6OF01BCVCJ.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctggggggaggcgtggtccagcctgggaggtccctgaaactctcctgtgcagcctctggattcgtctcaagtgtctaccctttgcacgtgggtccgccaggctccgaggcgaaggggctggaggtgggtggcacttatctcatctgagtaggaagagatcgactagttacgcacgtacgtccggtaggaacgggccgtattaccacctactctaccgagacgaacaacttaccaaagaacacacgtagtactactaggaactaaagtacggaacgtacgacctaggaacgacgtacgtaaggaacgaaccggtacggtcgttaggtacgttaagtttacgtaggttacggacgtaggtggaagtagttcgttacgttacgttagtagtacgtcgtaccgttagggtttacggttttaccgggtacccggtttacccggtaccccgggttacggggtaacccgtaccggggtaacccgttcggtaacccgtacccgttccttacccgtaccgtacggtaccccgttcccgaaacccggtaccggtacccttaccggttcccggttcccccttacccccgggtcggtccccgtcccg

SEQ ID NO: 37419 - DNA, 633 bp, Homo sapiens
  misc_feature: GYAE6OF01B3RWQ.53.33.C11.1.454.CMB.1.raw
  modified_base (214)..(214): a, c, t, g, unknown or other
  misc_feature (214)..(214): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccnccaggctccaggcaaggggctggagtgggtggcacttatctcatctgatggaagagatcgcctattacgcagactccgtagaacgggcctattcaccgatcctcagacgacaattaccaaagaacacactagtatctgacaagtggacagcctagagagctagaacgacacggtctgtagtattacgtggtagagagtgagtattgtactttacgtatgatcgacgtaggtttcgggttaccggttacccggttcccggacccggttacggggacccgacggggtaaccccgttcgggacccttacccggtccttaccccgtactaccgttcccgttacccgaaacccggaaccggggtccccctaacgggtttccccggttccccctttccccccgggtgggtcccccgtcccccggg

SEQ ID NO: 37420 - DNA, 709 bp, Homo sapiens
  misc_feature: GYAE6OF01CHF0L.53.33.C11.1.454.CMB.1.raw
  modified_base (336)..(336): a, c, t, g, unknown or other
  misc_feature (336)..(336): n is a, c, g, or t
  modified_base (419)..(419): a, c, t, g, unknown or other
  misc_feature (419)..(419): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtccttaccctttgcacgtcgggtcccgccgaggccttccgaggcgaaggggctgggagtggggtggctacttatcctcatctgagtagggaagagatggacctaattacgcagacctcggtaggaacgggccattccaccatcncagagacaacgttaccaaagaacacactagtactctagacaaagtggaacacggcctagacgagtcctagaacgaccgacggngttaggtagtaactttacgtgttggacgtaggtagtagtagttcgttactttaacgtagtttacggaacgttccgtaccgttaagggttttcggggtttaacccggttacccgggtttcccggtaaccccgggttacggggaccccggttaacgggtaacccccggttcggtacccgttacccggtcccttacccgtaccgtaccggttacccttacccgaccccggtaaccggtccccgtaaccgttcccgggttaccccttcccccggtcgggccccgttcccccggg

SEQ ID NO: 37421 - DNA, 631 bp, Homo sapiens
  misc_feature: GYAE6OF01CHWXS.53.33.C11.1.454.CMB.1.raw
  modified_base (172)..(172): a, c, t, g, unknown or other
  misc_feature (172)..(172): n is a, c, g, or t
  modified_base (337)..(337): a, c, t, g, unknown or other
  misc_feature (337)..(337): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (471)..(471): a, c, t, g, unknown or other
  misc_feature (471)..(471): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtggggggaggcgtggtccagccgtgggaggtccctagaaacctctcctgngcagcctctggtattcgtctacgaagtgtctaccgttgcacgtcggccgcaggtccacgaggcgaagggcgtggaggtggggtggctacttatctcatcgtaggagtaggaagagtatcgtaccttagtacgacacgtacgtccgtaggaacggctactccactntccacaacgagaacaataccaaacgaacactatacgtatacgtagaacaaagtacgacgacgacgtagacgaagtacgaaggacgaccgagtacgtgtagtatacgtgtcgagtagngagtntcgttatatagntagtcgtcgttaggttcggtttccgggtacccgttcccggacccgggtcgggaccggtaaccgggtccggtacgtcccgtaccgtcctaccgctaccgaccctacccgacccggaaccgtccctacgggtcccttccccgtcccgtccggtcccgtcccg

SEQ ID NO: 37422 - DNA, 556 bp, Homo sapiens
  misc_feature: GYAE6OF01DPLXA.53.33.C11.1.454.CMB.1.raw
  modified_base (544)..(544): a, c, t, g, unknown or other
  misc_feature (544)..(544): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctgggagtgggtggcacttatctcatctgatggaagagatgcctattacgcagactcgtgaagggccattcaccatctccagagacaattccaaagaacacactgtatctagacaaagtggaacagccctggagagctgaagacgacggctggtagtattacgtgtgcgagtgagatgtcttactatgatgctaggttggtttacggtacccgttccggacccgtggggacccgacgggacccgtcggtccaccgtctccgtcacgtcccttccgaacccgaggcccctacgttcccgtcccttaccccgnggcccgtccccg

SEQ ID NO: 37423 - DNA, 575 bp, Homo sapiens
  misc_feature: GYAE6OF01BZDM0.53.33.C11.1.454.CMB.1.raw
  modified_base (254)..(254): a, c, t, g, unknown or other
  misc_feature (254)..(254): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctgggagtggggtgcacttanctcatctgatggaagagatgcctattacgcagactccggtgaacgggccgattcaccatcctaccagagacaacttccaaagaacacactagtatctgacaaaatcggacagcctagagagctaggaagaacgacggctaggtagttattactgtagcgtagtgagatgtacttactatgatgacgtaggttggttacggttaccggttcgaccccgtcggggccgacgggaacccgtggtccaacccggtcttacccgtcagtcccttaccacccgtaacggccctagtcccggttaccttccccccgtggcccgtcccg

SEQ ID NO: 37424 - DNA, 1043 bp, Homo sapiens
  misc_feature: GYAE6OF01CGSUK.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtggggggaggcgtggtccagccgtgggaggtccctgaaactctcctgtgcagcctctggattcgtctcaagtcgtcctacctttgctacgtcgggtccgccgaggctaccgaggacgaaggggtcgtaggaggtgggtgctacgttatctcatctagagtaggaagagactcgaccttaagttaccgacgaacggtaccgttccggtaagggtaaccgggtaccgtaactttcccgaaacccgtattacccgttaaccgaaggtaaccgtaaaccttaaacgttaacccgaaaagtaaaacccgtactaaccgtacggttttaaaccgttaccgttaacggtaaacccttaaaacgggtttaccgggaaaccggttaaccggtaccccggttaacgggtaaaccgggttaacggtacccgtttaaacgggaaaccggttaacccgggtaaccgggttccgtttaagggttaaccggttttaaaccggttttaaccggttacggggttaacgggtaacccgggtaagggtttaaaccggtaacgggttttaacggttaacccggttttaacccgtttaaacgttacggttaccggttaacggtttacccgggttaccggtttaacgggggtttttaccggggttttaacccggggttaacccccgggttttaccccggtaaccccgggggttacccggggttaaaccccgggtaaaccccgggggttaaccccgtttccggggtaaccccgtttaacccccgggttaccctttaaccccgggttacccgtaaacccgggtttccccccgtttaaacccgggaaaccccgggttaacccgggttacccccgttaaccgggttttacccccggtttcccccccgttaacccccgggttcgggtaccccccggtttaaccccggg

SEQ ID NO: 37425 - DNA, 864 bp, Homo sapiens
  misc_feature: GYAE6OF01EOQ35.53.33.C11.1.454.CMB.1.raw
tcagcgcgtatacacacgaccggtgctcgatttagagtgagctcggttgggtttgggctgagctgggttttcctcgttgctcttttaagaggtgtccagtgtcacgtgcagctggtgcagtcgtgggggaggcgtggtccagccgtgggacggtccctgaaacctctcctgtgcagtcctcgtggtacttcgtctacgaagttcgttccttacccgtttgacctacggttcggggtcccgaccgtagggtcctacccggaagggtaccggaaggggggtccttagggggaggttcgggggtcggacccttaacgttttactcccttacgtaacgttcgttaggaaggttagggaaaacggtaagtacgttaccggtacctttaagtttaaccggactaacggtaccccggttaccgggttaagggaaaccggggtcccgttaactttacccgaacccttacgtcccgttaaccgaaggaacgtaacctaaacgttacccgaaaagtaaccaacgtacgttacggtaacttacgacgtaaacgtaaaacggttcggaaaccgtccggtaccggtagaaacggtacgtacgtaaacgaacgggtaccgtaacggtcgttaaggttacgttaacgtttacggtggtacggaggtaggtaggtaagtagtacgtttaacgttatagttagtacgtcgtacggttgggtttacggttacccggttacccggtacccgggtacccggtacggggtacccggtaaccggttcccgtacgtacccggtcccgtacctacgtactaccgtccctaccgaccggaccggtcccgtaccggttcccgttacccgttccccgtggtccccgtccgg

SEQ ID NO: 37426 - DNA, 771 bp, Homo sapiens
  misc_feature: GYAE6OF01C290O.53.33.C11.1.454.CMB.1.raw
  modified_base (228)..(228): a, c, t, g, unknown or other
  misc_feature (228)..(228): n is a, c, g, or t
  modified_base (419)..(419): a, c, t, g, unknown or other
  misc_feature (419)..(419): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggagtccctgaaactctcctgtgcacgcctcgtggattcgtctacgaagtcgttccttacccgttgcctacgtcgggtcccnccgaggcctccgagggcgaaggggctgggaggtgggtcgctacgttatctcgattcgtaggagtaggaacgtagtaagtcgtaccttaagtaccgactacgtacccgtcggtaacggaccggtaccgtattaccaccgtactccgtaccgaagtaactaactaacttaaccaaaacgtaacacgtacgttntacgtacgtacgaactaagtcggaaactcgtacgtagaggtacgtacgacgtaacggacggtacggttagttaggtttacgttaactttagggcgttacgggaaggtacggttaagacggttagttaccggtttaaccttaagttagttacgtaacggttaccgtaccggtttagggttttaccgggtttacccggtcccggttacccggacccgggttccggggaaccggttaccgggtacccgtcggttaccctaccggttccctaccgtccgtaccgtaccccgttacgaaccccggttacgtaccccgttacccggtcccgttacccgtccccgcgtccccgtaccgg

SEQ ID NO: 37427 - DNA, 748 bp, Homo sapiens
  misc_feature: GYAE6OF01CN0AR.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtggggggaggcgtggtccagccgtgggaggtccctagaaactctcctgtgcagcctctggacttcgtctacaagtcgtcctaccctttgcctacgtcgggtcccgccaggcctccgaggcgaaggggctgggaggtgggtgactacttatctacatctagagtaggaagagtatcgtacctagttacgacgacgtaccgtaccggtagggaacggtccgtacttccgaacctactacctacgaacgaacgtaactaacttaccgaaagaaccactactagtactacgtacgaacaaagtcggaacacgtccgtagagacgtacgtaacggaacgaccgacggtcgttagttagttaacgttacgtggtacgtacggtaaggtgaacgtacttacgttaccttaacgtagttacggtacgtaggttaccgttagggttttcgggtttaccgggtacccggtttccccggaacccgggttcggggtaacccgtaccgggtaacccgttcggtacccgtacccggttcctacccgtaccgacccgttacccgtaccccggaaacggtaccccgggtacccgttaccgttcccccgggttaccctcccccggtccggccccgttccccgg

SEQ ID NO: 37428 - DNA, 636 bp, Homo sapiens
  misc_feature: GYAE6OF01A2B85.53.33.C11.1.454.CMB.1.raw
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccnccaggctccgaggcaaggggctggaggtgggtgcacttatctcatctgatggaagngatgctatacgcagctccgtgaagggccgattcacctatcctaccagacgacaacttccaaagaacacactgtatctagacaagtggacagcctagagagctagaacgacgacggctgtagtattacgtggtgacgtagtacgagtagttcgttactttaactagtcgtagtcgtaccgtaggtttcgggtttaccggttacccggttcccggtaccccggtcggggtacccgtaaccggggtaacccgttcgggtaccctaccggttcccgtaccgtccgtacgtcccgtacccgaaccccgtaaccgggcccctacggttccccgggttcccctttccccccggtcggtcccccgtcccccgg

SEQ ID NO: 37429 - DNA, 675 bp, Homo sapiens
  misc_feature: GYAE6OF01DEJG4.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtcctaccctttgcacgtgggtccgccaggctccaggcaaggggctgggagtgggtggcacttatctcatctgatggaagagatgaccttatacgcagactccggtagaacggccgatcaccatctcagagacaatccaagaacacactgtatctagacaaagtggacacgcctagagacgatacgaagacgacggcgtcgtagttattacgtgtcgacggagtcgtagtagttcgttacttaacgttatagtacgttcgtaccgtaggtttacgggttttacgggttaaccccggtttaccggtacccccgggttcgggggaccccggtaccggggtaaccccggttaccgggttacccgtaccccggtttcctacccgttccgtaccgtcccgtttaccccgaacccgggttaaacccgggaccccgttaaccggttaccccggttccccgtttcccccccgtcgggtcccccgtaccccgg

SEQ ID NO: 37430 - DNA, 804 bp, Homo sapiens
  misc_feature: GYAE6OF01AXKRK.53.33.C11.1.454.CMB.1.raw
tcagcgcgtatacacacgaccggtgctcgatttagagtgagctcgttgggtttgggctgagcgtggtttcctcgttgctctttaagaggtgtccagtgtcacgtgcagctggtgcagtcgtgggggaggcgtggtccagccgtgggaggtccctgaactctcctgtgcagcctcgtggattcgtctcgaagttcgtcctaccctttgctacgtcgggtccgccgaggcctccgaggcgaaggggctgggaggtgggtcggactacttatctctatcgtagagtaggaagagatcgtacctagttacgcgacgtaccgtccggtaggaacgggcctaacgttaccaccgtagtacctaccgaagtaacgtaaactaacgttaacccgaaaacaaccaactacgttacgtactacgtagaacgtaaaacgtcggaactacggtaccgaggaacgtaacggaccgtaaggaaccgtaaccggtacggtacgttagttacgttaacgttacgtaggtcggtaacgtaaggtaggtaagtaggtttacgttacgttaacgtagtacggtacgttaccggacggttttgggtttaccgggttttacccgggttaccccggttacccggtacccggggtacgggtaccccggtaaccgggtcccgttaaccgggtccttaaaccccggttccctacccgggttaccgacccggtttaccccggtaaccccgttaaacccgggtacccggtacccccgttacccgtttccccgggtttacccccctaccccgggtccggtccccgtacccgg

SEQ ID NO: 37431 - DNA, 701 bp, Homo sapiens
  misc_feature: GYAE6OF01EIE0Q.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggaggtccctgaaactctcctgtgcagcctctggattcgtctcaagtgtctaccctttgcacgtgggtccgccaggcctccgaggcgaaggggcgtgggaggtggggtcggctacttatcctcatcgtgagtggaagagatcgacctattacgcagacctccggtagaacgggcctattcgaacctatcctaccagagaactaattaccgaagaaccacacttagtactctagaacaaagtcgggaacagcctagagagactagaacgacgacggtctacgtgtaacttcgtggtgcgagtgagtagttacgttacttaagtatagtactcggtacgttagggtttcgggtttaccggttacccgggttacccggtaccccgggttacgggacccgtaccggggtaaccccgttcgggtacccttacccgtccgttacccgtaccgtaccggttaccccttaccccggaaacccggtaacccgggttacccccgtaacggttacccccgggtttccccgtttcccccccggtgggtccccccgttaacccccggg

SEQ ID NO: 37432 - DNA, 565 bp, Homo sapiens
  misc_feature: GYAE6OF01AH5HW.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgacctattacgcagactccgtgaagggccattcaccatctccagagacaattaccaagaacacactgtatctgacaatggacagcctagagagctagaacgacgacggctgtgtattacgtgtgcgagtagagtagtgtacttactatgatcgtcgtaggttcggttcggttaccgttccggtacccgtcgggaccgacgggtaccgtcggtcgtaccgtccgtcccgtaaaacgtcgtacctcccgacccgaccggccctaccgtccgtcccttccccgtcggcccgtcccg

SEQ ID NO: 37433 - DNA, 818 bp, Homo sapiens
  misc_feature: GYAE6OF01D8E6P.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggacttcgtctcaagtcgttcctaccctttgccacgttcgggtccgccaggcctccgaagggcgaaacgggggctgggaggtggggtacggcctaacgtttatccttcgaacgttcgtaggtaagtagggaaagaggtaacgtcggtaccttaagttaccggaccgtaacggtaacccgttcccggtaagggaaaccgggtccgtaactttaccaccgtatcctaccgaagtaaccgaactaaactaccgaaagaaaccactagtacgtactacgtgaaactaaagtcggaacacgtaccgtagaagtacgtacgtaaggaacgacggtactcggttacgttagttaacgttcgtaggtgaacggtgtacggtagtacgttcgtttaacttaacgttatacggtaatccgggttaaccgttagggttttaccgggttaccgggtttaacccccggttacccggtaaccccggggttcgggggaacccgggtaaacccgggttacccggttaggttaccccgtaaccccttccggttcccgtaaccgtcccggttaccctaccccggaaaccggtaccgtaccccgtttacccgggttacccgttccccccgttacccgttcccgggaccccgttaccccgg

SEQ ID NO: 37434 - DNA, 664 bp, Homo sapiens
  misc_feature: GYAE6OF01C9P67.53.33.C11.1.454.CMB.1.raw
  modified_base (273)..(273): a, c, t, g, unknown or other
  misc_feature (273)..(273): n is a, c, g, or t
  modified_base (387)..(387): a, c, t, g, unknown or other
  misc_feature (387)..(387): n is a, c, g, or t
  modified_base (651)..(651): a, c, t, g, unknown or other
  misc_feature (651)..(651): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggaggtccctgaaactctcctgtgcagcctctggattcgtctcaagttcgtccttaccctttgctacgtcggggtcccgccaggcctccgagggcgaagggggctgggaggtggggtggctacttanctcatctgagtaggaagagattcgacctagttaccgcacgtaccgtcggtaggaacgggccgtattccaccatcctacgagaacgaacaactaccaaagaacactactgtactnagtactaaagtcggaacagaccgtaggacgagacgtagaacgacgacggtcttggttattagttcgtagtgacggtagtaggtagtagtcgttacttacgtagtcgtaagtcgtaccggtaggtttcgggtttaccggttaccccgttccggacccgggtcgggacccgtacgggtacccgttcggtaccaccgttcctccgtaccgacgtcccgttacccaccgggtaaccgccctaacgttccccggttcccttcccccggngccccgtaccccg

SEQ ID NO: 37435 - DNA, 846 bp, Homo sapiens
  misc_feature: GYAE6OF01B3DSZ.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctggggggaggcgtggtccagcctgggaggtccctgaaactctcctgtgcagcctctggattcgtctcaagtgtctaccctttgcactgggtccgccaggctccaggcaaggggctgggagtgggtggcacttatctcatctgatggaagagatgcctagttacgcagactccggtaggaagggccgattccaccatcctccagacgaacaattaccaaagaaccacactgtaactcgtagactaaaagtcggaaacgacgacccgttaggaaggacggacgtaggaaacggtaaccgtacgggtaccgttagggttaacgtttaacgttttaacgttggttacggtaccgggtaaggtaggtaaggtagtttacggtttaccttttaaccgttattaacggtacgttcgggtaccgttaaggggttttacgggggtttttaacggggttaacccccgggttttacccgggtaacccccccggggttacgggggggttaacccccgggtaacccggggggttaaacccccgttccgggggtttaaccccgtaacccccgggtttaccccgtttacccccgtttacccggtaacccggttccccgttttaaaccccccggaaccccgggtaaaaccccggggggttacccccccttaacgggtttcccccggggtttaccccccgttttccccccccgggttcccgggtcccccggttcccccccgg

SEQ ID NO: 37436 - DNA, 819 bp, Homo sapiens
  misc_feature: GYAE6OF01DZ4AV.53.33.C11.1.454.CMB.1.raw
  modified_base (236)..(236): a, c, t, g, unknown or other
  misc_feature (236)..(236): n is a, c, g, or t
  modified_base (460)..(460): a, c, t, g, unknown or other
  misc_feature (460)..(460): n is a, c, g, or t
tcagcgcgtatacacacgaccggtgctcgatttagagtgagctcgttgggtttgggctgagcttgggttttcctcgttgcttcttttaagaggtgtccagtgtcacgtgcagctggtgcagtcgtgggggaggcgtggtccagccgtgggacgtccctagaaactctctgtgcagtcctcgtggtattcgtctacgaagttcgttccttacccgtttgacctacgtcggggtcccnccgaggcctaccgagggaccggaagggggtctggggaggttcggggtcgtaccttaacttactcctactatcgtaggaagtagggaagtagtacgttacggtaacctttaacgttaccggaccgtaacggtaccgttaccgggtaagggtaaaccgggggacccttattaccccaaccgttactcccgtacgaacgaacgtaaacctaaacttaacccgaaaanaacctactaacgttagtaacttacgtagaaactaaaggtcggaacgtacgaccgtaggagtaccgtacggtaagaacgtacgtacgtcgttaggttacgttaagtttcggtggtacgaacgggttaggtaggtagttacgttacgttacgttaagttagtacgtaagtccgttacgggttacgggtttgggttttaacccgggtacccgtttacccgggacccgggttacgggaaccggtacccgggtaccggttccgtaccgtcccgttcttccggtaccgtacgttccccttaaccggaacccggtacccgtcccttaccgggttacccgttccccctcccgggcgtccccgtcccg

SEQ ID NO: 37437 - DNA, 797 bp, Homo sapiens
  misc_feature: GYAE6OF01E48BJ.53.33.C11.1.454.CMB.1.raw
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
tcagcgcgtatacacacgaccggtgctcgatttagagtgagctcgttgggtttgggctgagctgggttttcctcgttgcttcttttaagaggtgtccagtgtcacgtgcagctggtgcaggtcgtgggggaggcgtggtccagccgtgggacggtccctgaaacctctcctgtgcagcctcgtggtattcgtctacaagttcgttccttaccctttgcctacgtcggggtcccgccagggcctccgagggcgaaggggctgggagtgggtgcctacttanctcatcngataggagngatgcctattacgcagacctcccggtaggaacgggccctattaccaccgtactcctaccaagtaacgtaactaaacttacccgaaagtaaccaactacgttagtactctaagactaaaagtcgggaaccacggtacctaggacgaacggacgtacgggaaacgtaccgtaccgggtaccgttaggttacggtttaacgtttaccggttaggtagggacggttaagggttacgtaagttacgtttacggtttaacctttaacttaagttcggtaacgttcggtaccgttacgggttttacgggtttacccgggtttaccccgggttaccccgggtaaccccgggtaccggggtaccccgggtaaccgggttaaccccgttcggtacccgttaaccccggttcccgttacccgtcccgtacgtacccctacccggtaacccgacccgggtacccccgtacgttcccccggtaccctttccccccggtcggtccccggtccccg

SEQ ID NO: 37438 - DNA, 877 bp, Homo sapiens
  misc_feature: GYAE6OF01CCUHN.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtggggggaggcgtgggtccagcctgggacggtccctgaaactctcctgtgcagcctctggattcgtctacaagttcgtccttaccctttgcctacgtcgggtcccgcgaggcctccgagggcgaagggggctagggtaggtggggtggaccttacttactcttacattcgtaggtaagtagggaaagtacggtagttaccgtaccgtttaaacgttaccggacgtaaacggtaccccggttaccgggttaaggggaaaccgggggtacccttaactttacccgaaaccccttacttacccgtaaccgaaacggtaaacgtaaaccccttaaaaccgtttaaccccgaaaaacggaaaacccctaaccgttaaccgtttaacggttaactttaccgttaacggaaccttaaaaggttacggaaaccgtacgtacccgtaggaaacggacggtacgtaagggaaccgtaccgggtaaccggttcttagggtttaacgttaacgtttaacggttcgggttaacgtacgggtaaggttagggtaacgttacgttttacgtttaacgtttaacgtaagttacggtacgttaccggtacggtttagggttttccgggtttacccgggttacccggttaccggtacccgggtacgggacccggtacggtacccgttcgtacccgtaccgttccaccgtcgtactacccgtcccgaaccggtacgtccgtaccgtcccgtccctacccgcggtcccgtacccg

SEQ ID NO: 37439 - DNA, 839 bp, Homo sapiens
  misc_feature: GYAE6OF01C4BPF.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggacggtccctagaaactctcctgtcgcagcctctggtattcgtctcaagtgtcctacctttgcacgtcgggtccgccgaggcctccgagggcgaacgggggtctgggaggtggggtcggacctaacttcgtcctactacttcgtagaaggtaggaaagagtatcggtacctaacgttaccgacacgaccgtccggtaggaaacggccgtacttccaacctataccgtacgaacgaacgtaaactaacttaccgaaaacgtaactacgtaacctagtaactacgtacgaactaaaggtacgaacacggtacgtagacgacgtacgtaagaacgtaccgacggttcgtaggttacgttattacggtgtacgtacggtaagtagtaacgtatttacgttaaccgttacgttaagttcggtaacgttcgggtaaccgggtttaagggttttcccggggtttaacccgggtttaacccgttaaccccggggtacccggggttaacccggggtaaccccggtaacccgggggttacccccgttcggggttacccccgtacccggttaccccgtaccgtttaaccccgggaccgtttacccccgtaaaccccgggaaacccgggttaaccccggttaccccgttcccggttacccccggttaccccgtttcccccgggtccggtccccggttaccccgg

SEQ ID NO: 37440 - DNA, 650 bp, Homo sapiens
  misc_feature: GYAE6OF01A4DM8.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccgaggcaaggggctggagtgggtgcacttatctcatctgatggaagagatgcctatacgcagactccgtgaacggccgattcaccatctccagagacaattccaaagaacaaactgtaatctagacaaagtcggaacacgccgtagaagagacgtagaaacgaccgacggacttgtacgttaatttacgtggtcgacggtagtgtaagtagttacgttacttactagtagattcgtccgtaggtttgggtttaccggtacccggttacccggtaccccggtcggggacccgtaacggggtacccgtcggtacccgtacccgttccgtcccgtacgtaccgtacccttacccgaacccggtaaccgggccccttaacgttcccgggttaccccttaccccccggtcggtccccggtccccgtacccggg

SEQ ID NO: 37441 - DNA, 696 bp, Homo sapiens
  misc_feature: GYAE6OF01CC4V2.53.33.C11.1.454.CMB.1.raw
  modified_base (116)..(116): a, c, t, g, unknown or other
  misc_feature (116)..(116): n is a, c, g, or t
  modified_base (347)..(347): a, c, t, g, unknown or other
  misc_feature (347)..(347): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtncagtctgggggagcgtggtccagcctgggagtccctgaaactctcctgtcgcagcctctggattcgtctcaagtgtcctaccctttgcacgtgggtccgccaggctccgaggcgaaggggctggagtgggtggctacgttatctcattctgatggaagagatgcctattacgcagactccgaggacggcctatcaccatctccagagactaattaccaaagaacactactntatctagacaaatcggaacagtccgtagacgacgtactaggaaacgaccgtacggtcttcgtagttaacgttacgtggtaggacggtaggtaggtacgtagtttcgttactttaacgttacgtacgtacgttacggacgttaagggtttcgggttttaccggttaccccgggtttcccggtaccccgggttacggggaccccggtaaccgggtacccccgttacggtaccctacccggttccctaccgttcccgacggttaccccgttaccccgaacccgggtaaccgggtcccccgttaacggttccccggttacccccgttccccccgtcgggtccccgtcccccgg

SEQ ID NO: 37442 - DNA, 782 bp, Homo sapiens
  misc_feature: GYAE6OF01EO2X7.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctcgtggtattcgtctcaagttcgtccttaccctttgctacgtcgggtccgccaggcctccgaggcgaaggggctgggaggtgggtcggctacttatctcatctagagtaggaagagatcgccttaagttaccgcgagtaccgttccggtaggaacgggccgtacttaccaacctactcctaccgaagaacgaactaaacttacccgaaaacgaactaaccgtacttagttaactcgtacgtaaacgaaacgtggaaccaacgtccgttaaggacgtacggtacgtaaggaaacgaccgtacgggtcttaggttacgtacgtttacggtgtacggtacggtaagtgtaacgtgtttacgtttacgtttaacgttagtacgtagtcggtacgttaggggtttacgggtttacccgggtaaccccggtttacccgggaccccggggtcgggtaacccggtaaccggggttacccttacgggtacccgtaaccccggtttccgtacccgttacgtacccggttacccgtaccccggtaaccgggtaacccggtaccccgttacggttcccccggtttacccccgtccccgggtcggtccccccgttacccgg

SEQ ID NO: 37443 - DNA, 600 bp, Homo sapiens
  misc_feature: GYAE6OF01BYXB4.53.33.C11.1.454.CMB.1.raw
  modified_base (268)..(268): a, c, t, g, unknown or other
  misc_feature (268)..(268): n is a, c, g, or t
  modified_base (319)..(319): a, c, t, g, unknown or other
  misc_feature (319)..(319): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaanagatgcctattacgcagactccgtgaagggccgattccaccatctccaganacaattccaaagaacacactgtatctgacaaatggacagcctagagagtctaggaacgacgacggctgtagttattacgtgtgcggagtggagagttgtactttactagtgtatcgcgtaggttgggtttcggttacccggttcccgaccccggttcgggggacccgtacggggtaacccctcgggtaccacccggttcctacccgtccgtacgtcccttacccgacccgtaacgggcccctacggttccggttccccttcccccgtggcccggtcccccg

SEQ ID NO: 37444 - DNA, 647 bp, Homo sapiens
  misc_feature: GYAE6OF01CEK1Z.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtctaccctttgcacgtgggtccgccaggcctccgagggcgaagggggctgggaggtggggtggctacttatctcatcgtagagtggaagagtatcgacctattacgcagactccggtaggaacgggcctattccaccatcctaccaagacgaacaacttaccaaagaaccacactagtatctacgacaaagtggaacagcctagagagactaggaacgacacggtctaggtagttattacgtggtacggcgtaaggtgaagtagttagttacttaactagtagtagtcgtacgtaggtttcgggtttaccggtacccggttccggacccggtggggacccgtacgggtacccgtcggtaccgtacccgtcctaccgtcgtacgtccgtacccgaaccggtacggtaccccgtacgttcccggttcccgttcccccggtggtccccgtaccccgg

SEQ ID NO: 37445 - DNA, 850 bp, Homo sapiens
  misc_feature: GYAE6OF01A4AID.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtggggggaggcgtggtccagcctgggaggtccctgaaactctcctgtgcagcctctggattcgtctcaagtgtccttaccctttgcacgtcgggtcccgccgaggcctaccgagggccgaagggggctagggaggtggggtggctacttatctcatcgtagagtgggaaagagatcgaccttagttacgcagaccgtccggtggaacgggcctattccaccatcctcaagacgaactaactaccaaagaacacgtacttagtactcgtacgtaactaaaggtacggaacgtacgtccgtaaggacggtaaggtacgtaaggaaaaccgccggaaccgggttccgttaagggttacgtttaaacgtttaccgttagggtacggacgggtagggttacggaaggttagtttacgtttaccgtttaaacgttaggtacggttaagttaccgggttaccggtttaaggggttttaccggggttttaacccggggtttacccccgggtttacccggggttaccccccggggttacggggggtaacccggttaacccgggggtaaccccgtttccgggttaccccgttacccgggttcccttacccggtaccgtacccggtacccccggttaacccgaaaccccgggtaacccgggtaccccccgttaaccgggtttcccccgggttttccccccgttaccccccgggtccgggtccccccggttacccccggg

SEQ ID NO: 37446 - DNA, 656 bp, Homo sapiens
  misc_feature: GYAE6OF01BYZAY.53.33.C11.1.454.CMB.1.raw
  modified_base (292)..(292): a, c, t, g, unknown or other
  misc_feature (292)..(292): n is a, c, g, or t
  modified_base (555)..(555): a, c, t, g, unknown or other
  misc_feature (555)..(555): n is a, c, g, or t
tcagcgcgtatacacacgaccggtgctcgatttagagtgagctcgttgggtttgggctgagctgggtttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccgccagggcctccgaggcgaaggggctgggagtgggtggcacttatctcatctgaattggaagagatgacctaattacgnagaccgtccgtaggaacgggcctagttccaacctactcctaccgaagacgaactaacttaccaaagaaccactactgtactcgtagaactaaatcggacagccgtagacgagactaggaacgacgacggtctagtagttacttactggtagcgtaagttagattagttctaatagtagtatgccgtaggtttcggttacggttaccgtaccggtaccccggtgggtacccgaacgggtacccgttaggtcccgtaccgttccncccgttacgtaccgtaccccttaccgaaacccggaccgggtacccctacggtttcccgggttaccccctttccccggccgggtccccgtccccgttaccgg

SEQ ID NO: 37447 - DNA, 851 bp, Homo sapiens
  misc_feature: GYAE6OF01DVLQW.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggacggtccctagaaacctcctccgtgtgcacgcctcgaggtacttcgtctacaagtcgtccttaccctttgcacgtcgggtccgccgaggcctaccgaggacgaagggcgtgggacggtgggtcggtctacgttactcctacgatctaggagtaggaagagtagtacgtacctacgttacgactacggaccgtaccggtaggaacggtccgtacttaccaacctactacctaccgaagaacgtaacctaactaaccgaaaacgaaccaactacgtaacgttaatacgtacgaacgtaaacgtacggaacgacgtaccgtagaggacgacgtaagaacgaacgtacggtgttacgttagttactacggtggtaagcgggtaagtaggtagttacgtttattaacgtacgtaagtacggtacgtaccggttacggtttagggtttaccggggtttacccggtaccccggttacccgggtaaccccgggttcggggtaacccccggaaccgggttacccggttaccgggttacccccgttaaacccggtccccgttaccccgtaaccgttaaccccgggttaacccccgttaacccggtaaacccccggggttaccccgggtacccccgttttaaccccgggttccccccgggttttaccccggttacccccccgggttaacccgggtcccccgttaaccccccggg

SEQ ID NO: 37448 - DNA, 815 bp, Homo sapiens
  misc_feature: GYAE6OF01DN2LJ.53.33.C11.1.454.CMB.1.raw
  modified_base (231)..(231): a, c, t, g, unknown or other
  misc_feature (231)..(231): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccctgggacgtccctagaaacctctccgtgtgcagcctcgtggtattcgtctacgaagttcgtccttaccctttgctacgttcgggtccnccaggcctaccgagggcgaaggggtctgggaggtgggtcgctaacgtttatctacgtatcgtagtagtagggaagagtagtcggtaccttaacgttaccgccgaacggtaccgttaccggtaacggtaacggggtacctacgttacccaaccgtactacccgtaccgaagaaccgaaacttaaaccgttaacccgaaaacgtaaacctaactaaccgttacgttaacgtacgtaacgaaaccgtaaaaggtacggaaaccgtacggtaacccgtaggaaccggtaagtaccggtaaacgaaacggtaaccggccgggttaaccgttaggttaacgtttaacgttacgttacggtcggtaacggtagttaggtaacggtacgttacgttaacgtttaacttaggtacgttagtaccgttacgttacgggtttacgggtttccggttaacccggttcccgggtaccggacgggtaccgtaccggtaaccgtcgtaaccgtccgtaccgtccgtacgtaccgtaccgtacccgaaccgtaaccgtcccgtacgttcccggtaccccttcccggtccgcccggtcccg

SEQ ID NO: 37449 - DNA, 651 bp, Homo sapiens
  misc_feature: GYAE6OF01E1QW7.53.33.C11.1.454.CMB.1.raw
  modified_base (268)..(268): a, c, t, g, unknown or other
  misc_feature (268)..(268): n is a, c, g, or t
  modified_base (439)..(439): a, c, t, g, unknown or other
  misc_feature (439)..(439): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggaggtccctgaaactctcctgtgcagcctctggattcgtctcaagtgtcctaccctttgcacgtgggtccgccaggctccgaggcgaaggggctggaggtgggtgctacttagtctcatcngtagtggaagagatgacctattacgcagacctccggaggacgggccgattccaccgatctaccagagacaattaccaagaacacactagtatctagacaaagtggacagcctagaggagacgagaagaccgagtcgttagtcgttattacgtgtgacgagtagacgtattnttacgttactagtgtagtcgtacgttaggtttgggtttacggttaccccgttacccggacccgggttaccggggtaccgtaccggggtaaccccgttgtacccggtccgtaccttcccgtaccgtaccgtaccctttccccggaacccgtaaccgggtccccgtaaccgttcccgggtttcccccttaccccggtcggtccccggtcccccg

SEQ ID NO: 37450 - DNA, 721 bp, Homo sapiens
  misc_feature: GYAE6OF01EKC26.53.33.C11.1.454.CMB.1.raw
  modified_base (563)..(563): a, c, t, g, unknown or other
  misc_feature (563)..(563): n is a, c, g, or t
  modified_base (643)..(643): a, c, t, g, unknown or other
  misc_feature (643)..(643): n is a, c, g, or t
tcagcgcgtatacacacgaccggtgctcgatttagagtgagctcgttgggtttgggctgagctgggtttcctcgttgctcttttaagaggtgtccagtgtcacgtgcagctggtgcaggtcgtgggggagcgtgggtccagccgtgggagtccctgaactcgtcctgtcgcagcctcgtggtattcgtctacgtaagtcgtcctacccgtttgctacgtgggcccgccaggctccgaggcgaaggggcgtggaggtgggtcgacgtacgttatctctatcgtaggtaagtagggaagtacgtagttcggacctttaagttaaccggtaccacggtaaccgttccgggtagggaaccgggtaccggtactttacccgacctacgtccgtaaccgaagtaacgtaactaaacgttacaaacgaacactacgtagtatctagtaacaaggtacggaacacgtacgtagaacggtgacgtagaacgacgtacggtcttagggtacttagttaacgtggtagaacggtgtaagtagtaagtttcgttacttacgtaagtacggtacgngtaaccgttgggtttacgtttaccggtacccgtttacccggaccgggttcgggaccggaacgttaccccgacggttaccncccgttccgtccgtcgtactacccgttccgaaccgccggtaccctacggtcccgttacccctcccgtgcccgttaccg

SEQ ID NO: 37451 - DNA, 900 bp, Homo sapiens
  misc_feature: GYAE6OF01CDYIJ.53.33.C11.1.454.CMB.1.raw
  modified_base (222)..(222): a, c, t, g, unknown or other
  misc_feature (222)..(222): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggacggtccctgaaactctcctgtgcagcctctggattcgtctcaagttgtcctaccctttgctacgtgggtcccnccgaggcctaccgaggcgaaggggctggaggtgggtgactacttatctcatcgtagagtaggaagagtacgtcgtaccttaattaaccacgtacgaccgttccggtagggaaccggggtccgtactttaccgaccctacgttccctacccgaaggaacgtaaacctaaaaccgtttaacccgaaaaacggaaaccctaaccgtaaccgtttaggttaaaccgttccgttaaggaaacccttaaaaggtacgggaaccctaccggtacccgttagggaaggtaaccggaccgttaaagggaaaccggtaccggtaaccgggttcgttaggtttacggtttaacgttttacggttacgggttacgggaacggttaaggtaaggaacggttacgttttaccgtttacctttaacgttaagttacggtacgttaccggtaaccggtttaggggtttttccgggttttaacccggggtttaccccgtttacccccggggttaccccggggtacgggggtaaccccggttaaccggggttaccccgttaccgggttacccgtaccccgttacccgttccccgtaccgttacccgtacccccggttacccgaaccccgggtaccgggttacccccttcggttcccccggtttaccccgtcccccggtccggtccccgttccccgg

SEQ ID NO: 37452 - DNA, 896 bp, Homo sapiens
  misc_feature: GYAE6OF01ANNLC.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgcgcagctggtgcagtcgtgggggaggcgtggtccagcctgggaggtccctgaaactctcctgtgcagcctctggattcgtctcaagtgtcctaccctttgcacgtcgggtcccgccgaggcctccgagggccgaagggggcgttggggacggtggggtcggctacgttatcctcattcgtagagtaggaagagtatcgtaccttaagttaccgacgagtaccgtccggttacggaacgggcccgtacttaccgaccgtacttaccctaccgaagtaaccgaactaaaccttacccaaaacgtaaaacacctaacgtagtaacttacgtagaacctaaaggtacgaacgaacgtccgtaggagtacgtacgaaggaacgacgtacggtcttacggttagttaacgtttaggtacggtaggtacggtaaggtacggttaacgtagttttacggttacccgtttaaagttaggttaacggttacgttaccgggtaacgttttaacggggttttacggggtttttacccgggttaacccccggggttttacccggggtacccccgggttacccggggggtaacccggtaaaccccggggttaaccccgggttccgggtacccccgtttaccccggttacccgtttcccccggttaacccggttcccggtttaaccccctaaccccccgggtaaacccgggttaaaccccggggttcccccgttaaccccgggtttacccccggttccccccggtttttaccccccccgggtggggtccccccccgttaccccggg

SEQ ID NO: 37453 - DNA, 831 bp, Homo sapiens
  misc_feature: GYAE6OF01BWUVO.53.33.C11.1.454.CMB.1.raw
  modified_base (509)..(509): a, c, t, g, unknown or other
  misc_feature (509)..(509): n is a, c, g, or t
tcagcgcgtatacacacgaccggtgctcgatttagagtgagctcgttgggtttgggctgagcgtggtttccgtcgttgctcttttaagaggtgtccagtgtcacgtgcagcgtggtgcaggtcgtgggggaggcgtggtccagccgtgggagtccctgaactctcctgtgcacgccttcgtggtatttccggtctacctaaggttcttaccttacccgtttgccgtacggttccgggtccgccgacggtctccggaggacggaagggtcgtgggtaggtggggtctactagttactctactacttacgtagtaaggtaaggaacgtaagtacgttacgttacgttaacgttaccgtacgacggttaaccggttccggtaaagggaacggtaccgtacttacccaacctacgtttaccacggaacgaacaaaccgttaactacgaaaacgaactaacctacgttactactacgtaacgaagtaacgtcgaaccgtagtacgaagaaggtnaaaccggttagaacggaaccgcgtacgttaagttacgttacgttaggtccggtagtacggtagttaaggtcctttaagttacgttaaccgttagttaaccggttggtaacgttcccggttaacgggtttccgggtttaaccggggttttaccccggtaaccccgggtttacgggacccccgggttacgggtacccggtaacccgggtttaccggccgttaacccggtccgttacccgtaccgtccgtacccgtacccgtaacccggacccgttacccgccgttacccggtccttacccccggcgtccccggtcacccccggg

SEQ ID NO: 37454 - DNA, 661 bp, Homo sapiens
  misc_feature: GYAE6OF01A4MJC.53.33.C11.1.454.CMB.1.raw
tcagcgcgtatacacacgaccggtgctcgatttagagtgagctcgttggggtttgggctgagctgggttttcctcgttgctcttttaagaggtgtccagtgtcacgtgtagctggtgcagtctgggggaggcgtggtccagcctgggaggtccctgaaactctcctgtgcagcctctggattcgtctcaagtgtctaccctttgcacgtcgggtccgccaggcctccgaggcgaaggggctgggaggtgggtggctacttatctcatctgatggaagagatgcctattacgacagactccggtggaacgggccgattccaccatcctaccagacgacaactaccaagaacacactagtatcagacaaagtcggacacgacctaggaggacacgtagaaacgacgacgggtactggttagttattacgtggtaggacgaggtagtagtacgttgttacctttacgtataggtatacggtaccgttaggggtttcgggtttacgggttaccccggttacccggtaccccgggttcggggacccgtaaccgggtacccgttcggtacccgtaccgttcctcccgtacgtaccgttcctacccgaccggacccggtccctaccggttcccggttacccgtcccccgtcggcccgtcccgtcccgg

SEQ ID NO: 37455 - DNA, 765 bp, Homo sapiens
  misc_feature: GYAE6OF01BFN5H.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaactctcctgtgcacgcctctggtattccgtctcgaagttcgtccttaccctttgcctacgtcgggtcccgccgaggctccgaggcgaagggggtctgggaggtggggtacgctacttatctcatctgatagggaagagatcgcctattacgcacgtacgtccggtaggaacgggccgtaacttccaacctactaccgtccaagtacgaactaaacttaccgaaaagaaccactactagtatctacgactaaaggtcgaacacggtaccgtagaacgagacgtaggaacgaccgtacggggtccttaggtttaggttaacttacgggtttgcgggtaacggtaggtgtaacggtatttccggtttaactttaacgttagtacgttacgttcggaaccggtttgggtttaccgggtttttacgggtaacccccggtttacggtacccccggggttacgggaacccggttaaccgggtaccccggtgggttaacccttccccggttacctaccgtccgtaaccgtttcccccgtaacggaccccggtaacggttacccctaccgggttccccgtttcccggtaccccccgttgggccccccttaccccggg

SEQ ID NO: 37456 - DNA, 724 bp, Homo sapiens
  misc_feature: GYAE6OF01CHDXE.53.33.C11.1.454.CMB.1.raw
tcagcgcgtatacacacgaccggtgctcgatttagagtgagctcgttgggtttgggctgagctgggtttcctcgttgctcttttaagaggtgtccagtgtcacgtgcagctggtgcagtcgtggggggaggcgtggtccagcctgggaggtccctgaaactctcctgtgcagcctctggattcgtctcaagtgtctaccttgcacgtggtccgcaggctccaggcaaggggctggagtgggtgcacttatctcatcgtgagtggaagagatgacctaattacgcaagacgtccggtaggaaacgggccgtattccaacccatcctaccgaagaagaacaacttaccaaagaaaccactacctagtatactgaaccaaaagttcgggaactacggaccctaggaagacggctaaggaacggacgtaccggcgttaggttagttaagtttaacgtggttgtaccggtaaggtggtaagtattacggttactttaacttaagtgtagttacgaccgttagggtttacggtttccgggttaacccgttcccggtaaccccggtcgggggaacccggtaaccgggtaaccccggttcgggttacccgaccccgttccgttaccccgtaccgtaccggtaccctttaccccgaacccggtaaacccgggtacccctaaccgggttccccggttaccccgtttccccccgtgggtccccggttacccccgg

SEQ ID NO: 37457 - DNA, 783 bp, Homo sapiens
  misc_feature: GYAE6OF01E0K0W.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctcgtggattcgtctcaagtgtcctaccctttgctacgtcgggtccgccgacggctccgagggcgaagggggcctagggaggtggggtggctactttatcctacactctagaagtagggaaacgagtacgtcgtaccttaagttaccggctaacggtaaccgttcccgggtagggaaaccgggggtccctaacgtttacccaaccctaacttccgtacccgaaaggtaacgtaaaccgtaaactttaacccgaaaaacgtaaacctaaccctaacgttacggttaaaccttaccgtacgaaaccgtaaaaagtccggaaaccgacggtacccgttagggaacgtacgacgtaacgggaaaccgacgtacggtacttaggttacgttaacgtttaccggttaggtcggtaacggtaacggtaggtaacgttagttacggtttaactttaacgtagtcgtaacgtcgtacgttgggtttacgggttaccgttacccggttacccggtacccggtcgggaccgtaacgggtcccgtggtaccgtaccgtctaccgcgtacgccctaccgacccgtacgcccgtacgtcccgttccctcccgtcggccgtcccg

SEQ ID NO: 37458 - DNA, 818 bp, Homo sapiens
  misc_feature: GYAE6OF01CAIGL.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtggggggaggcgtggtccagccgtgggaggtccctgaaactctcctgtgcagcctctggattcgtctcaagtgtcctaccctttgcacgtgggtcccgccaggcctccgaggccgaagggggctgggacggtggggtggctacttatctcatcgtgatggaagagatcgacttaagttacgcagtaccgtcggtacggaacgggccgtacttaccaacctacttccgtaccgaacggaacgtaaacctaaactttaacccgaaaacgtaaacccaaccgtaacgttacggttaacttacgttacgaacgtaaaaaggtacggaaaccgtaacggtcccgtaggtaacggaacgtacgtaaacggaaacggtaaccgaaccgggtcgttaggtttacgttaacgtttaacgttaggtacggtacggtaggttaggtaacgttacgtttacggtttactttaaccgttagttacgtacgttacggtaccggtttagggtttcgggttttacccgggttacccggtttaccccggtaccccgggttccggggaccccggtaaccgggtacccggttaccggtacccgtaccccggttccgttaccccgtccgtaccttaccccgttacccgaacccggtacccgggaccccgtaccggttccccgttcccgtttcccccggtccggtcccgtcccccgg

SEQ ID NO: 37459 - DNA, 779 bp, Homo sapiens
  misc_feature: GYAE6OF01ER66I.53.33.C11.1.454.CMB.1.raw
  modified_base (117)..(117): a, c, t, g, unknown or other
  misc_feature (117)..(117): n is a, c, g, or t
tcagcgcgtatacacacgaccggtgctcgatttagagtgagctcgttgggtttgggctgagctgggttttcctcgttgcttcttttaagaggtgtccagtgtcacgtgcagctggtncagtcgtgggggaggcgtggtccagccgtggggacggtccctagaaactcgtcctgtgcagcctctggattcgtctcaagtgtctacctttgctacgtgggtccgccgaggcctccgaggacgaaggggtctagggacggtggggtcggactacgttactctacgattctagtaagtaggaaagagagttacgaccttaagttacggactagaccgtaccggtaggaaccgggcctagttaccacctactaccaccgtaagaacgtacctaaacgttaccaaacgaacaactacgtagttactacgtagaaactaaagacggtacgaacgtcgtacggagacgtacgtaaggaacgacgtacggtactaggtaattacgttacggttgaggtacgtaaggtagtacgtaacgtttggttaacctttaacgtagtttacgtaacgtcgggttaacgttaggggtttaccggggttttacccggttaaccccgttaccccgggaccccggggtttaccggaaccgggtaacccggttacccggtcggttacccgtaaccccggttcttaacccgtacgaacccttacccggtacccggaacgtaacccgggtacccttaccgggttaccccgttccccgttaccccggtcggtccccgtacccg

SEQ ID NO: 37460 - DNA, 667 bp, Homo sapiens
  misc_feature: GYAE6OF01BUXWH.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtcctaccctttgcactgggtccgccaggctccaggcaaggggctgggagtggggtggctacttatctcatctgataggaagagatgcctattacgcagactcgtagaagggccattcacatctcagagaacaattccaagaacactaactgtatctagacaaagtcggaacagcctagagagctagaacgacgacggcttaggtagtattacgtgtggacgaggtacgagtagttcgttactttaacgttagtacgtatcggtaccgttagggtttacggggttttaccgggttacccggtttaccccgggtaccccgggttcgggggaacccggtaaccggggttaaccccgtcgggtacccgtaccccgttccgttaccccgtccgtaccgtcccgttacccgaacccggtaaaccgggccccttacggttccccgttaccccgttccccccggtcggtccccgtacccccgg

SEQ ID NO: 37461 - DNA, 752 bp, Homo sapiens
  misc_feature: GYAE6OF01DBXL8.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgtggtccagcctgggagtccctgaacctctctgtgcagcctcgtggattcgtctcaagttgttcctaccctttgcacgtcggggtcccgccaggctacccgaggacggaaggggctagggagtcggggtcgactacttatcctcattctaggagtaggaagagtatcgtaccttaacgttaccggctacggccgttaccggtaggaacgggccgtacttccgacctacgtcccgacgtagaacgtaactaacgtaccgaaacgactaacctacttagtacttcgtacgaacgtaaagtcggaacacggtcgtagacggacgtacggtaagaaccggtacgtacggtacgttaggttactttaaccttaggttcggacggtacggttaagtaggtaggttactttcggttaactttacgtagttacgtcgtacggtacggtttagggtttaccgggtttaccggttacccggttaccccgggtacccgtacggggtacccgtaccgggttacccgtccggttaccctccggtacctcccgtaaccgtcccgtaacccttcccgaaccgggtaccgtaccccgttcggttaccccgttcccggtccccgtcggtcccgtcccg

SEQ ID NO: 37462 - DNA, 843 bp, Homo sapiens
  misc_feature: GYAE6OF01BITSE.53.33.C11.1.454.CMB.1.raw
tcagcgcgtatacacacgaccggtgctcgatttagagtgagctcgttgggtttgggctgagctgggttttcctcgttgctctttaagaggtgtccagtgtcacgtgcagctggtgcagtcgtgggggagcgtggtccagccgtgggaggtccctagaactctcctgtgcagtcctcgtggtacttcgtctacgaagttcgttaccttacccgtttgaccgtaccgttcgggtacccgccgtacggtcctaccgagggaccgtaagggggccgttagggaggttcggggtacggtacctaccgtttagtcctacgtacgttcgtaggagtagggaagtagtagtcgtaccttagttaccgacgtacgtaccgttacggtagggaacgggtccttaacttacccgaacctacttaccgtacgaaggtaaccgtaacgtaacttacccgaaaacgtaacaaccttacgtaacgtactacgtacgtaaacgtaagtacgacgagtaccgtaggacgtagtacgaagacgaacggcgtcgttagtagttacgttaggttcggaacgggacgtaaggttacgtacgtacgtttacgtaactttaaccgtgttacgacggttaccggtacggtttagggttttacccgggttacccgttaacccggggttcccggtacccggggtaccggggtaacccgaccggggttaccccgttacggtaccccgttacccgtaccggttcctaccgggttacccttaaccccgttcccggaacccggtaaccccggttaccgttacccggtttcccccgggtaacccctttccccggtcgggccccccgttaccggg

SEQ ID NO: 37463 - DNA, 788 bp, Homo sapiens
  misc_feature: GYAE6OF01DKT9X.53.33.C11.1.454.CMB.1.raw
  modified_base (116)..(116): a, c, t, g, unknown or other
  misc_feature (116)..(116): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtncagtcgtgggggaggcgtggtccagccgtgggaggtccctgaaactctcctgtgcagcctctggattcgtctacaagtcgtcctacccgtttgcacgtgggtcccgccaggctccgaggcgaaggggtctgggagtggggtgcctacttagtctcatcgtagagtaggaagagtattacgaccttaagttaccgacgaacggtaccgttccgtacgggaaacgggtccgtacttaccaccgtactccctacgaaggtaacaaccgtaacttacccaaacgaaccaacgtaccttagtaccttacgtacgaacgtaaacgtacggaaccgaagtacccgtagggaacggaacggtaccgttaaggaaacggtaaccggtacgggtaccgtttagggttacgtttaacgtttaccggttaggttacgggtacggttaagggtacggtaacgttagtttacgtttaaccttaagttaacgttacggtacttcgggtacgttaggtttcgggtttaccggttcccggttacccggtcccggtaccggggtaccgtaccgggtaccgttaccggtccgtacccgtcctaccgtacgtaccgtacccgttcccgaaacccggtccggtaccccgtaccgttacccggttccccgttaccccggtccggcccgtccccg

SEQ ID NO: 37464 - DNA, 785 bp, Homo sapiens
  misc_feature: GYAE6OF01CULQF.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctacaagtcgttcctaccctttgcacgtcgggtcccgccaggcctccagggcgaaggggctgggaggtggggtcgactacttatctcattctgtaagtgggaagagagttcgaccttagtaccgacacgtaccgtccggtagggaacggccgtatttccgacctatcctacagaacgtactaacgttaccaaacgaacacaacttgttaactcgttacgaacgtaaattcggaacacgtaccctaggaaggtacggtacgttaaggaaccgtaccgacggtacttaggttacgtttacttacggtgtcggaccggtaggtaggagtagttacgtttacttacgtagttacggacgtacggtacggttacgggtttcgggttttaaccgggttacccggtttcccggtaccccgggttaccggggtaccggtaacccggggttaacccggttaccgggttacccgtaccccggttcccgttacccgtccggtaaccgttccccgtttaaccccgaaacccgggtaacccgggttcccccgtaaccggtttaccccgggtttcccgttacccccccggttcggccccccggtttacccccgg

SEQ ID NO: 37465 - DNA, 689 bp, Homo sapiens
  misc_feature: GYAE6OF01BONB8.53.33.C11.1.454.CMB.1.raw
  modified_base (324)..(324): a, c, t, g, unknown or other
  misc_feature (324)..(324): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtcctgaaactctcctgtgcagcctctggattcgtctcaagtgtctacctttgcacgtgggtccgccaggcctcgaggcgaagggggctggagtggggtggacacttatctcatctgatggaagagatgcattttacgcagactccgtgaacgggcgagttccacatcctccaganacaactaccaacgaacacactgtactactgaacaagtacggacacgaccgtaggaacgacgacgtaggaacgaaccgacggtacgttaggttagttaacgttagttcggtacggtggtaacggtggaagagtttggtacctttaacttagtgtagtcgtacgttagggtttacgggtttccgggttaaccccggttcccgggtaccccggtcgggggtacccggtaaccgggtaaccgtccgggtacccgtacccggttcccgttacccgtccgtaccggttaccccttaccgtaaccccgggaccggtaccccgtaccggttcccggttacccccgtttccccgtccgggtccccgtcccccgg

SEQ ID NO: 37466 - DNA, 713 bp, Homo sapiens
  misc_feature: GYAE6OF01B5RVM.53.33.C11.1.454.CMB.1.raw
  modified_base (397)..(397): a, c, t, g, unknown or other
  misc_feature (397)..(397): n is a, c, g, or t
tcagcgcgtatacacacgaccggtgctcgatttagagtgagctcgttgggtttgggctgagctgggttttcctcgttgctcttttaagaggtgtccagtgtcacgcgcagctggtgcaggtctgggggaggcgtggtccagccgtgggacggtccctgaaactcctcctgtgcagcctctggtattcgtctcaagtgtcctacctttgcacgtgggtccgccgaggcctaccgaggcgaacggggcgtggaggtgggtcggctacttatctacatcgtggagtaggaagagagttcgtacttaactaccgacaacgtaccgtaccggtaggaacgggtccgtacttccgaccatcctaccgaagacaactaacttaccgaacaacactactagtacnctagacaagtacgacacgacgtagagacgacgtagaacgacgacggtcttaggtacgttacgttacgtgggtagtacggaggttaacggtagtacgtttacgttacgttaactacgtgtaacgtcgtacggttaaggttttcgggtttaccgggttaccggttacccggtacccggtacggggtacccgtaaccgggtacccggttcgggtaccctaccggtacccgttaccgtccgtaccgtcccgttacccgaacccggtaaccggtcccgttacggttacccgttccccgtccccggtacggtcccgtcccgg

SEQ ID NO: 37467 - DNA, 983 bp, Homo sapiens
  misc_feature: GYAE6OF01DPXWM.53.33.C11.1.454.CMB.1.raw
  modified_base (186)..(186): a, c, t, g, unknown or other
  misc_feature (186)..(186): n is a, c, g, or t
tcagcgcgtatacacacgaccggtgctcgatttagagtgagctcgttgggtttgggctgagctgggtttcctcgttgctcttttaagaggtgtccagtgtcacgtgcagctggtgcagtctgggggaggcgtggtccagcctgggagtccctgaaactctcctgtgcagcctctggtattcgtctnaagtgtccttaccctttgcacgtcgggtcccgccaggcctccgagggcgaaggggtctgggtaggtggggtggctacttagtctcatcgtgataggagagactgaccttagtacgacgtacggtaaccgttccgggttaggaaaccggggtcccgtaatttaccgaacccgtacctacctaaccggaacgtaaacgtaaccgtaaaccttaacccgaaaacggtaaacctaacctaaccgttacgttaacgtaccgttaacgaaccgtaaaacgtaccggaaaccgtaccgtaccggtacggaaggacgtaccgtaaggtaaacggtaccgtacgggtacgttacggttaacgtttacggttacgttacgggtcgtaaacgggttaggttacggtaacggtttagttaccggtttaactttaacggttacgtttacggtaaccgggtttacgttaccgggttaccggggtttttaaccggggttttacccggggtttaacccccggggtttaccccgggtaacccccgggggttccggggttaaaccccggggtaaccccggggtttaacccccggttttacccggggtaaccccgttaccccccgggtttaggtacccccccgtttaaaccggacccccgttttaacccgggtaaacccccccgggttaaaaccggggttaaccccccggggtttaaacccccccgtttaccgggggttttacccccccccgtttaccccggggtttttaaccccccccccggcgggggtttccccccgtttaaccccccccgggg

SEQ ID NO: 37468 - DNA, 758 bp, Homo sapiens
  misc_feature: GYAE6OF01BGO09.53.33.C11.1.454.CMB.1.raw
  modified_base (312)..(312): a, c, t, g, unknown or other
  misc_feature (312)..(312): n is a, c, g, or t
tcagcgcgtatacacacgaccggtgctcgatttagagtgagctcgttgggtttgggctgagctgggtttcctcgttgctctttaagaggtgtccagtgtcacgtgcagctggtgcgagtcgtgggggaggcgtaggtccagccgtgggacgtccctagaaacctctccgtgtgcagcctgtggattccgtctacaagtcgtccttacccgtttgcctacgtgggtcccaccgaggtcctaccgaggcggaaggggtctgggaggtcgggtacgactaacgtttctcgtacacgttcgtaggagttaggaagngtacgttaccgaccttagttaccgacgtacgtaccgtaccggtaggaacggccgtaattacccgactacgttaccgaacgaagacgaactaacgttaaccgaaacgacctactacgttactaagtaccgtagaacgtaaagtccggaaagtccgaccggttaagacggtaactacggaacggtaacgtacgtacggtacgttacgttaaggttactttacggtagtaggtacggtagtagtagttacgttagtttacctatagtacgtagtcgtacgttacggttacgggtttacccggtaccggttaccccggtaccgggttaaccgggaccgggtaaccgtacccgttacggtaccgtacccctcgtcccgttacgactacccgtaccgtaacccgtacggtccctacggttccccgtttacccgtcccgtcccgtccgtcccg

SEQ ID NO: 37469 - DNA, 894 bp, Homo sapiens
  misc_feature: GYAE6OF01BZ5DO.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggaggtccctgaaactctcctgtgcagcctctggattcgtctcaagtgtccttaccctttgctacgtgggtcccgccgaggcctccgaggcgaaggggctgggaggtgggtcggctactttatctacatcgtagagtagggaacgagtattcgtaccttaagttaccgactaacggtaccgttccggtaaggtaaccggggtacccgtacttaccaacccgtactaccgtaccgaagaaccgtaacctaaacctttaacccgaaaacgtaaacctaaccgtaacgttacgtaacttacgtacgaaacgtaaaagtacggaaccgtaacggtaccgtaggaaaggtaacggtacgtaaacggtaaacggaaccggtacccgggttactttacgggttacgtttaaacgtttccgggttaaggttacgggacggttaaaggtagggttaacgttaagtttccgtttaacctttaacgtagttacggtactttaccgggtaacggttacggggtttttaccggggtttacccgggttaacccggtttacccccgggtacccgggttaccggggtaaccccggtaaaccggggttaccccgtaccgggttaccccttaccccgggtttccttaccccgtcgtaccccgttaccccgttaaaccccgtaacccgggtaaccccggttcccgtaacccgggtttcccccgggtttccccccttccccggggacccggttcccccgtaccccggg

SEQ ID NO: 37470 - DNA, 863 bp, Homo sapiens
  misc_feature: GYAE6OF01ADD7T.53.33.C11.1.454.CMB.1.raw
  modified_base (603)..(603): a, c, t, g, unknown or other
  misc_feature (603)..(603): n is a, c, g, or t
tcagcgcgtatacacacgaccggtgctcgatttagagtgagctcgttgggtttgggctgagctgggttttcctcgttgcttcttttaagaggtgtccagtgtcacgtgcagctggtgcaggtcgtgggggacgcgtggtacccaggtccgtgggacgtccctagaaacctctcctggtcgacacgccttcgtggtacttcgtactataacggttcgttccttacctttgaccgtacggttcgggtccgaccacggtcctacgagggtaccggaaggggtcgtgggtagggtcgggtacggtacctaacgtttactcgtactcgttacgtaggagttaaggggaaccgtaaggtactaccggtaccttaaaggttaccgacgtaacggtaacccggttccgggaacgggtaacgggtacctacttacccgaccacgtcctacgaagtaacgtaactactaaccgaagtaacccactacgttagtactacgacgaacgtaagcggtaacacggaccgtagtaacgacggtacgtaacggaaccgtacgtaccgggttactacgggttaattacggttaccggtaggtaccgtagtacggggtaanacgttacggttacgttaccttagtaacggtcgaagttaccgttacgggtttaggtttacccgggttcccggttacccggggttaacccccgggtaccgggttaccgggtaaccggttaaccgggtaccccgttaggtcccccgtttacgacccctaccgtttaccgtaccgttaccccgaacccgggaaaccggttaccccggaccccgtttacgttaccccgggttaccccctccggttcccccggacgttcccccggg

SEQ ID NO: 37471 - DNA, 839 bp, Homo sapiens
  misc_feature: GYAE6OF01B7REI.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggacggtccctgaaactctcctgtgcacgcctctggattcgtctcaagtcgtccttaccctttgcacgtcggtcccgccgagggcctccgaagggccgaaagggggtcgtgggtaggtggggtcggcctaacgtttactccgtcgattcgtagtaagtagggaacgagtaactcgtaccttagttaaccggacctaacggtaccgttcccggtagggaaaccgggtcccgtaatttacccgaacccgtacgtccctaccgaagtaacgtaaaccgtaactttaccccgaaaaacgtaacctaaccctaacgtttacgtactacgttaacgaaccgtaaaacgttcggaaacctacggtacccgtagtaacggagacggttaacgaaacggtacggtaccggtaccgttaggtttaacgtttaacgtttaacggttacggtacggtacgggttaaaggtagggttaacgttacgtttacgtttaaccgtttaagttagttacgtaagttccggtacgtttagggtttaccgggttttaccggttacccggttacccggtaccccgggtccgggtaacccggtaccggtacccgttccggtacccgtaccgtcccgtacccgtccgtaccgtcccgtaccgaacccgtacccggacccgtacgttcccgtacccgtccccgtcggcccgtccccgg

SEQ ID NO: 37472 - DNA, 651 bp, Homo sapiens
  misc_feature: GYAE6OF01AWAHP.53.33.C11.1.454.CMB.1.raw
  modified_base (312)..(312): a, c, t, g, unknown or other
  misc_feature (312)..(312): n is a, c, g, or t
tcagcgcgtatacacacgaccggtgctcgatttagagtgagctcggttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcgagtgtctaccctttgcacgtgggtccgccaggctccaggcgaagggggctggaggtgggtggctacgttatctcatctgatggaagagatgctatacgcagactcggtgaggccgtatcaccnctctccagagactaactaccaaagacactactagtactcgtagactaaagtggaaccaggtcctagacgagcgtagaacgacgacggacgttgtagttaacgtttacgtcggtaggacgtaaggtggaagtagttctacgtttactagtacgagttcgcgttagggttcgggttttacgggtacccgttcccggtaccccggttagggggaccccggtaaccggggtaacccgttcgggccgtaccccgttcctcccgtaccgtaccgtcccgttaccccgaccggaaccgggtcccctacggttccccgttaccccttcccccggtggcccgtccccg

SEQ ID NO: 37473 - DNA, 702 bp, Homo sapiens
  misc_feature: GYAE6OF01C18EW.53.33.C11.1.454.CMB.1.raw
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggacggtccctgaaactctcctgtgcagcctctggtacttcgtctcgaagttcgtccttaccctttgccgtacgtcggggtcccgccgacgggctcccgagggcgaagggggtcgtgggaggtggggtcggcctaacttatccgtactactcgttagagttaggaagagtactcgaccttagtacgcacgacgtccggtaggaacgcgtacttaccacactctacgagtanactatacaacgaacanactgtactacgtagacgtaagtcgaacgcgtcgtagaaggccgatacggaacgtacgtaacggtcgtagttacgtttaatacgttaggtcgagtaagtaggtaacgtagttacgtatttaacgtagttgtacgtgtaccggttaggtttaccggggtttcccggttaccggttacccggacccggtacggggtacccggtaccgggtacccggttccggtaccctaccgtccgtcccgtacgtccttaccggtacccgtaccgaaccggtccctaccggtcccgtccccttcccggcgtccccgtcccg

SEQ ID NO: 37474 - DNA, 868 bp, Homo sapiens
  misc_feature: GYAE6OF01EO2BK.53.33.C11.1.454.CMB.1.raw
tcagcgcgtatacacacgaccggtgctcgatttagagtgagctcgttgggtttgggctgagcttggttttcctcgttgcttcttttaagaggtgtccagtgtcacgtgcagctggtgcagtcgtgggggaggcgtggtccagcctgggaggtccctgaaactctcctgtgcacgcctctggacttcgtctcaagtgtccttaccctttgcctacgtcgggtcccgccaggcctccgaggcgaaggggtctggaggtgggtgctactttatcctcatctgataggaaagagtatcgtaccttaagttaccgacgtacggtaccgttccggtaagggaaccgggtcccgtaactttcccgaaccctaacttcccgtaaccgaagaacgtaaacctaaacttacccgaaaacgaaacctaacctacttagttaacctacgtacgaaacgtaaagtcggaaccacggtaccgtaggacgtacgtacgtaacggaacgacccgacggttcttaggttacgttaacgtttaccgtggttacggtacggaaggttacgtaacggttacgtttaccggtttactttaaacgttacggttaggtaacccgttcgggttaacccggtttacggggttttacccggggttttaaccccgggtacccccgggtttacccgggacccccggggttaacgggggaccccggtaaaccccgggtttcccggtaccggtaccccgttaccccggttcccgtttacccgtaccggtaacccgttccccgttaaccccggaaaccccgggtaccccgggtccccgtttaacccggttccccgggtttcccccccttcccccgggtcgggtccccccgtacccccgg

SEQ ID NO: 37475 - DNA, 766 bp, Homo sapiens
  misc_feature: GYAE6OF01D399Q.53.33.C11.1.454.CMB.1.raw
  modified_base (116)..(116): a, c, t, g, unknown or other
  misc_feature (116)..(116): n is a, c, g, or t
  modified_base (226)..(226): a, c, t, g, unknown or other
  misc_feature (226)..(226): n is a, c, g, or t
  modified_base (591)..(591): a, c, t, g, unknown or other
  misc_feature (591)..(591): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtncagtcgtgggggagcgtggtccagccgtgggacgtccctgaactctcctgtgcagcctcgtggtacttcgtctacaagtcgttccttacccttgccacgttcgggtcccnccgaggtcctaccgagggcgtaaggggtcttgggaggttcggggtcgaccttacgtttatccgtcattcttaggagttagggaagacgtattcgtaccttaacttaccggacgaacggtaccgttccggtaagggaacgggtccctaatttacccgactacgtcctaccgaagtaacgtaactaacttaccgaaacgaacctaccgtagttcaagttcctaaggacctaaaaggtcggaacgacgtacccgtagggaaacgacgttaacgacggtaaaaccgtaccggtacggtcgttaggttaacgtttacgttaacgttcggtaggacgttaggtcgtaagttagttagttacctagtagtanaccgttgacgttagggttacggtttaccggtacccggtccgtacccgggtagggacccgtacgggtaccttcggtaacccgtccgttaccgtccgtaccgtacttcccgtaacccgaccggtaccgtccccgtaccgtttacccggttccccgttaccccgtcggcccgtacccg

SEQ ID NO: 37476 - DNA, 841 bp, Homo sapiens
  misc_feature: GYAE6OF01CJDO3.53.33.C11.1.454.CMB.1.raw
  modified_base (125)..(125): a, c, t, g, unknown or other
  misc_feature (125)..(125): n is a, c, g, or t
  modified_base (526)..(526): a, c, t, g, unknown or other
  misc_feature (526)..(526): n is a, c, g, or t
tcagcgcgtatacacacgaccggtgctcgatttagagtgagctcgttgggtttgggctgagctgggttttcctcgttgcttcttttaagaggtgtccagtgtcacgtgcagctggtgcaggtcgngggggaggcgtggtccagccgtgggacgtccctagaactctctgtgcagtcctcgtggacttcgtctcgaagttcgtccttacccgtttgccgacgtcgggcccgaccgacggcgtaccgagggacggtaaggggtccgtaggggtaggttggggtacggtactacctttagtccttactacgttcgtaggaagtacggaaagtagtagtcggtacctttaagtaccgacgtaacgtaccgtaccggtagggtaaccgggccgttaacttaccgaacctactaccgtaccgaaggtactaactaactaccgaaaacgtacacgtactggtaactacgtacgaactaagtacgaacctcggtacgtaagacggcgtaacgtaacggaacgtacgaccggttnttaggtaatttacgtggtagtcgtaacggtgttagagttacttacgttactaaggtagttcgaaggttcgtaaccgggtttagggtttcgggtttaacccccggtacccggttaccccgggtaaccggggttcccggaaacccggttaccgggttaacccccgttccgggtacccgttaccccgttacccgttacccgcccgttacggttacccccgtaacccccgggaacgggttaaccccggtccccgttttacccgggtcccccccgtttaccccggttacccccggtccggggttccccccttaccccggg

SEQ ID NO: 37477 - DNA, 870 bp, Homo sapiens
  misc_feature: GYAE6OF01BQE2F.53.33.C11.1.454.CMB.1.raw
  modified_base (113)..(113): a, c, t, g, unknown or other
  misc_feature (113)..(113): n is a, c, g, or t
tcagcgcgtatacacacgaccggtgctcgatttagagtgagctcgttgggtttgggctgagctggtttcctcgttgctctttaagaggtgtccagtgtcacgtgcagctggtncagtcgtgggggagcgtggtccagcctgggacgtccctagaaacctctctgtgccagtcctgtggtattcgtctacaagtcgtccttaccttgcctacgtcgggtcccgccgaggtctccggaggcgaagggggtcttaggggagttcggggtcgactacgtttactccgtagtacttcgtaggtaacgttaggggtaaaagacgtaacgttccggtaacccttttaaacgtttaaccggaccgtaacggttaaccccggttaccgggttaaggggaaaccgggggttaccccgttaaatttccccgaaacccggttactttccgtaacccgtaaacgggaaacggttaaaaccccttaaacgtttaaccccggaaaaacgtaaacctaacccgtagtttaacggttacctaaccggtacggaaacctaaaaggtcgggaacctacggtacccgtaagggaacgtacggtacgtaaagggaaccgtacggaccgttgttggttacgtttaactcggttagcggtacgtaggtcgtaggtctttcgtaacgtgacggtcttacgtcggtacggtttcggttaccggttaccgtaccccgggtacccggacgggtaccgggaccgttaccgggtacgtttcccgacccgtttcccgtaccgttccggtaaccgtcccttaacccggtccggaaaccccggttcctaacccggttcccggttccccttacccccgttcgggtccccgtcccggtacccgg

SEQ ID NO: 37478 - DNA, 715 bp, Homo sapiens
  misc_feature: GYAE6OF01BUM0O.53.33.C11.1.454.CMB.1.raw
  modified_base (304)..(304): a, c, t, g, unknown or other
  misc_feature (304)..(304): n is a, c, g, or t
  modified_base (408)..(408): a, c, t, g, unknown or other
  misc_feature (408)..(408): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagttgttccttaccctttgctacgtgggtcccgccgacggcctaccgaggcgaaggggctgggaggttcggggtggctacgtttactcctacacttctggattagggaaagagtntcgacctagttacgcacggacgttccggtaggaacgggcctacttccgacctatcctacaacgacgactaaacttaccaaagaacacgactatatacgtacganaaacgtggaccagacgtagacgagctaggaacgacgacgtgttcgtagttacttacgtcggtggcgtaagtaggattagttcgttactttacgtagtagtacgtccgtacggttgggtttcgggtttaccggttacccggttacccggacccggttccgggaaccggtaccgggttacccgtcggtacccgtcccgttacgtccccgtagtcccgtacccgttaccccggaacccggtaccccgtcccgtaacccgggtttcccccgttacccccggttacccccggtcccggtcccggtcccccgg

SEQ ID NO: 37479 - DNA, 739 bp, Homo sapiens
  misc_feature: GYAE6OF01CFESI.53.33.C11.1.454.CMB.1.raw
  modified_base (268)..(268): a, c, t, g, unknown or other
  misc_feature (268)..(268): n is a, c, g, or t
tcagcgcgtatacacacgaccggtgctcgatttagagtgagctcgttgggtttgggctgagctgggtttcctcgttgctcttttaagaggtgtccagtgtcacgtgcagctggtgcagtcgtgggggaggcgtggtccaggccgtgggaggtccctgaaactctcctgtgcagcctctggattcgtctacaagtcgtcctacccgtttgcacgtcgggcccgaccaggcctccgagggctaagggggctgggagtgggtgctacttanctacatctgatggaagagagtcgacctagttaacgcacgacgttccggaggaacggggcccatttaccaccaatcctacccgaaggacgaacctaaattaccccaaagaaccaacaacgtgtaaactcgtgaacaaaatggaacacgacgtcggaaggaccgtagaacgaacgacggacgttagtacgtttagttaacttcggtaggcggtaaggtagtaggtacgttagttacggtttacttacgttagtaacgtgtaccgttaacggtttcggggtttaacgggtttacccgggttacccggttaccccgggtaccggggttacccggaaccgggtacccggtacggttcccggtaacccgtacccgttcccaccgttacggtacccttaccccggttacccggaaaccggccccgttaacgttcccgggttacccttcccccgtcccgggttccgccccgttacccgg

SEQ ID NO: 37480 - DNA, 784 bp, Homo sapiens
  misc_feature: GYAE6OF01E18WV.53.33.C11.1.454.CMB.1.raw
  modified_base (237)..(237): a, c, t, g, unknown or other
  misc_feature (237)..(237): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (384)..(384): a, c, t, g, unknown or other
  misc_feature (384)..(384): n is a, c, g, or t
tcagcgcgtatacacacgaccggtgctcgatttagagtgagctcgttgggtttgggctgagcgtggtttcgtcgtaggcgtctttaagaggtgtccagtgtcacgtgcagctggtgcagtcgtgggggaggcgtggtccagccgtggggaggtccctgaaacctctccgtgtgccgacgtcctcgttaggctttcgtctcaagtcgttccttaccctttgccgacgttcggggcccnccaagggcctccgaagggccgtaaggggtcctgggaggtgggtacgcctactttntcctanactcgngagtaggaaggatagcgtacctacgttacgcgacgtacgtcccggtaggtacggacacttacacgactcgtcgaacgaanacctaactaccgaaacgactaaccagttccgtaatcgacggtaaataacggtacgacgacgtcgtaggacgacgtatacgaaaacggtccgtacggcgtagttacgttaacgttacgtagtacgtacgtacggtagaccggttattaccgtttaaccgttagttacgtacggtacgttacggtaccggttacgggtttacggttaacccgggtttaccccggttacccgggtaaaccccggttccggggaaccgggtaaccggggttaccccgtccgggtacccgttaccccggtacccgtaccttaccgtacccggttaccctaacccgtaaccccggtaccgggaacccgttcggttaaccccgttccccgtaccccggtccggcccggttaccccgg

SEQ ID NO: 37481 - DNA, 963 bp, Homo sapiens
  misc_feature: GYAE6OF01B9O4U.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgcgcagctggtgcagtcgtgggggaggcgtggtccagccgtgggaggtccctgaaactctcctgtgcagcctcgtgtattcgtctcaagtcgttcctaccctttgcacgtcgggtccgccaggtcctaccgaggccgaacgggggcgtgggacggtgggggtggtacctaacgtttactcctcgtatccgtagtagtaaggaacgaagtacgtctaccgttaacgttaccgacgtaccgtaaccgtcggtaacggacgggaccgtaattacccacctactccgtaccgaagacgtaactaactaccgaaaacgaacctaacgtacgtacgttactacgtacgaaacgtaaacggtacggaacgacggtacccgaggtaaacgacggtaacgtaacgggtaaaacgggaccggtaacccgggttacggtttaacggttacgtttaacggtttaaccggtacgggttacggaacgggtaagggtacgggttaaacggtttacggtttaaccgttttaccgtttaacgtttaacggtaacggggttaaccttaccgggttacggtttacgggtttttaaccggggtttaccccggggtttaaccccgggtttaccccggggtaaccccggggttaacccgggggtaaaccccgggttaccccggggttaacccgggttaccccgggtacccccgtttaccccgttaaccccggttcccgtaccccggttaacccgtttacccccggttaaaccccggtaaaccccccggggtaaaccggggtaccccccggtttacccggtttcccccggttaacccccccggtttcccccgggtacccgggttccccccggttacccccgg

SEQ ID NO: 37482 - DNA, 693 bp, Homo sapiens
  misc_feature: GYAE6OF01B10HX.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtcctgaaactctcctgtgcagcctctggattcgtctcaagtgtctaccctttgcactgggtccgccaggctcgaggcaaggggctggagtgggtgcacgttatctcattctgataggaagagatgcctagttacgcagaccgtcgtggaacggccgtattacaccatcctccgagacgacaacttaccaaagaacacacgttagtactctgactaaagtcggacacgtctagacgagtctaggaacgacgacggacgttagtacgttaacgttacgtggtagcggtaaggtcgaagtacgtttcggttaacctttagtactggtactcggtcggttaacgggtttaggggttttaccggttaaccccggttcccgggtaaccccggtacgggggccgtaaccggggtaaccccgttccgggtaccctacccggttccgtcccgtaccgtacggttaccccttacccggaaacccggtacccgggtacccgttacccgttccccgggtttacccccgttaccccggttcgggccccgtacccccg

SEQ ID NO: 37483 - DNA, 837 bp, Homo sapiens
  misc_feature: GYAE6OF01CVMVX.53.33.C11.1.454.CMB.1.raw
tcagcgcgtatacacacgaccggtgctcgatttagagtgagctcgttgggtttgggctgagctgggttttcctcgttgctcttttaagaggtgtcagtgtcacgtgcagctggtgcagtcggtgggggaggcgtggtccagccgtgggacgtccctagaaactctcctgtgcacgtcctgtggtacttcgtctacgaacgttcgttccttaccgtttcgactacggtcggggtcccgacgcggtaccgtcggaacggacgggaacgggggtcgttaggggacgggttggggtcggtacttacttatcctactagttacgtagtaagtagggaaagtacgattccggtacttaacggttaccgacgtacgtaccggtaccgtacgggaacgggtcctacttccgaacctacgtcctacgaacgtaacgaacctaactaaccgaaacgaacaactacgtactagtaccgaagaacgtaacgtacggactacggtacgtagacggacgtaacggtacgacggtacgggtacggttaccgtaagggttttcgttaacgttacggggttacggtggttaaacggttaagggtagaacgttttcgttaagtttaccttagtacgtaggttacttcgggtacgttttacgggtttcgggtttaccccggtaccgttaccccgggaccgggaaccggttaccgggaaccggttcccgtaccggttacccgtccccggttacttccggaacccgttaccaccccgggttaaccgtaacccgggtaccgtccccgtttaaccggttccccggttcccctttcccccggggagttccccggtaacccg

SEQ ID NO: 37484 - DNA, 701 bp, Homo sapiens
  misc_feature: GYAE6OF01EGU4L.53.33.C11.1.454.CMB.1.raw
  modified_base (261)..(261): a, c, t, g, unknown or other
  misc_feature (261)..(261): n is a, c, g, or t
tcagcgcgtatacacacgaccggtgctcgatttagagtgagctcgttgggtttggctgagctgggttttcctcgttgctctttaagaggtgtccagtgtcacgtgcagctggtgcagtctggggagcgtggtccagcctgggagtccctagaactctctgtgcagcctcgtggtattcgtctcagtgtcttacccttgctacgtcgggtcccgcgaggcctccgaggccgaagggctgggagtgggtgctacgttatcctntatcgtagagtaggaagagtatcgtacctaattacgacgtacgaccgttccgaggaacgggcctacgtttccaaccgtactccgtaccgaaggtacgaactaaacgttaccaaacgaacctactacgttagtactctagaactaagtcggaactacgtcgtagacgagtacgtagaacgaccgtacggtcgttagttacggttatttacgtgtacgacgtaggtacgtagtagttacgttacttaagtgttagtacgttcgtacgttaggtttcggtttaccgggtacccgtttacccggtacccggtcgggtaacccgtacggtacccgtcggtccctaccccggttcgtacccgtacgttacctacccggttacccaacccgggtacgtacccctcgggttaccccgtcccgttaccccggttcgcccggttaccccg

SEQ ID NO: 37485 - DNA, 789 bp, Homo sapiens
  misc_feature: GYAE6OF01C48HJ.53.33.C11.1.454.CMB.1.raw
tcagcgcgtatacacacgaccggtgctcgatttagagtgagctcgttgggtttgggctgagcttgggttttcctcgttgctcttttaagaggtgtccagtgtcacgtgcagctggtgcagtcgtgggggaggcgtggtccagcctgggagtccctgaaactctcctgtgcagcctctggtattcgtctcaagttcgttcctaccctttgctacgtcgggtcccgccgacggcctccgaaggcgaaacgggggtcgtgggaggttggggtcggcctaactttactcctacgtattcgtgagtaggaagtagtatcgaccttattaccgacacgacctcggtaggaacggtccgtacttaccgacctactcctacgaacgaacgtaactaaactaccaaacgaacctactaacgtgtaactcgtagaactaaagtcggaacacgtcctaggacgacggtactaagaacggtcgtacggtcgttagttaagttactacggtgtagacgtaggtacgtagttacttcgttaaccttaagttagtcggaacttcggtaccggttaggtttcgggggtttacccgttaccccgggttacccggaaccggggttccgggaacccgttacggggttaaaccccgttcgggttacccccgtaacccggtttccttaaccccggtcgttacccgggttacccccttaaccccggtaaccccgggtaacccgggttaccccttacccggttttcccccgggttcccccgttacccccggccgggtcccccgtttccccgg

SEQ ID NO: 37486 - DNA, 751 bp, Homo sapiens
  misc_feature: GYAE6OF01D8AV3.53.33.C11.1.454.CMB.1.raw
  modified_base (267)..(267): a, c, t, g, unknown or other
  misc_feature (267)..(267): n is a, c, g, or t
  modified_base (735)..(735): a, c, t, g, unknown or other
  misc_feature (735)..(735): n is a, c, g, or t
tcagcgcgtatacacacgaccggtgctcgatttagagtgagctcgttgggtttgggcgtgagctgggttttcctcgttgtctctttaagaggtgtccagtgtcacgtgcagctggtgcagtctggggagcgtggtccagcctgggagtcctgaactctctgtgcagcctctggactcgtctcaagtgtctaccttgcacgtcggtccgccaggcctccaggccgaagggctgggagtgggtgctacttatctcatctgactggaagngatcgcctattacgcacgactccgtagaacggccgtattacacctatcgtccagtacgactaacttaccaaacgaaccgactacgtagtaactcgtacgacaaagttcggacacggcctaggacgtacgtacgtagaaagtaccgacggtacgttagttacgttaacgtttaacgtggtcgtaccgggtaaaggttaggtaaccgttaggtttacgttccgtttttaaaccgttaggttacgttaacggtaccggtacccgttaagggggttttaccggttttaccggggtttaaccccgggtttacccgggtaaccccggtttccggggggaacccgggtaacccggggttaacccccgttacgggtaccctaacccggttccgtaccccgtaacgtaccggtacccgtttaccccgacccgggtaaccggcccccgttaaggtcccggttaccccgtttccccggnggtacccccgtcccgg

SEQ ID NO: 37487 - DNA, 739 bp, Homo sapiens
  misc_feature: GYAE6OF01BWYE7.53.33.C11.1.454.CMB.1.raw
  modified_base (224)..(224): a, c, t, g, unknown or other
  misc_feature (224)..(224): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtggggggaggcgtggtccaggcctgggaggtccctgaaactctcctgtgcagcctctggtattcgtctcaagtcgtccttaccctttgctacgtcgggtccnccgaggcctccgaggcgaaggggctgggaggtgggtggctacgttatctcattctgagtggaagagactcggacctagttaccgcacgtacgtccggtaggaacgggccgtattaccacctactcctccgaagacgtaactaaacttaccaaagaacacacttagtactctagacaaagtcggacgtaacgcgtagaacgagtacgtagaacgacggacggtcttaggttagtaacttacggtggtaggcggtaagtaggagttaagttcgttaactttaacctaggttacgtacgtacgggtccgttaggggttttacggtttaccgggtacccggtttacccgggtccccgggttacggggaccccggtaacgggtacccccggttaggtaccccgttacggtccccttacccggtcccgtacggttaccccgttacccgaaccggtaaacccgggtcccttaacggtccccggtttacccccgttccccggtccgggtccccgtaccccggg

SEQ ID NO: 37488 - DNA, 735 bp, Homo sapiens
  misc_feature: GYAE6OF01BLSDD.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtgggtccagccgtgggaggtccctgaaactctcctgtgcagcctcgtggattcgtctcaagtcgtctaccctttgcacgtcgggtccgccacggctccgaggcgaaggggctgggaggtgggtcggctacttatctcatctgagtaggaagagatcgactattacgcagacgtccggaggaacggacctataccgacactacacaagaacaactaactaccaaacgaacactacgtagtaactactacgaacgaagtacggaacgacgaccgtaggacggaacgtacgtaaggaaacggtaaccggaccggtagttacggtaagttaacgttacgttaggtacgggacggtagggtaacggtagtacgttacgttactttaacgtaagtacggtagtaccggtacggttagggtttacgggtttacccggttaacccgggttcccgggtaacccgggttacgggacccggtaaccggggttaccccggtacggtacccgtacccgttcccgtacccgtccgtaccggttacccgtacccgaacccgggtaacccgacccgttacggttccccgtaccctttccccgcgggtcccctacccgg

SEQ ID NO: 37489 - DNA, 759 bp, Homo sapiens
  misc_feature: GYAE6OF01A4E7D.53.33.C11.1.454.CMB.1.raw
  modified_base (116)..(116): a, c, t, g, unknown or other
  misc_feature (116)..(116): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtncagtcgtgggggaggcgtggtccagccgtgggacgtccctgaaactctcctgtgcagtcctctggtacttcgtctacaagttcgtccttaccgttgctacgtgggtcccgcgacggcctccgaggcgaaggggctgggaggtcgggtgtcctaacttatcctacgtacttcgtggtacgtagggaagtagtacgtcgtactagttacgacgtacgaccgttcggaggaacggtccgtacttaccgacctacgttaccgtcgaacgaacgtaaactaacttaaccgaaaacgaaccactacgtaattacgtacgtaagaactaagtacggactacggcgtagaacgtcgagtaacggaacctacggaccgttgttaacgttacggtaaactttggtgtacggacggtagtagagttacgttgttaaccttagtagtgtaaccgtcgggtttcgggtaacgttttccgggtttaacccggaccccggttcccggtaacccggggtacgggtacccgaaccgggttccctaccggttacccgtacccgttccttaaaccggcgttacccttacccggtacccgaacccggtacccgttaccctaccggttccccgtttccccggacccggttcgccccgttacccg

SEQ ID NO: 37490 - DNA, 757 bp, Homo sapiens
  misc_feature: GYAE6OF01CS303.53.33.C11.1.454.CMB.1.raw
  modified_base (295)..(295): a, c, t, g, unknown or other
  misc_feature (295)..(295): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtggggggaggcgtggtccagccgtgggacggtccctgaaactctcctgtgcacgcctcgtggtattccgtctctaagtcgttcctaccctttgcctaccgtcgggtcccgccaggcctccgaggcgaaggggctgggaggtgggtcgctacttctctcgatctagagtggaanagtagtcgtacttacgttacgacgacgtaccgtccggtaggaaccggcgtacttaccaccatccgtcgaacgaacgaacctaaactaccgaaagtaaacctaactacgtcgtaccttacgtaacgtaactaaaagtcggaaccgaccgtaccgtaggaacgtacgaccgtaagaacgaccggtaacgtcgttgttacgttagttacgtgtaggtacggtagtaggtagtagttacgttacttacgtatacgtacgtacggtacgttacggtttacgggtttacccggttaccccgggttcccgggttacccgggtacgggtacccggtacccggtaccggtacccggtccgtaccccgttcgtacccgttccgtacgtaccccgttcccgaacccggtaacccggtcccgttacccggttccccggttacccccggttcccggtcccggtccccgtccccgg

SEQ ID NO: 37491 - DNA, 765 bp, Homo sapiens
  misc_feature: GYAE6OF01A9WE7.53.33.C11.1.454.CMB.1.raw
tcagcgcgtatacacacgaccggtgctcgatttagagtgagctcgttgggtttgggctgagctggttttcctcgttgctcttttaagaggtgtcctagtgtcacgtgcagctggtgcagtcgtggggagcgtggtccagccgtgggaggtccctgaactcctctgtcgcacgtcctcgtggactttcggtcctacgaagttcgtaccttacccgtttgcctacgtcgggtacccgccgagggcctaccgagggtccgtaacggggctagggaggtcgggtaggctaacgtttactctcatcgtgagtaggaacgagtacttcggaccttacgttacggcgtacgtaccgtcggtacggtaacgggtcctacgttaccgaccgtatccgtaccgaaggacgtaacgtaacttaacgaaacgtaaccgaaccgtacgttacgtacgtactacgaacgtaacgttcggacgtacgtcgtagagacggtacgtacggaacgtaccgacggtcgttaggttagtttacgttacgttggtacggtacggtaaggtcggtaagttactttacggtaccttttaacggtagttgtacgtaccggttcggttaacgggttttccggtttaccgggttacccgttcccggtacccggtacgggtacccgtacggtacccgtcggtccgaccgttcctacccgtcgtaccgtccgttcccgaaccgtaccggtacccctacgttccccggttaccctcccgtcggccccgttcccg

SEQ ID NO: 37492 - DNA, 845 bp, Homo sapiens
  misc_feature: GYAE6OF01B5M5M.53.33.C11.1.454.CMB.1.raw
  modified_base (296)..(296): a, c, t, g, unknown or other
  misc_feature (296)..(296): n is a, c, g, or t
tcagcgcgtatacacacgaccggtgctcgatttagagtgagctcgttgggtttgggctgagctgggtttcctcgttgctctttaagaggtgtccagtgtcacgtgcagctggtgcagtcgtggggaggcgtggtccagcctgggacggtccctgaaactctcctgtcgcacgtcctcgtggtactttcgtcctcgtaagttcgttccttacccgtttgccgtacgttcggggtcccgaccgaggccgtaccgacgggacggaaagggggcgtgggagggtgggtcggcttacgttntcgtcattcgtaggagtaggaagagtatcgacttaacgtacgacgacgtaccgtccggtaggaaccgggtacctacgtttaccaccctacgttaccgtcaaggtaaccgtaaacttaaaacttacccgaaaacggtaaacccacgttaaccgtcgtaaagttaccgttacgaaaccgttaaggaccggtaaacaccggaccgttaggaaacgggtaacgtaacggtaaaggtaacccggaaggttaacccgggtagtttagggttaacgttttaactaacgttacgggtaggtaaccggtaggtagaaccgtttaagtttctttaataacgttgtaagtacgttcggtaacggttggtttaccgggtttacccggtaaccgggtttacccggtacccggggttacgggacccggttacccgggtaaccgttccgtaccggttcccgttaaccgtccgttaccgacccgtttacccgaaacccgtacccggttaaacggccccttacggttccccgttacccgtttccccggaccgtccccgtacccggg

SEQ ID NO: 37493 - DNA, 818 bp, Homo sapiens
  misc_feature: GYAE6OF01E5P7L.53.33.C11.1.454.CMB.1.raw
  modified_base (116)..(116): a, c, t, g, unknown or other
  misc_feature (116)..(116): n is a, c, g, or t
  modified_base (223)..(223): a, c, t, g, unknown or other
  misc_feature (223)..(223): n is a, c, g, or t
  modified_base (313)..(313): a, c, t, g, unknown or other
  misc_feature (313)..(313): n is a, c, g, or t
tcagcgcgtatacacacgaccggtgctcgatttagagtgagctcgttgggttgggctgagcttgggttttcctcgttgctcttttaagaggtgtccagtgtcacgtgcagctggtncagtcgtggggggagcgtggtccagccgtggggagtccctagaaactctaccgtgtgacagcctactggtattcgctacaagtcgttctaccttgcgacgtgggccncgaggcctacgaggacgaaggggtctaggggaggtcggggtacgactacgtttacgtctacgtacgttcgtacggtagtaacgggtaaanaggtacgtcgtaccgttaacgtaccgtacgaacggtacccgttaccgggtaacggtaaccggggtacctaaccgttacccgaaccgtaacttaccgaaccgtaaggaaccgtaaacgtaaaaccttaacgtaaaacggaacctaaaccgtacgtaatttacgtaactacgtaaaccgtaaagtacggtaactacggaccgtaaggaacgtaagtacgtagaaacgacggtaccggtcttaggttactagttcgtagtacgaggtatagtacgttaagtcttaacgttacgaggtactacgggtacctcgggtttaacggttcgggttaaccggtcccgttacccgggaccggttacgggacccgttaacgggtacccttcgggacccgtaccgttacccgtacgtacccgtccgttaaccccgtacccggaaccggttaaccccggttcccgtaaccgggtttcccccgttacccccggttcccccggtgtcccccggttaccgg

SEQ ID NO: 37494 - DNA, 779 bp, Homo sapiens
  misc_feature: GYAE6OF01BGZPE.53.33.C11.1.454.CMB.1.raw
tcagcgcgtatacacacgaccggtgctcgatttagagtgagctcgttgggtttgggctgagctgggttttcctcgttgcttcttttaagaggtgtccagtgtcacgtgcagctggtgcagtcgtgggggaggcgtggtccagccgtgggacggtccctagaaactctcctgtcgcacgcctctggtacttcgtctcgagtcgtcctaccttcgctacgtcgggtccgcgaggcctcgaggcgaagggctgggaggtcgggtgactagttactctctactcgtagagttaggaaagacgtagtacgtaccttaacgtacgcgtaacgtaaccgtccggtaaggacgggtcctactccacctactcaccgaagtacgaactaacgttacaaacgtaacaacctacgttactaatcgtagaactaacgtggtaacacgtacgtaggaagtcgacgaacggaacgaccgtacggtctttaggttacgtttatcggttagtaccgggtaagaggtagtaacgttacgtttattaaccgttacgttaggtcgttaaggttcccggttaaggttcgggtttttacgggttaccccggttaaccccgggttcccgggtaaccccgggttacgggggtacccggtaacccggggttacccgttccgggttaccccgttctaccccggtttacgacgtaacccgtccccggtacgaaccccggggtacctaccccggttaccgtttcccccgggtttaaccccgtccccggtcggtcccccgtaccccg

SEQ ID NO: 37495 - DNA, 919 bp, Homo sapiens
  misc_feature: GYAE6OF01BZZAY.53.33.C11.1.454.CMB.1.raw
  modified_base (220)..(220): a, c, t, g, unknown or other
  misc_feature (220)..(220): n is a, c, g, or t
  modified_base (563)..(563): a, c, t, g, unknown or other
  misc_feature (563)..(563): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtggggagcgtggtccagccgtgggacggtccctgaaactctcctgtgcagcctcgtggtattcgtctcgaagtcgtctacctttgcacgtcgggtccnccgaggtcctccgagggcgaaggggtctagggaggtcggggtcgaccttacgttactccttactacgttcgtaggtaagttagggaaagtacggtaacgttccggtacctttaacgttaccggacctaaccggttaaccccgttacccgggttaagggaaaccgggggtaccctaacgtttacccgaaacccgtattccccgtaccgaagtaccgtaaaccttaaacgttacccgaaaacgtaaccctaactacgttacgttacgtacgtacggaactaaagttccggaacacggtaccgtagacggtacgtacgtaacggaaacgtaccggtaacccggttnttaacggtttagtttaacgtttacgtaggttaaccggtacgggtaaacgttacggtaagttacccgtttagtttaaccgtttaaccgttagttacggtaacgttcggtaccggttttaacgggtttcggtttaacccgggtttaccccgggttacccggtaaccccggggtacccggggacccggttaccgggtaaacccccggttcgggtaaccccgttcccgtaccggttaccgtcccggttaaaccggttacccccttaacccgggaacccgggtaacccccggttaccgtttacccccgggtttcccgtttaaccccccggtttccccccggtgggtacccccgttccccgg

SEQ ID NO: 37496 - DNA, 901 bp, Homo sapiens
  misc_feature: GYAE6OF01BSASH.53.33.C11.1.454.CMB.1.raw
  modified_base (116)..(116): a, c, t, g, unknown or other
  misc_feature (116)..(116): n is a, c, g, or t
  modified_base (854)..(854): a, c, t, g, unknown or other
  misc_feature (854)..(854): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtncagtcgtgggggaggcgtggtccagccgtgggacggtccctagaaactctccgtgtcgcagcctcgtggacttcgtctcgaagttcgttccttacccgtttgctacggtcggtcccgccgacggtcctccgaggacggaaggggtccgtgggacggtgggtcggtcgtactttactcgtctaacgttcgtagtaggtaagggaaacggagtacgttacgtccgttaagttaccgacgtacggtaccgtcgggtaggaaccgggtaccgtactaccgtacctacgtaccgtaccgaacgtaactaaaccgtaaacgttaaccgaaaacgtaaaccgtaacctacgttaacggttaactaccgttaacgaaaccgtaaaggtaccggtaaccgacgtaaccggtaggtaaacggaacgtacggttaaacggaaaccggtaaccgggtaccgttggtttaaagggtttccgttaacggtttaaccgtggggtacgtaaacggtttaagggtcggtaaattttccggtacgtttaaacgtttaagtaccgtaggtttaacggtccggttacgggttttaacggggttttcccggttttaacccccggggtaaccgtttacccccggggacccgggttcccgggggtaaaccgttaaacccgggtcccggttcccgtaccgtacccgttcccgcccttaaagggtcccctacccgggttaacccccgacgggacccccggttnttaccccgggttcccctcccccgttacccgggccgtacccgtcccgg

SEQ ID NO: 37497 - DNA, 835 bp, Homo sapiens
  misc_feature: GYAE6OF01EBWBF.53.33.C11.1.454.CMB.1.raw
tcagcgcgtatacacacgaccggtgctcgatttagagtgagctcgttgggtttgggctgagctgggttttcctcgttgcttcttttaagaggtgtccagtgtcacgtgcagctggtgctagtcgtgggggaggcgtggtccagccgtgggaggtccctgaaactctcctgtgcagcctctggtattcgtctacaagtgtccttaccctttgcacgtcgggtccgccaggcctccgaggcgaaggggctgggaggtggggtcgctacttatcctcatcgtagacgtaggaagagtacgtcgtaccttaacgttacgaccgacggtaccgttaccgggaaggaaccgggtaccgtacttacccgaacctacctaccgtaccgaagaacgtaacctaacgtaacccgaaacgaacctaacctacgtacgtaactacgtacgtaacgtaagtaccggaacgacgtcggtaggacgtacgtacgtaagaacgtacggtacgtagttaggttaagtttacgttagtcggtacgacggtagtacggtaacttagtttacgttaccgttaagttacgtaggttacgttaccgtaccgggttttaaggggttttacccgggtttaccccggtacccgggttaccccgggtacccggggttacgggaccgggttaaccccggggttacccttcccggggttaaccctaccccggttacccgttaccccgtaccggtacccgttaccccggtaaaccccgggaaacccggttaaccccgggttcccttaccgggtttccccccggttttaccccggttcccccggtcccgggtaccccgtaccccg

SEQ ID NO: 37498 - DNA, 880 bp, Homo sapiens
  misc_feature: GYAE6OF01DJPCI.53.33.C11.1.454.CMB.1.raw
  modified_base (116)..(116): a, c, t, g, unknown or other
  misc_feature (116)..(116): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtncagtcgtgggggaggcgtggtccagccgtgggacggtccctagaaactctccgtgtcgcacgtcctcgtaggtactttccgcttacgtaagttcgttacccttaccccgtttgaccgtaccggttccggggtccccgacccggacggtccctacccggaacggggaccggtaacggggggtccgtggggtacggggttcgggggttcgggtacccttaaccgtttaacttccttaccgtaagttccgttaggtaaacggttaggggaaaaggtagttacgttaccggtacctttaacgtaccgtacgtaaccggtacccgttaccgggtaaggggaacccgggtacccgtaactttacccgaaccgttaccgtttcccgaaccgtaaggaaaccgtaaaccttaaaacttaacccgaaaaaccgaaacccgttaaacctacgttaacgttaataccgttaacgaaaccgtaagtacggaaccacggtaccgtagacgacgagtaacgaaccggacgtacggtacgtaggttacttaacgtgtaggtacgtacggtagagtagtacgttactttaccgtattacggtagacgttacgttcggttagggtttaccggttaccggttcccgtcccggtaccgggtaccggtaccggaccccgggttaaccgtcgtaccgtccgttacctacccgtactacccggtccctacccggaaccgtcccgtcccgttccgttaccccggtcccttcccggccgcccctccgg

SEQ ID NO: 37499 - DNA, 746 bp, Homo sapiens
  misc_feature: GYAE6OF01B5AAI.53.33.C11.1.454.CMB.1.raw
  modified_base (584)..(584): a, c, t, g, unknown or other
  misc_feature (584)..(584): n is a, c, g, or t
tcagcgcgtatacacacgaccggtgctcgatttagagtgagctcgttgggtttgggctgagctgggtttcctcgttgctctttaagaggtgtccagtgtcacgtgcagcgtggtgcaggtcgtgggggaggcgtggtccagcgtgggacgtccgtagaaacctctccgtgtcgcgacgtcctcgtggacttcgtctacgtaagtcgttccttacccgtttgcctccggttcgggtcccgaccgaagggtccctaccggaacgggacggaacggggtcggtaggggtgggtggggtcgtacgtaacttacttcctacgtacgttcgtaggtaggtaaggaagagtacgttaccgtccttaacgtaccgacgtaaccgtaccggtccggtaacgggtaaccggacgtaccttacccgtaaccacgttaccaccggttaaggaaccaacttaacctaaccgaaacaaccgtactacctacggtactacgtacaaagaacgtcggaacacgtacgtagaagtacgtacagggactcgagtctaggtattgtacgtgtcgagtgacgtagtacttgtaccttagtacgngtacgcttcggtcgggttacgttccggtaacccgttacccgggcggtacccggtacgggtacccggtaccgttcggacctccgtcctaccgctaccgtacctacggaccccgtaacggtccgtacccgttcccgttacccccgtccggcccgcggttacccg

SEQ ID NO: 37500 - DNA, 918 bp, Homo sapiens
  misc_feature: GYAE6OF01CC8GD.53.33.C11.1.454.CMB.1.raw
  modified_base (116)..(116): a, c, t, g, unknown or other
  misc_feature (116)..(116): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtncagtcgtgggggaggcgtggtccagccgtgggacggtccctagaaactctctgtgcacgtcctcgtggtacttcgtctacgtaagttcgttaccttacccgtttgacctacggttcggggtcccgccgacgggtcctaccggacgggtaccggtaaaggggggtccgtaggggtagggttcgggggtacggtaccttaacgtttaactccgttaactacgttcgtaggtaacgtaagggaacgtagtaacgtcgtaccttaacgtaccgacgtacggtaccgtaccgggtaacgggaaccgggtaccgtacttaccgaaccctactaccgtaacgaaggtaaccgtaactaaacttaaccgaaacgtaacctaacctacgttagttactacggtaacgtaacgtaacggtcggaaccgtacggtacgtaggtacgacgtacgtaaacgaaccggtacgtacggttcgttacgttaacgttaacgttacggtacggttacggacggtaacgtaaggtacgttacgtttacggttaaccttaagttacggtagtaacggttaccggtacgtttaacgggggtttccgggttttaaccccgggtcccgggttaacccgggtaccccgggttaccggggtaacccggtaacccgggttaacccggttccggtacccgtttacccgttccgtccccgtaacgtttccccggaacccgttaccccggacccgggttaaaccccgggtccccctttcggggtttccccccgtaacccccggtttccccgggacgttcccccggtacccg

SEQ ID NO: 37501 - DNA, 1164 bp, Homo sapiens
  misc_feature: GYAE6OF01CUYA9.53.33.C11.1.454.CMB.1.raw
  modified_base (88)..(88): a, c, t, g, unknown or other
  misc_feature (88)..(88): n is a, c, g, or t
tcagcgcgtatacacacgaccggtgctcgatttagagtgagctcgttgggtttggctgagctgggttttcctcgttgctcttttaagnggtgtccagtgtcacgtgcagctggtgcagtcgtgggggaggcgtggtccagccgtgggacggtccctagtaaactctccgtgtgcgacgtcctcgtaggtactttcggtactacgtaacgtacgttcccttacccgtttgcgtaccgtcggggtcccgacccgacggtcctaccggacgggaccggtaagggggtcgtagggtaggtggggtcggtaccgttactttacgtccgttacgtacgttcgttaggaaagttagggaaaacgaagttacgttaccgtaccgtttaacgtaccggtaccgtaacggtaaccggttaccggtacggggaaaccgggtccgtaacttaccctaacctaacggttacctacggaacgtaaaccgtaaacctaaaccgttaacccgaaaaacgtaacctaaccgtactttaacggtaacttaacggttacggaaacttaaacggtacggtaaaccaccggttacgtaacggtaacggtaaaccgtacggttaaacggtaaaaccgtaccggaccgggttttacgttaacgggttttacgtttaaaccgtttacgttaccggtacggttaaaccggtaaagggtttaacggttaacgtttaaaccggttttaaccggttttaacccgtttaaacttttaacggggtttaacggttaacccggttttaacggggtttacccgggtttacggggtttttttaacccgggggttttaaccccccgggttttaaaaccccccggggggtttccccccgggttttaaacccccggggggtacccgggggtttaaaaccccccggggggtaacccggggttttaaaccccccgggttttacccccgggttaaccccggtttaccccccgggtttaccgttaaccccccggttttaaaccggtaccccggtttaacccccccgggttaaaaccccgggttaaacccccggggaaacccggtttacccccccgggttttaaaccggtttaccccccccccggggttttacccccggttccccccggggtttaaaccccgggccccccggtttaaccccccggg

SEQ ID NO: 37502 - DNA, 939 bp, Homo sapiens
  misc_feature: GYAE6OF01ENAYH.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggaggtccctgaaactctcctgtgcagcctctggtattcgtctacaagttgtccttacccgtttgccgtacgttcggggtcccgcccgtaggtcctaccgagggacgaacgggggcgtgggaggttcgggggtaggaccgttactttattcctctaacttccgttaggaagttacgggaaaggacggtaacttcgtaccgtttaagttaccgacgaacgttaccggttaccggttgggaaaccggggtacccggtaacttacccggaaccctactccgttaacccgtaaggtaaccgaacgttaaaccttaaccccgaaaacgtaaacctaacccgtaaccgttagtaacgtttactacggtaacgtaaaacgtacgggaacctacggtaccgtacgggaacggtacggtaccgttaaaggaaacggtaaccggtaacgggttccttagggtttacgttaatttaccgggttggtacggtacggtagggtacggtaagttaggtttacgtttactttaacgttagttacggttacgtccggtacggttttacgggtttacgggttttacccgggtttaccccgggtttaaccccgggtaccccggggttaccggggtaacccggtaacccgggggttaaccccttccggggttaaccccgtaccccgtttcccgttaccccgtacggttaccccggttacccttaccccggtaaaccccgtacccggggtacccccttccgggttacccccggtttccccgttacccccgggtcccggtacccgttccccggg

SEQ ID NO: 37503 - DNA, 737 bp, Homo sapiens
  misc_feature: GYAE6OF01E0D7N.53.33.C11.1.454.CMB.1.raw
  modified_base (346)..(346): a, c, t, g, unknown or other
  misc_feature (346)..(346): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtggggacggtccctgaaacctctcctgtgcagcctctggattcgtctcaagtgtcttaccttgccacgtcgggtccgccacggcctccgaggcgaaggggctgggaggtggggtgctacgttatctacagtctagagtaggaagagatcgtactagttacgcagactccggaggaacggccgtactcaccactcctacaganaactaactaccaaaagaacacactagtactactgaataagtacggacacgcctagagagactaaggaacacgacggtcttaggtacttagttacgttggtacggacggtaggtagaagttacgtacgtttacgtttaactagttagtcggtacgttaccgttagggtttttacgggtttacccgggtttaccccgggtaccgggttacccccggggttcccggggtaacccggtaacccggggtaacccgttaccggttacccgtacccgttccgttaccccgtcccgtacccgttaccccgggttaccccgaaacccggtaccccggtaccccgttaaccggttcccccgttacccccggttccccggttcccgggccccgttccccggg

SEQ ID NO: 37504 - DNA, 1037 bp, Homo sapiens
  misc_feature: GYAE6OF01B5BX1.53.33.C11.1.454.CMB.1.raw
tcagcgcgtatacacacgaccggtgctcgatttagagtgagctcgttgggtttgggctgagctgggttttcctcgttgctctttaagaggtgtccagtgtcacgtgcagctggtgcagtcgtgggggaggcgtggtccagccgtgggacgtccctagaaactcctcctgtcgcacgtcctcgtggtattccgtctacgaagttcgttcccttacccgtttgccgtacgtcgggtcccgaccgacggtccctaccggagggaccggaaggggtcgttaggggtagggttcggggtacggaccttaacgtttacttccttaccgtacgttaccgttaggaggtaacgggaaagtacgtaagttaccgtaccgttaaacgttaacccggacgtaaccggtaacccggttacccgggtaagggtaaccggggtacccgttaacttacccgaacctacgttacccgtaaccgaacgtaaaccgtaaactaaaaccgttaaacccgaaaaccgaaacccgtaacctaacgtttaacgtaacgtacgtaacgaaacgtaaaacgtcggtaaactacggtacctaagggacgtaacgacgtaaacgtaacgaccggtacggtacgttaggttacgttaacgttaggtcggtacggtacgtaacggtaggtaacttacgtttccgtttaaacgttaacgttagtaaggttccgttaaccgggttacggtttaaccggggtttacccgggttttacccggttaacccccggggtttaccccgggtaacccccggggtttcgggaaacccccggggtttaacccgggtaacccggtttacccggtaccccccggttacccggtttaaccccttacccgggttaaccccgttaacccggttaaccccccggtttaaaacccccgggtaaaccccgggttaccccccgggttaaccccccggtttaaccccggttttcccccccggggttttaccccccccgttaaccccccggggttttacccgggccccccccgggtttaaaccccgg

SEQ ID NO: 37505 - DNA, 805 bp, Homo sapiens
  misc_feature: GYAE6OF01AY3LG.53.33.C11.1.454.CMB.1.raw
  modified_base (227)..(227): a, c, t, g, unknown or other
  misc_feature (227)..(227): n is a, c, g, or t
tcagcgcgtatacacacgaccggtgctcgatttagagtgagctcgttgggtttgggctgagctgggtttcctcgttgctcttttaagaggtgtccagtgtcacgtgcagctggtgcagtcgtgggggaggcgtggtccagccgtgggacggtccctagaaacctctcctgtgcagcctctggtattccgtctacaagtgtccttacctttgcctacgtcgggtcccnccaggctccgaggcgaaggggctgggaggtgggtcgctacgtttatcgtacatcgtagagtaggaagagtatcgtaccttacgtacgacgtacggtaccgtccggtaggaaccgggtcctaacgttaccgaacctacttacctaccgaacgtaaccgtaactaaacttaacccgaaaacgaaacctaactaccgtaagttactacgtaacgtaacgtaaagtacggaacgtaacgtaccgtaggaagtacggtacgtaaacggaacgtaaccggtacggttcgttacggttaacttttaacgttacgggttacggttacgggtaaccggtaaaggttcggtaaacggttaccgtttaaggttacctttaaacgtaggttacgttaacggtccggttacgggttacggttttcgggttaacccggttacccggttaccgtcccgggtacgggacccgtaaccgggtcccgttacggtccccgtaaccgttccgtaccgaccgttaccgtaccccgtaaccgaacccggtccgtaccccgtccggtttaccccgtcccgtcccggtcgtcccgtaccccg

SEQ ID NO: 37506 - DNA, 697 bp, Homo sapiens
  misc_feature: GYAE6OF01BWQH2.53.33.C11.1.454.CMB.1.raw
  modified_base (117)..(117): a, c, t, g, unknown or other
  misc_feature (117)..(117): n is a, c, g, or t
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
tcagcgcgtatacacacgaccggtgctcgatttagagtgagctcgttgggtttgggctgagcggtggtttcgcgtaggctctttaagaggtgtcagtgtcacgtgcagctggtgcgngtcgtgggggaggcggttcggtccagcctagggacggtccctagaaaccttctctgtcgcacgtcctcgtggtattcgtactcaggttcttctaccctttgactcgtcggtccncgaggctaccgaggacgagggtntaggaggtggtagactacttncctgactcgtagacgtaggagagtatggacttatacgnacgcgtccggnggaacggctatacactctacacgacatacgaactacaacgaactctaacgttgtactggagaagagtacgactacncgtgaagtacncggtaaacgacgtcgaacgtgtacgttaggttactacgtgacgtaggagttagactagttactttacgtacgtagtacgtacgtaccgttaggttaccggtttaccgggtttaccggttacccggtaacccgggttccgggtaccgggtaccgggaaccggttacccggtccgtaccggttcccgtccgttaccgacggttcccttacccgtacccggacggtaaaccccgtttcgtaccccggttcccggtttaaccccgtcccggtcccggtcccgttccccgg

SEQ ID NO: 37507 - DNA, 713 bp, Homo sapiens
  misc_feature: GYAE6OF01DGW5H.53.33.C11.1.454.CMB.1.raw
  modified_base (284)..(284): a, c, t, g, unknown or other
  misc_feature (284)..(284): n is a, c, g, or t
  modified_base (400)..(400): a, c, t, g, unknown or other
  misc_feature (400)..(400): n is a, c, g, or t
  modified_base (701)..(701): a, c, t, g, unknown or other
  misc_feature (701)..(701): n is a, c, g, or t
tcagcgcgtatacacacgaccggtgctcgatttagagtgagctcgttgggtttggctgagctggttttcctcgttgctcttttaagaggtgtccagtgtcacgtgcagctggtgcagtcgtgggggagcgtggtccagccgtgggagtccctgaaactctcctgtgcagcctctggacttcgtctcgaagttcgtaccttacccgttgctacgtcgggtccgccaggtctccgaggcgaaggggctggagtgggtgctacgtactctcatctagagtacggaanagatcgtactaagtacgactacgtaccgtcgtagggaaccgggccgtattcccaaccgattccacgaagaagtaacaactccaaaagacctaacacgttacgtatacgtacgtaanaacgtcgaactacgactgaagacggtacgtaagaacggtacgacggtacttagggttattacgttaacgtcggtaacgtacggtaagtaggtaacgttattacggttttaaccttaacgttaggtacgtagttaccgttggttaacccggtttagggtttaaccccggtttcccggtacccggacccggggttcggaaccggttaccgggtacccgttcgtaccctaccgttcctacccgtacgtcgtaccttacccgaaccgtaaccgggtccctacggttaccccgttccgtccccggnggtccctacccg

SEQ ID NO: 37508 - DNA, 922 bp, Homo sapiens
  misc_feature: GYAE6OF01CDZJ4.53.33.C11.1.454.CMB.1.raw
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
tcagcgcgtatacacacgaccggtgctcgatttagagtgagctcgttgggtttgggctgagctgggttttcctcgttgctctttaagaggtgtccagtgtcacgtgcagtctggtgcagtcgtgggggaggcgtggtccaggccgtgggacgtcccgtagaaactcgtcctgtcgcagcctcgtggtattcgtctacaagtcgttctacctttgcncgtcggccgcaggcctcgaggcgaagggctggngtgggtgactacgttatctactagttcgtggtaataggaagagtagttacgaccttagtaacgcgtaacgtacggtcccggtaagggaacggtccgtaacttccgaacctacgtacctacggaatacgtaaacgtaaacgttaacccaaagaaaccactaccggtacttaacgttccgtaacgggtaaacaaaggtttaccggaaccgttaaacggttccccggtaaagggaagttaccggtaaacgacgggtaaaaacccggaaccgggttaaccggtaccggttttaacgtagggtttaaaccctttaacgggttgtttaacggggaacgggaagtttacgggtaaagttccgttttaagttaaacccgttttagggtaaaaccttttggaaacccggttcggtaaccccgggttaaaggttttttcgggtttaacccgggtaacccccgtttccccggggttaaacccccgtaacggggggtttcccgtaaaaaccccgggggtccttcccccgggtaaaggtttccccccgtaaccccgggtttcccggttaaaccgtacccccgggttaaccttaaccccccgggtaaacgttaaccccgggttacccccgtaacgttttcccccgggtacccccgtttaccccccggtcggtaaacccctccccggg

SEQ ID NO: 37509 - DNA, 858 bp, Homo sapiens
  misc_feature: GYAE6OF01A51BF.53.33.C11.1.454.CMB.1.raw
  modified_base (310)..(310): a, c, t, g, unknown or other
  misc_feature (310)..(310): n is a, c, g, or t
  modified_base (514)..(514): a, c, t, g, unknown or other
  misc_feature (514)..(514): n is a, c, g, or t
  modified_base (533)..(533): a, c, t, g, unknown or other
  misc_feature (533)..(533): n is a, c, g, or t
tcagcgcgtatacacacgaccggtgctcgatttagagtgagctcgttgggtttgggctgagctgggttttcctcgttgctcttttaagaggtgtccagtgtcacgcgcagtctggtgcagtcgtgggggaggcgtggtaccagccgtggggacggtccctagaaactccgtcctggtgcacgtccttcgtggtacttcgtctactaaggtcgttcctacccgtttgcctacgtcgggtcccgccgaggcctaccggaagggaccggtaagggggtcttaggggaggtggggacgtctacgttactctacntcgtagagtgggaagagtatcgtaccttagtacgcacggtacgtcggtacgggacggtcctatccgacctacgtcctacgaacgtacaaccgtaactaaaccgaacgaacctactactagtactactagaaacgtacgtgaaacctcgacgtagacgtacgtgaaacgaacgaccgtacggtgttaggtattaaccgtgtcggngagtaacgtggtaacgttntttaacgttacgttaatcggtaaacgtacggttaccgtacggttttaccggggttacggggtttaccccgggtttaacccggttccccccggggtaaaccccgggggttaacgggggtaccccccgggttaaaccggggtcccccgtttaacggggtccccgtttacccccggtacccccgttccgttaaacccggacccgttttaccccggaaaaccccggttaccccgtaaacccggggttcccccccgttttaacccgggtaccccgggttttacccccccccgtacccggggggttcccaccccccgggttaccccccggg

SEQ ID NO: 37510 - DNA, 847 bp, Homo sapiens
  misc_feature: GYAE6OF01EYDGZ.53.33.C11.1.454.CMB.1.raw
  modified_base (220)..(220): a, c, t, g, unknown or other
  misc_feature (220)..(220): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgtggtccagcctggggacggtcccttaaactctcctgtgcagcctctggtattcgtctcaagtcgtcttacccttgcacgtgggtcccncgaggcctcgaggcgaaggggcgtaggaggtcgggtggctacttatctcattcgtagtagtaggaaaggtagacttcggtacccttaagttaccgacgtaacggtaccgttacccgggttagggaacggggtcccgtaacgtttaccaacccgtacgttacccgtaccgaagggtaaccgtaaccgtaaactttacccgaaaacgtaacctaaccggtaacttacggttaactccgtagaaccgtaaagtcgggaactacggtcccgtaggaacgaggtacgaaggaaacggaccggtacgggtcgttacgttagttaacgtttacgttggtacggtaacgggtacggtagaaagtacgtttacggttaacttacgttaagtgtaacgttccggttaacgttacggggttttacgggtttaccgggttaccccggtttcccgggtaccccgggttaccggggtacccgaacccggggttaaccccgttcgggtaaccccgttacccgttccgtcccgtacggtaacccggttacccgttaccccggaaacccgggtacccggtacccgttacccggtttaccccggttcccccttaccccgggcccggtacccgtcccggtacccgg

SEQ ID NO: 37511 - DNA, 769 bp, Homo sapiens
  misc_feature: GYAE6OF01APP3A.53.33.C11.1.454.CMB.1.raw
  modified_base (346)..(346): a, c, t, g, unknown or other
  misc_feature (346)..(346): n is a, c, g, or t
  modified_base (519)..(519): a, c, t, g, unknown or other
  misc_feature (519)..(519): n is a, c, g, or t
  modified_base (711)..(711): a, c, t, g, unknown or other
  misc_feature (711)..(711): n is a, c, g, or t
  modified_base (718)..(718): a, c, t, g, unknown or other
  misc_feature (718)..(718): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggacggtccctagaaactctcctgtcgcacgtcctcgtggtacttcgtctacgtaagttcgttacctaccccttttggacctaccgttcggggtcccgaccgacggccctaccgaggggaccgaaagggggtccgtaggggagggttcgggggtcggaccttactttactcctacgtactcgttaggacgttaggggaanaaggtatacggtacccttagttaacccggacgtaacgtacccggtaccggtagggaaccggggaccttacgttacccaacctacgttcctaaccgaacggaacctaaaccgttaacttaaccaaaacggtaaacaccgttactagtactacgtacgaactaaagtaccggaanaccggtaccgagaacgtacggacctaaggaacgtaccgcggtataggttacgttaacgttcgtcgtagggtacgaggtacgtagtcgtttacgtacttacgagtacggtctacggtcggttagggtttcggttaccggtacccggttccgtaccggtcggtaccgaccggtcgtaccgccgtcctcgtcccncgttacnccgttaccaccgtccgtccctcgttcccgtacccgtcccggcgtccgtccc

SEQ ID NO: 37512 - DNA, 879 bp, Homo sapiens
  misc_feature: GYAE6OF01EFKA4.53.33.C11.1.454.CMB.1.raw
  modified_base (162)..(162): a, c, t, g, unknown or other
  misc_feature (162)..(162): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
tcagcgcgtatacacacgaccggtgctcgatttagagtgagctcgttgggtttgggctgagctgggttttcctcgttgcttcttttaaggaggtgtccagtgtcacgtgcagctggtgcagtcggtgggggaggcgtcggtccagccgtgggacgtccctanaactctcctgtcgcatcctgtgtattcgtctagtaagttcgtccttacccgttgctacggtcggtccncgnggtccnccgaggacgtaacgggcgtagggtaggtgggtcgactacgtttactactcgtagttcgtaggtaacgtagggtaaacgagtacgttaccggtaccttaagttaccgacgtaaggtacccgttaccggaggaaccgggtaccctaagttacccgaacgtacttaccaccgaataaccgaaccttaacttaaaccgaaataacccgtactaacttacgtactacgtaaataacgaaaagtccggaacgttacgcgtaacggtacgtaacggacgtaggtaaaccgcccggtacggtagtaggttacttagttaacggtggttacgacggttagtacggtagttacgttacgttaacttaacgttaacgtaggttacgttaccgggttaacgggttttacgggttaacgggggtttttacccggaacccccggggtttacccggtaacccggggtaccgggttaaccccgggtaaccgggttacccggttacccggtaccccgggttacccttaacccggttacccgtaacccgttacccggtaaccccgttaaacccggtaaccccgggtaacccgttaccccggttaacggttcccccggtttacccccggttaccccgtcccgggtcccccggtacccgg

SEQ ID NO: 37513 - DNA, 909 bp, Homo sapiens
  misc_feature: GYAE6OF01B6P25.53.33.C11.1.454.CMB.1.raw
tcagcgcgtatacacacgaccggtgctcgatttagagtgagctcgttgggtttgggctgagctgggtttcctcgttgctcttttaagaggtgtccagtgtcacgtgcagctggtgcagtcgtggggaggcgtcggtccagtccgtgggacggtccctagaactctccgtgtcgcacgtcctcgtggtacttcgtctacgtaagttcgttccttacccgtttgacctacgttcgggtcccgccgacggtcctaccgacgggtaccggaaacgggggtccgttaggggtaagggttcggggtacggtaccttaacgtttacgtcctacgtaacgttcgtaggtaaggtaacggaaacgtacgtacgttaccgtaccgttacgtaccgacgtaacggtaccggttccggtaacggaaccgggtaccgttaaccgtaccaaccgtacgtaccgtaacgaacgtaccgtaaaccgtaacgtaaccgaaacgaacctaacgtaacttacgtaactacgtaacgtaaacgtaacggtacggaactacgtacgtaggacggtacgtacggtaacggaacgtacgtacggttcgttacgttacgttaacgttacggtcggtacgtacggtagtacggtagttacgttacgtttaacgttacgtaagtacgttacgtaccggttacggtttaacggtttaccgggtttaacccggttaccccgggttaccccggggttacccgggtacccgggtaaccgggttaacccgggttacccggttaccggtaccccggttacccgttacccgtacccgttaccgtacccgttaccccggtaaacccgtacccggtaacccggtacccgttacccggttccccgttccccggttacccccgggttccggtaccccggttacccg

SEQ ID NO: 37514 - DNA, 788 bp, Homo sapiens
  misc_feature: GYAE6OF01A42W6.53.33.C11.1.454.CMB.1.raw
  modified_base (235)..(235): a, c, t, g, unknown or other
  misc_feature (235)..(235): n is a, c, g, or t
tcagcgcgtatacacacgaccggtgctcgatttagagtgagctcgttgggttgggctgagctgggtttcctcgttgctctttaagaggtgtccagtgtcacgtgcagctggtgcagtcgtgggggaggcggtcggtccacggcctgggggtacggtccctcggaaaccttcctcctgtgacacgtcctcgtggtattcgtctacgacgtcgtcctaccttgacacgtcgggtccnccgaggtctccgaggacgtaaggggctaggtaggtggggtcgactacttagtcctactacgtcgtaggacgtaagggtaacgaagtactcgtaccttaacgttactacgacggtacctaccgggtagggtaaccgggaccgttacgtccctaacgtacgttacctaccgtaagtaaccgaactaaccgttaaccaaacggtaaaccaacctctaacggtacttacgaactaaacggtaacgtaacgggaacctacggtaacccgtagaaaccggtaagtaaccgtacggaaaacggtccgtaaccgggttcgttaaggttaaccggtttagttacgtaaggcggtaacggtagtacggagttacgttgttaccgtaattcgtaatcgtacgtacgttcgggttaacgggttcccggttaccgggtacccggcgggtaccggtcggtaacccggcgttccgaaccgtccggtactcccggtactaccggtcctccggaacccggaccgttcctcccgggttaccctacccggtccctccgggtcctaccccggg

SEQ ID NO: 37515 - DNA, 724 bp, Homo sapiens
  misc_feature: GYAE6OF01EOFX9.53.33.C11.1.454.CMB.1.raw
  modified_base (193)..(193): a, c, t, g, unknown or other
  misc_feature (193)..(193): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtggggaggcgtggtccagccgtgggacgtccctagaaacttctcctgtgcacgcctgtggacttcgtctanaagttgttccttaccctttgctacgtcgggtcccgtccgaggtcctacgacgggacgaaggggtctaggggaggttcggggtgacctacgttatccgtactagtcgtaggagtacgggaagacgtattcgtacttaagttacgacgtaacgtaccggtccggtaaggaaccgggtaccttacttcccgaacctaccttcctaccgtaaggaacgtaactaactacccgaaaacgtactaacgtacgttagtactcgacgtaacaaggtcgtaacgcgtacgtaggagacgacgtaagaacgtacgtagtaccttaggttacgttaacgtttacgtaggtacgaagttaaggtcggtaacttgttcgttaactagtacgtgtacgtcgtacgtggtttaccgggttaccgtccgtaccgtacccggtcgggaccgtaccgtaccgtcgtccgtccgtcctccgtactccggttacccaccgtaccggccgcccgttacgtccccggttccccgtcccgtggcccctacccgg

SEQ ID NO: 37516 - DNA, 1021 bp, Homo sapiens
  misc_feature: GYAE6OF01D27TP.53.33.C11.1.454.CMB.1.raw
tcagcgcgtatacacacgaccggtgctcgatttagagtgagctcgttgggtttgggctgagctgggttttcctcgttgcttcttttaagaggtgtccagtgtcacgtgcagctggtgcagtcgtggggggaggcgtggtccagccgtgggacgtccctagaaactctcctgtcgcacgtcctcgtggtacttccgtctacgaagttcgttccttacccgtttgccgtacgtcgggtacccgccgaggtcctaccggagggaccggaagggggtcgtagggtacgggtcggggtcggaccttaactttacgtccttactacgtacgttaggaaggtaagggaaggtacgtaacgttacgtaaccgttaacgttaccggactaaccggtaacccgttaccgggtaacggggtaaccgggtaccttaccgttaccctaacccgtaaccgttacccgtaaccgaaacggtaacgtaaacctaaaccgttaacccgaaaaacggtaacctacgtaacgttacgttaacctacgtaacgtaaaccgtaaacgtacggtaaccgaacgtaccgtaaggtaacggtaacgtaccgtaaacgggaaaccggttaccggtacgggttaccgttaggtttaacgttaacttacccggggtagggtacgtaacgggtagttaacggtacgtttaacgtttaccgtttacgtttaaccgtagttaaccggtaacgttaccgggtttacgggtttaacggggttttcccggggtttttaaccccggtacccggggtttaccccccggggtcccgggggttaaaccccggggtaccccgggtaacccgggtttaaaccccccggttcggggttaaacccccgttccccggtttaccccgttaccccggtaccggttaacccgtttaccccccgtaaaacccgggaccccggtaaccccgggttaccccgttaccccgggtttacccccgggtttccccccgtaacccccgggtccgggtacccccggttaccccgg

SEQ ID NO: 37517 - DNA, 856 bp, Homo sapiens
  misc_feature: GYAE6OF01BYQX7.53.33.C11.1.454.CMB.1.raw
  modified_base (115)..(115): a, c, t, g, unknown or other
  misc_feature (115)..(115): n is a, c, g, or t
tcagcgcgtatacacacgaccggtgctcgatttagagtgagctcgttgggtttgggctgagctgggttttcctcgttgctctttaagaggtgtccagtgtcacgtgcagctggtncagtcgtgggggagcgtggtccagcctgggacggtccctagaactctccgtgtcgcagcctcgtaggtacttcgtctacgtaagttcgttaccctaccctttgacctacgttcgggtcccaccgacggtcctaccgagggaccgaacgggggtctaggggacggttgggtcgaccttaacgtttactctaccgtattcgtagagttaggaagtacgtagttcgaccttacgttaaccgcgtaaccgtaccgtccggttaggaaccgggaccttactacccgacctaccgttaccctacgaaacggtacgtaacctaaccgttaccaaaacgtaaaccgtaccttaacgtacgttaaccgttccgaacggtaacgtaaacggtaccgtaccgtaaccgtccgtaaagacggtacgtaccgtaaggaaccgaccggtacggttacttacggtagttacgttacgttacggtaggtaccggtaggtagtacgttacttaggttacctttaacgtcgttacgtacggttacggtcgttacgggttttacccggtttccggttaaccccggttcccgggtaaccggtcccgggtaccggttaaccccggaccgttccggtaaccccttccggttacccgttacccgtaccggtaccgttaccccggtaaacccgacccggtaacccgggttccccttaaccgggttcccccgttaccccgtacccggtcccggaccccgttacccg

SEQ ID NO: 37518 - DNA, 787 bp, Homo sapiens
  misc_feature: GYAE6OF01DMRTE.53.33.C11.1.454.CMB.1.raw
  modified_base (776)..(776): a, c, t, g, unknown or other
  misc_feature (776)..(776): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtggggggaggcgtggtccagccgtgggaggtccctgaaactctcctgtgcagcctctggattcgtctcaagtgttctaccctttgctacgtcgggtccgccgacggctccgaggcgaagggggctgggaggtgggtggcctacgttatctcattctagagtagggaagagtatcgtaccttaagttacgcgaacgtaccgtccggtagggaaacggggtcccgtactttaccccgaaccctaacttccctaaccgtaacggtaaacgtaaacccggtaaaactttaaccccgaaaaacgaaaaccctaaccgtaaaccgtttagttaaaccgttaccgtaacgaaaccgtaaaaggtttaaccgggaaccgaaccggtacccgttagggaaacggacgttaaccggtaaacggaaaacggtaaccgtacgggtacgttgggttaagtttactttaaacggtgggtacggaacggtaggtagtacgtaagttcttaacgttaacttagtcgtaacgtccgttaggtacgggtttcggtttaaccgggtcccgtacccggtaccgggtacgggcccgtacgggaccgttcgtcgtacccgtctccgctatcccgtacaaccgggtacgacccgtcgttccccgtcccgttcccggngcccgtcccgg

SEQ ID NO: 37519 - DNA, 833 bp, Homo sapiens
  misc_feature: GYAE6OF01EYYDP.53.33.C11.1.454.CMB.1.raw
  modified_base (822)..(822): a, c, t, g, unknown or other
  misc_feature (822)..(822): n is a, c, g, or t
tcagcgcgtatacacacgaccggtgctcgatttagagtgagctcgttgggttgggctgagctgggtttcctcgttgctctttaagaggtgtccagtgtcacgtgccagcgtggtcgctaggtcggtagggggacggtcgtcggtccaggccgtgggacggtccctagtaactctccgtggtcgacgtacgccgtcgttcggtacttcgtacctacgtaacgttcgtaccttacccgtttacgacgtacggtcgggtcccgaccgacgggtcctaccggaacgggtacggaacggggtccggtagggtacggtacggggttacggtacctacttacgtcctacacgtagtagtagtaacggtaaggtaacgtaacgtaccgttaacgtaacgtaccgaccgtaacggtaccggttaccgggtagggaacggtaccgtacgttacccacgtacgtaccgtacgaactaacgtaacgtaacctaacgtaaaccgaacctactacgtactacgtaacgtacgtaaacgtagacgtaacgacgtacgtacgacgtagtaacgtaacggaacgtacggtagttacgttagttacgttaacgttacgtaggtaacgtaaggttagtaaggttaacgttacgttaacgttaacgttaagtacgtacgtacgtacggttacggttacgggttacgggtttacccgtaccggtacccggtaccgggtacggtacccggtaaccgtaccggttccgtacccgtacgtacccgtccgtacgtacccgtaccaacccgtaccgtacccgtacgttaccgtcccgttacccgtccnccggtccctcg

SEQ ID NO: 37520 - DNA, 870 bp, Homo sapiens
  misc_feature: GYAE6OF01BDS0E.53.33.C11.1.454.CMB.1.raw
  modified_base (285)..(285): a, c, t, g, unknown or other
  misc_feature (285)..(285): n is a, c, g, or t
tcagcgcgtatacacacgaccggtgctcgatttagagtgagctcgttgggtttgggctgagcttgggttttcctcgttgcttcttttaagaggtgtccagtgtcacgtgcagctggtgcaggtcggtgggggacgcgtggtccaggccgtgggacgtccctagaacctctcctggtacgcgacgtcctcgtaggtactttccgtctacgtaacgttcgttccttaccctttgacctcggtcgggtccaccgacgcctaccgacgggacggaacgggtcgtagggnggtgggtacggtactacgtttacgctacgtagtcgtaaggtagtggaagtacggtacttccggtaacttacggttaccgacgtaacggtaccggttaccggtaacgggaaccgggttccgttaacctacctaaccgtacgttacctaaccgaaacgtacgtaaaccttaaccgtaaccgtaaagaaccttaccgtaagttctaacgtacgtaacgaacgtaacggcgaacgtcggaactagggaccgtacgagaagtaaccgacgtacggtcgttaccgttagtacgttacggtaggtacgtacggtaagtacggttaacgtacggtttaacttccgtttaagtcgtaacgggttcttaacgggtacgggtttaacggtttacccgggttccggttaccccgggttaacccgggccgggtttaaccggacccggggttaccgttaccccggtccggtaacccgtcccggttaccttacccggtaccggttacctaccccggtaaaccggttaccggaaccccggttaccggttcccggttaccccccggttaccggttcccggaccccggtccgtttaccccggg

SEQ ID NO: 37521 - DNA, 520 bp, Homo sapiens
  misc_feature: GYAE6OF02H4B9R.53.33.C11.1.454.CMB.1.raw
  modified_base (401)..(401): a, c, t, g, unknown or other
  misc_feature (401)..(401): n is a, c, g, or t
tcagcgcgtatacacacgaccggtgctcgatttagagtgagctcgttgggtttgggctgagctgggttttcctcgttgctcttttaagaggtgtccagtgtcacgcgcagctggtgcagtctggggaggcgtggtccagcctgggaggtccctgaaactctcctgtgcagcctctggattcgtctcaagtgtctacctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtnttactatgatgccagtggtttggtaccgttcgacccgtgggccagggaacctggtcaccgtctccgtcacgctccaccaacgggcccacgtccggtcccttccccgtcggccgtccccg

SEQ ID NO: 37522 - DNA, 533 bp, Homo sapiens
  misc_feature: GYAE6OF02IRK27.53.33.C11.1.454.CMB.1.raw
  modified_base (251)..(251): a, c, t, g, unknown or other
  misc_feature (251)..(251): n is a, c, g, or t
tcagcgcgtatacacacgaccggtgctcgatttagagtgagctcgttgggtttgggctgagcgtggtttcgcgtaggctctttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttanctcatctgatggaagagatgcctattacgcagactccgtgaagggccgattcaccatctccagagacaattccaagaacacactgtatctgacaaatggacagcctgagagctagaagacacggctgtgtattactgtgcgagtgagatgtcttactatgatgctaggttggtttggtaccgtttccgacccgttgggccgagggaaccctgggtcaccgtctccgtcacgtcttaccaccgaacggcccacgttccggtaccttccccgtcggccgtcccg

SEQ ID NO: 37523 - DNA, 518 bp, Homo sapiens
  misc_feature: GYAE6OF02I54V1.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgcagtggtttggtaccgttcgacccgtggggccagggaaccctggtccaccgtctccgtcacgctccaccacggcccagtccggtcctccccgtcggccgtcccg

SEQ ID NO: 37524 - DNA, 522 bp, Homo sapiens
  misc_feature: GYAE6OF02G3IUH.53.33.C11.1.454.CMB.1.raw
tcagcgcgtatacacacgaccggtgctcgatttagagtgagctcgttgggtttgggctgagctgggtttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgcctagtggtttggtaccgttcgacccgtggggccagggaaccctggtctaccgtctccgtcacgtcttccaccgaaggcccacgtccggtccttccccgtggcctcccg

SEQ ID NO: 37525 - DNA, 529 bp, Homo sapiens
  misc_feature: GYAE6OF02JCGI5.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccgtggggccagggaaccctggtccgaccgtctccgtcacgcttccgaccaacggccccgacgtccggtccttcccccgtcggtccgtccccg

SEQ ID NO: 37526 - DNA, 518 bp, Homo sapiens
  misc_feature: GYAE6OF02IX7LX.53.33.C11.1.454.CMB.1.raw
  modified_base (267)..(267): a, c, t, g, unknown or other
  misc_feature (267)..(267): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaanagatgcctattacgcagactccgtgaaggccgattcaccatctccagagacaattccaagaacacactgtaatctgcaaaatggacagcctgagagctgaagacacggctgtgtattactgtgcgagtgagatgtcttactatgatgccagtggttgtaccgttcgacccgtgggccaggaaccctgccaccgtctccgtcacgtcttccgaccgtaaggcccagtccggttcctccccgtggccgtcccg

SEQ ID NO: 37527 - DNA, 554 bp, Homo sapiens
  misc_feature: GYAE6OF02HVL9P.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaaggaacacactgtatctgacaaatggaacagcctgagagctagaagacacggctgtgtattactgtgcgagtgagatgttacttactatgatgcgtagttgggtttcggtacccgttcggaccccggtcgggaccgacgggaaccctggtacctacccgttctcccgtcacgtcctaccgaccgaccggcccacgtcccggtcccttccccgtcggtcccgtccccg

SEQ ID NO: 37528 - DNA, 529 bp, Homo sapiens
  misc_feature: GYAE6OF02ICY9P.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgacaaatggacagcctgagagctagaagacacgctgtgtattactgtgcgagtgagatgtcttactatgatgctaggttggtttcggtaccgttcgtacccgtgggccgaggaccctgtcaccgtctccgtcacgtcctccgaccgacgggcccacgtccggttccgtccccgtcggccgtccccg

SEQ ID NO: 37529 - DNA, 536 bp, Homo sapiens
  misc_feature: GYAE6OF02IKXJS.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaaatggacagcctgagagctgaagacacggctgtgtattactgtgcgagtgagatgtcttactatgatgcctagttgggtttgttaccgttccgtacccgtcggggccgacgggaaccctcgggtccaccgtctcctcacgcttccaccgaacgggccctacgtccggtccttccccgtcggccgtccccg

SEQ ID NO: 37530 - DNA, 569 bp, Homo sapiens
  misc_feature: GYAE6OF02GITX3.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaaagaaccacactgtatctgacaaatggacagcctgagagctagaagacacggctgtgtattactgtgcgagtgagatgtcttactatgtatgcctaggttggtttacggtacccgttccggtaccccgttacgggggcccgaacggggtaaccccgttgggtaccgacccgttcctccgtcgtacgtccttcccgaaccgacgggcccacgttccggtcccttccccgtcggtcccgtcccg

SEQ ID NO: 37531 - DNA, 640 bp, Homo sapiens
  misc_feature: GYAE6OF02IR545.53.33.C11.1.454.CMB.1.raw
tcagcgcgtatacacacgaccggtgctcgatttagagtgagctcgttgggtttgggctgagcgtgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgacctattacgcagacctccgtgaagggccgattccgacctatcctccagagaacaattccaaagtaacacactgtatctagacaaagtggaacagacctaggacgagactagaagacgacggcttagtgttaattacgtgtagcggtagtggaagtattgttacttaactagttgatcggtactaagggtttgggtttacggttaccgttccggtaccccgttcggggcccgtaacgggaaccccgttgggtaccctacccggttaccgtcccgttacgaccgttccgttaccccgaaccggtaaccgggtaccccgtacgttccccgggttcccctttacccccggtcgggtcccgttcccccgg

SEQ ID NO: 37532 - DNA, 627 bp, Homo sapiens
  misc_feature: GYAE6OF02G4MU8.53.33.C11.1.454.CMB.1.raw
tcagcgcgtatacacacgaccggtgctcgatttagagtgagctcgttgggtttgggtcgtgagctgggtttcctcgttgctctttaagaggtgtccagtgtcacgtgcagctggtgcagtcgtgggggaggcgtgggtccagcctgggaggtccctgaaactctcctgtgcagcctctggattcgtctcaagtgtctaccctttgcactgggtccgccaggcctccgaggcgaaggggctgggaggtgggtggcacttatctcatctgatggaagagatgcctattacgcagactccgtgaagggccgattcacatctccagagacaattccaaagaacacactgtaatctgacaaatgacagcctgagagctagaagacacggctggtgtaattaacgtgtgacgagtagagtagttagtcttactatgtaatcgcctaaggttcgggtttacggtacccgtttccggtaacccccggttgggggaccccggtaaacgggtaaaccccgttgggtacccttacccggtacccgttccccgtaccgtacgtcccctttacccgaaaccccgacgggtacccctacggtcccggttacccgttccccccgttacgggcccgtcccccg

SEQ ID NO: 37533 - DNA, 523 bp, Homo sapiens
  misc_feature: GYAE6OF02H52CL.53.33.C11.1.454.CMB.1.raw
  modified_base (268)..(268): a, c, t, g, unknown or other
  misc_feature (268)..(268): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaangatgcctattacgcagactcgtgaagggccgattcaccatctccagagacaattccaaagaacacactgtatctgacaaatggacagcctgagagctgaagacacggctgtgtattactgtgcgagtgagatgtcttactatgatgctagttggtttggtaccgttcgacccgtgggccgacgggaaccctggtcaccgtcctcctcacgctccaccgaacggcccacgtccggttcctccccgtcgccgtcccg

SEQ ID NO: 37534 - DNA, 581 bp, Homo sapiens
  misc_feature: GYAE6OF02IAITK.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacaactgtatctgacaaatgacagcctagagagctagaagacacggctgtgtatacgtgtgcgtagtgagtatgttcttactatgatcgaccgtaggttgggtttcggtacccgttccggaccccggttggggcccgtaacgggaacccgttagggtccacccggttctcccgtcgacgtcccttacccgaacccgacgggtaccctacgtacccggttccctttacccccgtcgggcccgtcccccgg

SEQ ID NO: 37535 - DNA, 621 bp, Homo sapiens
  misc_feature: GYAE6OF02GS9VC.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgacaaatggacagcctgagagctagaagacgacggctgtgtattactgtgcgtagtgagagtgtcttactatgtagtcgccgtaggttgggttttacggtaccggtttccgtaccccggttcgggggacccgtaaccggggtaaccccgttgggtacccgtacccggttcctacccgttccgaaccggttccctttaccccgaacccggtaaccggggacccctaaccggttcccgggttaccccttttaccccccggtcgggtaccccgtcccccgg

SEQ ID NO: 37536 - DNA, 582 bp, Homo sapiens
  misc_feature: GYAE6OF02JV3PT.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctatacgcagactccgtaggaacgggccgtatcaccatctacagagacaataccaagaacacactagtatctgacaaagtggacagacctagacgagacgtagaacgacacggctggtagtactactggtgacgagtagagtattgtacttactgtgtatgtactaggttcgggtttcggtacccggttccgaccccggttggggacccgtacgggacccttcgggtcctacccggttcctcccgtacgacgtccttacccgaacgtacggccctacgtcccggttcccttccccgtcgcccgtcccg

SEQ ID NO: 37537 - DNA, 540 bp, Homo sapiens
  misc_feature: GYAE6OF02ICCB4.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaaagaacacactgtatctgcaaatggacagcctgagagctagaagacacggctgtgtattactgtgcgagtgagattgtcttactatgatgccgtagttggtttacggtaccgttccgacccgtcggggccgacgggtaacccgtcggtctaccgtcctccgtcgacgctccgaccgaacggcccacgtccggtcctccccgtcggccgtcccg

SEQ ID NO: 37538 - DNA, 599 bp, Homo sapiens
  misc_feature: GYAE6OF02I9USY.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggatcgtctcaagtgtctacctttgcactgggtccgccaggctccaggcaaggggctggagtgggtggcacttatctcatctgatggaagagatgcctattacgcagactccgtaggaacgggccgtattccacctatcctaccgaaggacgaacaacttaccaaagaaacacactgtatctagacaaagtggacagccgtgagagcgtagaagacgacggtctagtgtaattacgtagtgcgagtgagtattgttacttactatgtatgtacgtaggttcgggtttcggtaccgttaccggtacccggtcggggccgtaaccgggaccgtcggttacccaccggttcctcccgtcgaccgtccgttaccgaaccgtaacgggccctacggttcccgtcccgttccccgtcggcccgtccccg

SEQ ID NO: 37539 - DNA, 590 bp, Homo sapiens
  misc_feature: GYAE6OF02G3S5U.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcgaaggggctggagtgggtggcacttatctcatctgagtggaagagatgcctattacgcagactccgtgaagggccgattcaccatctccagagacaagggttaccaagaacacactgtatctagacaaatggacacgcctagagagctagaacgacgacggctgtgtattacgtgtgcgagtgagattgtacttactatagatgcgtaggttgggtttcggttaccgttccggtaccccggtcggggacccgtaacgggtaacccgttcggtaccgtacccgtcctcccgtcgaccgtccttacccgaacccgaaccggtacccgtacgttcccggttcccgttcccccgtcggcccgtcccg

SEQ ID NO: 37540 - DNA, 533 bp, Homo sapiens
  misc_feature: GYAE6OF02FMUVE.53.33.C11.1.454.CMB.1.raw
  modified_base (411)..(411): a, c, t, g, unknown or other
  misc_feature (411)..(411): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccattcaccatctccagagacaattccaagaacacactgtatctgcaaatggacagcctagagagctgaagacacggctgtgtattactgtgcgagtgagatgtcttactatnatgccagttggtttcggtaccgttcggacccgtggggccacgggtaccctgggtccaccgtctcccgtcacgtccttccaccgaacggccctagtccggtccttccccgtggtcccgtcccg

SEQ ID NO: 37541 - DNA, 581 bp, Homo sapiens
  misc_feature: GYAE6OF02HX0KV.53.33.C11.1.454.CMB.1.raw
  modified_base (318)..(318): a, c, t, g, unknown or other
  misc_feature (318)..(318): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtggggtggcacttatctcatctgatggaagagatgcctattacgcagactccgtgaagggccgattcaccatctccagngacaattccaaagacacactgtatctgcaaatggacagcctgagagctgaagacacggctgtgtattactgtgcgagtgagatgtcttactatgatgcgtagttggtttcggtaccgttccggacccccgttcgggggcccgtaacgggaaccccgttcgggtacctacccggttccttccccgtcgtaccgtaccgttcccctaacccgaaccgggccccacgttcccggtcccgtttccccccgtcggtcccgtcccccgg

SEQ ID NO: 37542 - DNA, 526 bp, Homo sapiens
  misc_feature: GYAE6OF02FO2KO.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagattgtcttactatgatgctagtggtttggtaccgttcgacccgtgggccgacggaaccctggtccaccgtctccgtcacgtctccaccgacggccctacgtccggtccttccccgtcggccgtccccg

SEQ ID NO: 37543 - DNA, 573 bp, Homo sapiens
  misc_feature: GYAE6OF02I5IA9.53.33.C11.1.454.CMB.1.raw
  modified_base (254)..(254): a, c, t, g, unknown or other
  misc_feature (254)..(254): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacgttanctcatctgatggaagagatgcctattacgcagactccgtgaagggccgattcaccatctccagagacaattccaagaacacactgtatctgacaaatggacagcctagagagctgaagacacgactgtgtattactagtgcgagtgagatgtcttactatgatgacctaggttaggtttcggttaccggttccgtaccccgttgggacccgacgggtaaacccgtgggtaccgaccgttcctacccgtcgtacgtccttacccgaccgtaacggccccgtaacgtcccggtccgtttcccccgtggtccccgtccccgg

SEQ ID NO: 37544 - DNA, 517 bp, Homo sapiens
  misc_feature: GYAE6OF02FZ08P.53.33.C11.1.454.CMB.1.raw
  modified_base (268)..(268): a, c, t, g, unknown or other
  misc_feature (268)..(268): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaanagatgcctattacgcagactccgtgaagggccgattcaccatctccagagacaattccaagaacacactgtatctgcaaatggacagcctgagagctgaagacacggctgtgtattactgtgcgagtgagattgtcttactatgatgcctagtcggttgtaccgttcgacccgtgggccacgggaacctggtcacgtctcctcagcctccaccgaacggcccagtccggtcctccccgtggccgtcccg

SEQ ID NO: 37545 - DNA, 511 bp, Homo sapiens
  misc_feature: GYAE6OF02GGDJR.53.33.C11.1.454.CMB.1.raw
  modified_base (378)..(378): a, c, t, g, unknown or other
  misc_feature (378)..(378): n is a, c, g, or t
  modified_base (477)..(477): a, c, t, g, unknown or other
  misc_feature (477)..(477): n is a, c, g, or t
tcagcgcgtatacacacgaccggtgctcgatttagagtgagctcgttgagtttgggctgagctgggtttcctcgttgctctttaagaggtgtccagtgtcacgtgcagctggtgcagtctgggggagcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccattcaccatctccagagacaattccaagaacacactgtatctgacaaatggacagcctgagagctagaacgacacgctgtntattactgtgcgagtgagatgttacttactatgatgccaggttcggtttagtaccgttcgacccgtggggccacgggtacctggtccacgtcgtcctcncgctccacgacggccagtccgtcctcccgtgccg

SEQ ID NO: 37546 - DNA, 522 bp, Homo sapiens
  misc_feature: GYAE6OF02IZBGO.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgcagtggtttgtaccgttcgacccgttcgggccagggtaacccgtggtcaccgtctccgtcacgctccaccgaggcccacgtccggtccttcccccgtcggccgtcccg

SEQ ID NO: 37547 - DNA, 592 bp, Homo sapiens
  misc_feature: GYAE6OF02I1CMT.53.33.C11.1.454.CMB.1.raw
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
  modified_base (431)..(431): a, c, t, g, unknown or other
  misc_feature (431)..(431): n is a, c, g, or t
tcagcgcgtatacacacgaccggtgctcgatttagagtgagctcgttgggtttgggctgagcgtgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccnccaggctccaggcaaggggctggagtgggtgcacttatctcatctgatgganagatgcctattacgcagactcgtgaagggccgattcaccatctaccagagactaattccaagaaccacactgtatctgcaaaatggaacagcctgagaggctagaaagaccacggactgtagtattaacgtgtgacgagtgagtattgtcttacgtaatgagtnaccgtaggttggtttacgggtacccgttccgtaccccggtcggggccgtaaccgggaacctcgggtacctaccgtcctacccgtcgtacgtcccttaacccgacccgtaacgggaccctacgttacccggttcccttcccccggtggtccccgtaccccgg

SEQ ID NO: 37548 - DNA, 617 bp, Homo sapiens
  misc_feature: GYAE6OF02F6VIR.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattccaccatctccagagaacaattccaaagaacacactgtatctgacaaatggacagcctagagagctagaagacacggctgtgtattactgtgcgagtgagtattgtacttactatgatcgctaggttgggtttggtacccgttccggtaccccggttcggggacccgacggggtaaacccgttcgggtacccgtacccgttccgttcccgtaccgtaccggttacccttaccccgaacccgtaaccggggtccccgtaacggttccccgggttacccctttcccccccggttacgggtccccgttccccccgg

SEQ ID NO: 37549 - DNA, 589 bp, Homo sapiens
  misc_feature: GYAE6OF02I8TEK.53.33.C11.1.454.CMB.1.raw
  modified_base (316)..(316): a, c, t, g, unknown or other
  misc_feature (316)..(316): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctagtacgcagactccgtgaaggccgatcacatctaccaganacaattccaagaaccacactgtatctagacaaatggacagacctgacagcgtgaacgacaacggctgtagtagttactgtcgagagtgagatgtacttactatgtatcgctaggttcggtttacggtacccgttcggtaccccgttacggggaccgtaacgggtaacctcggtaccgacccgtccgtacccgtctaaccggtccttacccgaacccgaaccgggtacctaccggttcccggttaccccttcccccggtcggtccccgtccccg

SEQ ID NO: 37550 - DNA, 585 bp, Homo sapiens
  misc_feature: GYAE6OF02GKMHE.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtgggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtaggaagggccgattcaccatctccagagacaattaccaagaacacactgtatctagacaaatggacagcctgagagctagaacgacgacggctagtgtattactgtgcgagtgagattgtcttatatgatcgcgtagttgggtttacggttacccggttccggtacccggttggggacccgtaacgggtaacccgtcggtccgtacccgttcctaccgtctacgtccttacccgaccgtaaccgggaccctacgttcccggttcccctttcccccggtcggcccgtccccgg

SEQ ID NO: 37551 - DNA, 662 bp, Homo sapiens
  misc_feature: GYAE6OF02JYTYX.53.33.C11.1.454.CMB.1.raw
  modified_base (214)..(214): a, c, t, g, unknown or other
  misc_feature (214)..(214): n is a, c, g, or t
  modified_base (499)..(499): a, c, t, g, unknown or other
  misc_feature (499)..(499): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccnccaggctccaggcaaggggctggagtgggtgctacgttatctcatctgataggaagagatgaccttagttacgcagtaaccgtccggtaggaacggggtccgtacttaccgaacctactacctacccgaaggaacgtaacctaaacttacccgaaaagaaccaacctacgtagtaactcgtagaaccaaagttcggaacacgtacctagaagacgacgtagaaacgcgaacggcttagtagttaacttactggtacgacgtagtgagtatcggttactaacgttntgtatcgacgtaggttcggtttacgtaccggttccgtacccggtcggggtaccacgggtaaccctggtacctaccggtctacccggtcgtacgttacccgtacccgaaccggtaaccggtcccctaacgttcccggtacccttccccggtcggccctccccgg

SEQ ID NO: 37552 - DNA, 575 bp, Homo sapiens
  misc_feature: GYAE6OF02G8Y7X.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactggtccgccaggctccaggcaaggggctggagtgggtggcacttatctcatctgatggaagagatgcctatacgcagactccgtgaagggccgattcaccatctccagagacaattccaagaacacactagtatctgacaaatggaacagcctgagagctagaagacacggctgtgttattacgtgtgcgagtgagatgtacttactatgagtgccgtaggttggttttcggttacccggttccgaccccgttcggggtacccgacgggtaacccgtggtccgtaccgttccgtcccgtcaccgtccgttcccaaccgtaacgggaccccgtagttcccggttcccttcccccgtcggcccggtccccg

SEQ ID NO: 37553 - DNA, 613 bp, Homo sapiens
  misc_feature: GYAE6OF02HHTMN.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtcccttaaactctcctgtgcagcctctggattcgtctcaagtgtctaccctttgcactgggtccgccaggctccaggcaaggggctggagtgggtggcacttatctcatctgatggaagagatgcctattacgcagactccgtgaacgggccgattcaccatctccagagacaattaccaagaacacactgtactctgacaaatggaacagcctagagagctaggaaacgacgacggtctaggtgttaagttacgtgtgacgagtgagtatgttacttatatgtatgacctaggttgggtttacggttaccggttaccgtacccggtacggggacccgtaacggggtacccgttcggtccgtacccgttcctcccgttcgtaccgtccgttacccgaacccgaaccgggtacccgtaccgttaccggttccccgttcccccggtcggtccccgtccccgtccgg

SEQ ID NO: 37554 - DNA, 598 bp, Homo sapiens
  misc_feature: GYAE6OF02GGIJC.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtcccttaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgacaaatggacagcctgagagctagaagacacggctgtgtattactgtgcgagtgagatgtacttactatgatgcctaggttggtttacgggttacccggtttccgtaccccggtggggtacccgtaacgggtaaccccgtcgggttaccgtacccggttcctcccgtaccgtacgtccttacccgaacccgaaccgggtacccgtacgttcccgggttcccgttccccccgttcgggtcccgtccccgttccgg

SEQ ID NO: 37555 - DNA, 534 bp, Homo sapiens
  misc_feature: GYAE6OF02GIZMU.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccggtgaagggccgattcaccatctccagagacaattccaagaacacactgtatctgacaaagtggacagcctgagagctagaagacacggctgtagtattacgtgtgcgagtgagattggtacttactatgatgctagttggtttggtaccgttcgacccgtgggccacggacctgtccaccgtctcctcacgtcttaccaccgaacgggcccacgttccggtcccttccccgtcggccgtcccg

SEQ ID NO: 37556 - DNA, 592 bp, Homo sapiens
  misc_feature: GYAE6OF02GKJVB.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaaccacactgtatctgacaaatggacagcctgagagctagaagacgacggctgtagtattactgtgcgagtgagatgtacttactatgatgccgtaggttacgggttttcgggttacccgtttccggtaccccggttcgggggacccgaaccggggtaacccgttcggtacctacccggtccttcccgtccgtacgtcccttacccgaacccgtaaccgggccctacgttcccggttccctttcccccgtcggcccgtccccg

SEQ ID NO: 37557 - DNA, 627 bp, Homo sapiens
  misc_feature: GYAE6OF02GVIJE.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcgaaggggctggagtgggtggcacttatctcatctgatggaagagatgcctattacgcagactccgtagaagggccattcacctatctccgagagacaattaccaaagaacacactgtatctgacaaagtggacacgcctagagagcgtagaacgacgacgcgtgtagtagttacgtgtgacgtagtagagtagttcgttacttactagtagtagtcgtacgtaggttacgggtttacggtaccgttccggtaccccggttcgggtacccggtagggtaaccccccccggtggttacccgtaccgttccgttacccgtccggtaccgtcccgttacccgacccgtaaccggacccgtacggttacccgttccccgttccccgtacccggtcccgtccccgg

SEQ ID NO: 37558 - DNA, 632 bp, Homo sapiens
  misc_feature: GYAE6OF02I1VHY.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtaggaacgggccgtattccaccatcctccagacgaactaacttccaagaaccacactgtatctagacaaaagtggaacaggtcctggaacgagtctagggaaagaccgaacgggcgttacgttagttacttacgttgtaggtcgaaggttgagtattcgttactttacgtatagtagtcgacgtaggttcgggtttcggttaccggttccggtacccggtcggggtaccgacgggtaaccgtcggtacctaccgttccgtaccgtcgtacgcccttacccgaaccgaaccgggtaccctaccggttcccggttcccgttacccccgttcggacccgtcccg

SEQ ID NO: 37559 - DNA, 588 bp, Homo sapiens
  misc_feature: GYAE6OF02GY5ST.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcacatctccagagacaattccaagaacacactagtatctgacaaatggacagcctagagagctgaagacacggctgtgtattactgtgcgtagtgagtagttgtactttaactatagtatacgctaggttcgggttttacggtacccggtttccggaccccggttggggcccgtacgggaacccgtgggtacccaccgttcctaccgtccgacgtacccgttacccgacccgtaacgggcccctaagttcccggttacccttcccccgtcggcccgtacccccg

SEQ ID NO: 37560 - DNA, 534 bp, Homo sapiens
  misc_feature: GYAE6OF02GBDXY.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgacaaatggacagcctgagagctagaagacacggctgtgtattactgtgcgagtgagatgtcttactatgatgcctagtggtttggtacccgttcgacccgtgggccacggaaccctgtccaccgtctccgtcacgtcctacccaccgaacggccctacgttccggttccttcccccgtcggccgtccccg

SEQ ID NO: 37561 - DNA, 535 bp, Homo sapiens
  misc_feature: GYAE6OF02FYV3S.53.33.C11.1.454.CMB.1.raw
  modified_base (269)..(269): a, c, t, g, unknown or other
  misc_feature (269)..(269): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtggggtggcacttatctcatctgatggaanagatgcctattacgcagactccgtgaagggccgattcaccatctccagagacaattccaagaacacactgtatctgacaaagtggacagcctagagacgctagaaagacacggctgtagtattactgtgcgagtgagatgtcttatatgatgctaggttggtttcggtaccgttccgacccgttgggccgacggaccgtggtccgtaccgtcctccgtcacgtcctccaccgacggccacgtccgtactcccccgtggccctcccg

SEQ ID NO: 37562 - DNA, 648 bp, Homo sapiens
  misc_feature: GYAE6OF02IHM1N.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtgggtccagcctgggaggtccctgaaactctcctgtgcagcctctggattcgtctcaagtgtctacctttgcactgggtccgccaggctccaggcaaggggctggaggtggggtggcacttatctcatctgatggaagagatgcctattacgcagactccgtgaagggccgattcaccactctccagacgaacaattaccaagaacacactgtactctgacaatgacagcctagagagcgtagacgaacgacggtgtcgtgttaacttacgtggtagacgtagtggaagtagttcggtttactttacgttattgtaatcgggtaccgtagggtttgggttttaccgggttaccccggtttaccgggtaccccggttacggggacccggtaacgggtaaccccgttaggtacccgtaccgttccttcccgtccgtaccgtccgttaacccgaacccggaaccgggtccccacggttcccggttccccgtttcccccggtcggccccgttacccccgg

SEQ ID NO: 37563 - DNA, 687 bp, Homo sapiens
  misc_feature: GYAE6OF02JZGBA.53.33.C11.1.454.CMB.1.raw
  modified_base (215)..(215): a, c, t, g, unknown or other
  misc_feature (215)..(215): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctggggaggcgtggtccagcctgggaggtccctgaaactctcctgtgcagcctctggattcgtctcaagtgtcctaccctttgcacgtgggtccnccaggcctccgaggcgaaggggctggaggtgggtgctacttatctcatctgagtggaagagatcgtccttaagttaccgacaagtacctccggtaggaacgggccgtacgttccaacctatcctaccgaagtacgaactaacttacccgaaagaaccactacgtagtactctgaacaagtcgacagcctgaacgagacgtagaagaccgacggtctgtagttacgttacgtgttggacggtagtacgagtattacgttcgttaacgttagtgtaactcggaccgttaaggtttgggtttaccgggttaacccgttcccggtaccccgggttacggggtacccgaacgggttaaaccccgtcggtacccgtaccgttccgttcccgtacggtacttcccgttacccgaaccggaaccgggtacccgtaccggtacccggttcccgttcccccggtacggtccccgttacccgg

SEQ ID NO: 37564 - DNA, 642 bp, Homo sapiens
  misc_feature: GYAE6OF02HBVW9.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaagggggctgggagtggggtggcacttatctcatctgatggaagagatgcctattacgcagactcgtagaagggccattcaccatctccagagacaattccaaagaacacactgtatctgacaaatggacagcctgagagctagaagacacggctgtagtattacgtgtgcgtaggtagagtattgtactttaactatagtagtgaccgtaggtttgggtttacggtacccgtttccggtaaccccggttcgggggacccgtaaaccgggtaacccgttcgggtacccgtacccggttcctcccgttaccgtaccgttacccgtttaccccgaaaccccggtaaccgggtacccccgttaacggttccccgggtttaccccgtttccccccggtacgggtcccccgttcccccgg

SEQ ID NO: 37565 - DNA, 638 bp, Homo sapiens
  misc_feature: GYAE6OF02G66J7.53.33.C11.1.454.CMB.1.raw
  modified_base (271)..(271): a, c, t, g, unknown or other
  misc_feature (271)..(271): n is a, c, g, or t
tcagcgcgtatacacacgaccggtgctcgatttagagtgagctcgttgggtttgggctgagctgggttttcctcgttgctcttttaagaggtgtccagtgtcacgcgcagctggtgcagtctgggggaggcgtggtccagcctgggaggtccctgaaactctcctgtgcagcctctggattcgtctcaagtgtctaccctttgcacgtgggtccgccaggctccgaggcaaggggctgggagtgggtggcacttatctcatctgatggaanagatgcctatacgcagactccgtgaaggccgtattcaccatctccagagacaattaccaagaacacactgtatctgacaaagtgacagcctgagagctagaagtacacgtctgtagtatactagtgcgagtgagattgtacttaactagtgatcgactagggttacggtttttcgggtaacccgtttcccggaaccccggttgggggaacccgtaacggggtaaccccttggggtaccctaacccgggttcccttcccgtaccgtacggttcccctttaccccggaaacccggtaaccgggtacccccttaaccgggttaccggtttcccccctttaccccccggttacgggtcccgtaccccccgg

SEQ ID NO: 37566 - DNA, 625 bp, Homo sapiens
  misc_feature: GYAE6OF02GZW8O.53.33.C11.1.454.CMB.1.raw
  modified_base (460)..(460): a, c, t, g, unknown or other
  misc_feature (460)..(460): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggcctccaggcaaggggctgggagtgggtggcacttatctcatctgatggaagagatcgcctattacgcagactccggtaggaacgggccgtattccgacctatcctaccgagaacgactaattaccaaagaaccacactagtactactgacaaagtcggaacacgcctagagacgactaggaacgacgacggtactgtagttaattacgtgtagacgtagtgaagtgttagttcttaatagngtatcgtaccgtaggtttcgggttttccggtaccgttcccggtacccggtcggggacccgaacgggttacccgtgggtaccctacccgtcgtaccgtcgacgtcccgtaaccgaacccggtacgaccctcggttaccgtccccgtttcccggcgtccccgtcccg

SEQ ID NO: 37567 - DNA, 564 bp, Homo sapiens
  misc_feature: GYAE6OF02HIW66.53.33.C11.1.454.CMB.1.raw
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctgggaggtgggtggcacttatctcatctgatggaagagatgcctattacgcagactccgtgaacgggccgattcaccatcctccagacgacaattccaagaacacactagtactctgacaaatggacagcctgagagctagaagacacggntgtgtattactgtgcgagtganttgtcttactatgatcgcgtagttggtttcggtaccgttccggtacccggttgggggacccgggtaccctggtacctaccgtctcctcgtaccgtccttacccgaacgtaccgggccctacgttcccggtcccgttccccgtcgggccctccctcgg

SEQ ID NO: 37568 - DNA, 601 bp, Homo sapiens
  misc_feature: GYAE6OF02HG8GL.53.33.C11.1.454.CMB.1.raw
  modified_base (388)..(388): a, c, t, g, unknown or other
  misc_feature (388)..(388): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtggggtggcacttatctcatctgatgggaagagatgcctaattacgcagactcgtgaagggccgattcaccatctcagagacaattaccaagaacacactgtatctgacaaatggacagccgtagagagctagaagacgacggctggtntattatgtgcgagtgagtagttgttacttaactatgtatgtaccgtaggttagggtttcgggttacccgttaccggtaccccgttcggggacccgacgggtaacccgtcggtacccgtacccgttccttcccgtacgtaccgtaccgttcccgaaccgaaccgggtccctacggttcccggttacccgttcccccggtcggtccccgtccccg

SEQ ID NO: 37569 - DNA, 701 bp, Homo sapiens
  misc_feature: GYAE6OF02HAT0S.53.33.C11.1.454.CMB.1.raw
  modified_base (260)..(260): a, c, t, g, unknown or other
  misc_feature (260)..(260): n is a, c, g, or t
  modified_base (334)..(334): a, c, t, g, unknown or other
  misc_feature (334)..(334): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccgccaggctccgaggcgaaggggctgggaggtggggtggcacgttanctcatctgatggaagagatgcctattacgcacgactccggtaggaacggggccgattccacctatcctacaganacaattaccaaagaacacactgtaactctagacaaagtcggacacgacctgagacgactaggaacgacgacggtctgtagtattacgtgtgcgtagtagagtagttcgttacttactagtagtacgtacggtacgtaggtttcggggttttacggttacccgggtttacccgtaccccgggttccggggggacccggtaaacccggggtaacccggttaccgggttacccgtacccggttacccgttacccgttcccgtaccggttacccgtaaccccgtaaccccggtaacccgggtaccccgttaaccgggttcccccgtttccccggttttacccccccggttccgggtccccggttcccccgg

SEQ ID NO: 37570 - DNA, 655 bp, Homo sapiens
  misc_feature: GYAE6OF02G7BRL.53.33.C11.1.454.CMB.1.raw
  modified_base (409)..(409): a, c, t, g, unknown or other
  misc_feature (409)..(409): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccgaggcaaggggctggaggtgggtggcacttatctcatctgatggaagagatcgcctatacgcagactccgtggaaggccgattcacatctccagagacaatccgaagaacacactgtatctagacaaatggacagctagagagctagaagacgacggcgtgtagtagtacgtgtgacgagtgagtnttgtacttactagtgtatcgtacgtaggttacgggttttacggtacccggttaccggtaccccgggttacggggtacccggtaacggggtaaccccgttcgggtacccgtacccggttcccttacccgtccgttaacccggttaccccgtttaccccgaaccccggttaaccggggtacccccttaaccggttaccccggtttccccccggtttaccccccggttccgggtccccggttacccccg

SEQ ID NO: 37571 - DNA, 634 bp, Homo sapiens
  misc_feature: GYAE6OF02HC0H5.53.33.C11.1.454.CMB.1.raw
  modified_base (340)..(340): a, c, t, g, unknown or other
  misc_feature (340)..(340): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtcctaccctttgcactgggtccgccaggctccaggcgaaggggctgggaggtggggtggcacttatctcatctgagtggaagagatgcctattacgcagactccgtaggaacggggccgattcaccatctccagagacaattccaaanacacactagtatctacgacaaagtcggacagtcctagagagactagaagaccgacggcctaggttacgttaattacgttggtaggacgtaggtaggagtagttagttacttaactatgtagtgactaggttggtttacgggttacccgttccggaccccggttacggggaccgtaacgggtaacccgttgggtacccgtaccgttccgttaccgtccgacgtcccttacccgacccgaaccggccctaaccggttccggttaccccgtttcccccgtcggtaccccgtccccgg

SEQ ID NO: 37572 - DNA, 536 bp, Homo sapiens
  misc_feature: GYAE6OF02F9PDW.53.33.C11.1.454.CMB.1.raw
  modified_base (400)..(400): a, c, t, g, unknown or other
  misc_feature (400)..(400): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaaggccgattcaccatctccagagacaattccaagaacacactgtatctgacaaatggacagcctgagagctgaacgacacggctgtgtattactgtgcgagtgagntgtcttactatgatcgactagtggtttacggtaccgttccgacccgttgggcctacgggaccctcggtccaccgtctccgtcgacgtcctccgaaccgaccggcctacgtccgtccttccccgcggtccgtccccg

SEQ ID NO: 37573 - DNA, 611 bp, Homo sapiens
  misc_feature: GYAE6OF02GF2UF.53.33.C11.1.454.CMB.1.raw
  modified_base (256)..(256): a, c, t, g, unknown or other
  misc_feature (256)..(256): n is a, c, g, or t
  modified_base (357)..(357): a, c, t, g, unknown or other
  misc_feature (357)..(357): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccgaggcgaaggggctggagtgggtggctacttanctcatctgatggaagagatgcctattacgcagacctccgtggaacgggccgattccgaccatcctccagacgactaattccgaaagaacacactgtatctnacaaatggacagcctagagacgctaggaacgacgacggtcgtgtagttattacgtgtgacgtagtgagattgttacttactatgatgacgtaggttgggtttacggttaccggtttccggtaccccggtcggggacccgaacgggtaacccgttcgggtacctacccgttcctcccgtccgtacgtcccgttacccgaacccgtaacgggaccccgtacggttcccgttccctttcccccgtcggcccgtcccg

SEQ ID NO: 37574 - DNA, 638 bp, Homo sapiens
  misc_feature: GYAE6OF02HODMO.53.33.C11.1.454.CMB.1.raw
  modified_base (269)..(269): a, c, t, g, unknown or other
  misc_feature (269)..(269): n is a, c, g, or t
  modified_base (334)..(334): a, c, t, g, unknown or other
  misc_feature (334)..(334): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggctacttatctcatctgatggaanagatgcctattacgcagactccgtgaagggccgattcaccatctccagagacaattccaagaacncactgtatctgacaaatggacagcctagagagcgtagaagacacggctgttagtaattacgtgtgacgtaggtgagattggtcttaacttatgtatgccgtaggttcggtttacgggtaccggttcccggtaccccggtcgggggtacccgaaccggggaaaccccggtttcgggtacccgtacccggttccgttaccccgttcgaacccgttccgtttaacccccgaacccgtaacccggggaccccctacgttccccgggtttcccccgtttccccccgttacggggtccccgtacccccgg

SEQ ID NO: 37575 - DNA, 646 bp, Homo sapiens
  misc_feature: GYAE6OF02IPLLC.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtcttaccctttgcactgggtccgccaggctccgaggcaaggggctggagtggggtgcacttatctcatctgatggaagagatgcctattacgcagactccgtgaagggccatcaccatcctccagacgaacaattccaagaacacactagtactctagacaaatggactagcctaggacgtagacctaggaaacgacgacggtctgtgttacttaacgtgtgcggtaagtgagtgttgtcctttaactagttcgatcggacgtaaggtttgggtttcggtttaccgtttaccggccccggttagggaccccgtaacggggtaacccttggggttaccctaccggttcctaccccgttcgaaccggttcccgtttaccccgaacccggtaacgggtacccccttaacggttcccgggttcccccttcccccggttacgggccccggttacccccg

SEQ ID NO: 37576 - DNA, 605 bp, Homo sapiens
  misc_feature: GYAE6OF02JEZ8W.53.33.C11.1.454.CMB.1.raw
  modified_base (214)..(214): a, c, t, g, unknown or other
  misc_feature (214)..(214): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccnccaggctccaggcaaggggctggagtgggtggcacttatctcatctgatggaagagatgcctattacgcagactccgtgaagggccgattcaccatctaccagagacaattccaaagaacaacactgtatctagacaaagtggaacagcctagagagctagaagacgacggctgtgtatactgtgcgagtgagtattgtacttatagtagtatcgacgtaggtttcgggtttcggttacccggttccggaccccggttcgggggaccgaacggggtaaccctcggtacctaccgttcctcccgtaccgtacgtcccgttacccgtaacccggaaccgggtccccgtacgttcccggttacccctttcccccggtcgggccccgtaccccgg

SEQ ID NO: 37577 - DNA, 606 bp, Homo sapiens
  misc_feature: GYAE6OF02F91OR.53.33.C11.1.454.CMB.1.raw
  modified_base (375)..(375): a, c, t, g, unknown or other
  misc_feature (375)..(375): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccgaggcaaggggctggaggtggggtggcacttatctcatctgatggaagagatgcctattacgcagtacctccgtaggaacgggtccgattcaccagtcctaccagacgaactaacttaccaaagaacacactgtatctgacaaagtggaacncgcctagagagcgtagaacgacgacggctgtagtattagtgtgcgtagtgagagttgtacttactattgtactggccgtaggttggtttacgggttacccgttaccggtaccccggttcggggacccgtacgggtaacccgtacgggtacctaccgtaccgtccgtctacgtccctaccgaccgtaacggccctacggtcccggttccctcccccgtcggcccgtccccgg

SEQ ID NO: 37578 - DNA, 672 bp, Homo sapiens
  misc_feature: GYAE6OF02GWBL6.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccgaggcaaggggctgggaggtggggtggcacgttatctcatctgatggaagagatgcctagttacgcacgacttccggtaggaacgggccgtattccacctagtcctaccgagacgacaacttaccaagaacactacgtgtactactagactaaagtaggacacgacctagagagctacgaagacgacgacgttggtagttacttacgtggtagcggtaggtgagtacgttcgttacttacgtatagtactcgtaccgtgggtttacggtttcgggttacccgttaccggtacccgggtacggggtacccgtacgggttaacccgtcgggttacccgtacccgtcccgttaccgtccgtaccgttccccgtaaccgtacccgggtaaccggtaccccgttaccggttaccccggttccccgtttcccccggtacgggtccccgtccccgg

SEQ ID NO: 37579 - DNA, 723 bp, Homo sapiens
  misc_feature: GYAE6OF02H5PTI.53.33.C11.1.454.CMB.1.raw
  modified_base (115)..(115): a, c, t, g, unknown or other
  misc_feature (115)..(115): n is a, c, g, or t
  modified_base (172)..(172): a, c, t, g, unknown or other
  misc_feature (172)..(172): n is a, c, g, or t
  modified_base (263)..(263): a, c, t, g, unknown or other
  misc_feature (263)..(263): n is a, c, g, or t
  modified_base (411)..(411): a, c, t, g, unknown or other
  misc_feature (411)..(411): n is a, c, g, or t
  modified_base (457)..(457): a, c, t, g, unknown or other
  misc_feature (457)..(457): n is a, c, g, or t
tcagcgcgtatacacacgaccggtgctcgatttagagtgagctcgttgggtttgggctgagcggtggtttcgcgtaggctctttaagaggtgtccagtgtcacgtgcagctggtncagtcgtgggggagcgtggtccagcctgggacggtccctagaaactctcctgacgcngccttgtggacttcgtcttacgaagtcggttaccttaccctttggactacgtcggggtcccaccgaggtcctcgaggaccggaacggggtnttagggaggttcggggtcgactaacgtttatcctcgtagttctggagtaacgggaagtggaactcggaccttacgtttacggctactaacgtccggtaggacgggtctacgtaccactacgtccaccagacaactacttacaacaacncacgtagtacgtacacgactaagtcggaacacgtccgagagtacgngacgaacgtacgcggtatggtacttagttctaggtacgaggatgaagttcgtacgtttactaacgtagttagacgttacgacgttcgggttttcgggttaccgttaacccggttacccggtacccgggtacggtaccccgggtaacggttaacccgtcgggtaacccttccgtacccgtcccgtgtacccgtttccgtaacccgaaccggttcccggtacccgttcggtaccccggttccccggtaccgtccggtcccgtaaccgg

SEQ ID NO: 37580 - DNA, 565 bp, Homo sapiens
  misc_feature: GYAE6OF02HFUAK.53.33.C11.1.454.CMB.1.raw
  modified_base (255)..(255): a, c, t, g, unknown or other
  misc_feature (255)..(255): n is a, c, g, or t
  modified_base (418)..(418): a, c, t, g, unknown or other
  misc_feature (418)..(418): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaagggggctggagtggggtggcacttanctcatctgatggaagagatgcctattacgcagactccgtgaagggccattcaccatctccagagactaacttccaaagaaccacactagtaatctgactaaaagtggaacaggcctaggagacgctagaagaccgacggctgtgtattactgtgcgagtgagntgttcttactagtgatcgctagttacgggtttcggtaccgttccgtacccgtcggggccgtacgggaccgtcggtccgaccgtctccgtcacgtccttccgaccgacggcccacgttcccggtcccttccccgtcggtcccgtcccg

SEQ ID NO: 37581 - DNA, 699 bp, Homo sapiens
  misc_feature: GYAE6OF02HDREO.53.33.C11.1.454.CMB.1.raw
  modified_base (270)..(270): a, c, t, g, unknown or other
  misc_feature (270)..(270): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (399)..(399): a, c, t, g, unknown or other
  misc_feature (399)..(399): n is a, c, g, or t
tcagcgcgtatacacacgaccggtgctcgatttagagtgagctcgttgggtttgggtcgtgagctggtttccttcgttgtctctttaagtaggtgtccagtgtcacgtgcagctggtgcagtcgtggggaggcgtggtccagcctgggacgtccctgaaactctcctgtcgcagcctgtggtattcgtctcaagtcgtctaccttgcacgtcgggtcccaccgaggcctaccgaggcgaagggggcttggaagtggggtgcctaagtttnctacatctgaagtggaaagtagatcgaccttagtaacgcacgtaacgtccggtagaacggcctactcgacactcacaganaactanaccaagaacncgtactagtctcgtanaacgtaaagtcgaaacncgtccgtaagacgaggtaccgtagaaacgtacgaccgtatcggtaatttctaacggtcgtagcgtaacgggtagagtacgttagtttacttactagtagtacgtcggtacgtacgggttttacggttacggttacccgttacccggtacccgggttccgggaaccgtaaacgggaccccttacggacgtccccgttaacgttcccgtaaactcccggttcccgtaaaccggtcccgaaaccgggtccccttaacccggttccgttaccccccgttttaccggccccggtaccttccccgg

SEQ ID NO: 37582 - DNA, 653 bp, Homo sapiens
  misc_feature: GYAE6OF02IFHX9.53.33.C11.1.454.CMB.1.raw
  modified_base (467)..(467): a, c, t, g, unknown or other
  misc_feature (467)..(467): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggcctcaggcaagggggctggaggtggggtggctacttactctcatctgagtaggaagagatcgctattacgcagactccgtaggaacgggcgtattccactatcctacagacgactaacttaccaaagaacaacactagtactctagactaaatacggaacacgtccgtagacggagtacgtaggaacgacgtacgggtcttaggtacgttacgttactggtacgcgtaagtgagtattcgttacttanagttagtactcggtactaggtttcgggtttaccgttaaccggttccggtacccgggtacgggtaccggtaaccgggtacccgtcggtacccgtaccgtccttcccgtacgtaccgtacccgtaacccgaccggtaaccgggtccctaacggttcccgtaccccgttcccgtccgggtccctacccg

SEQ ID NO: 37583 - DNA, 627 bp, Homo sapiens
  misc_feature: GYAE6OF02ITIT6.53.33.C11.1.454.CMB.1.raw
tcagcgcgtatacacacgaccggtgctcgatttagagtgagctcgttgggtttgggctgagctgggttttcctcgttgctcttttaaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcgaaggggctggagtgggtggcacttatctcatctgatggaagagatgcctagttacgcagacgtccgtggaacgggccgtattcacctatcctaccagaagaacaacttaccaaagaaccacactagtatctagacaataggacacgctagagagctagaacgacacggtcgtgtagtatttacgtggtagcggtagtagtagagttcgttacttacttagtagtagtcgtacgtagggtttcgggttttaccggtacccggtttacccggacccggttcggggacccgtaacgggtaacccgtggtaccctacccgtcgtcccgtacgtaccgtccttacccgaacccgtaccggtaccctacggttcccggtacccgttccccggtcggccctcccg

SEQ ID NO: 37584 - DNA, 560 bp, Homo sapiens
  misc_feature: GYAE6OF02F22SZ.53.33.C11.1.454.CMB.1.raw
  modified_base (382)..(382): a, c, t, g, unknown or other
  misc_feature (382)..(382): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccattccaccatcctccagacgactaattccaagaacacactgtatctgacaaagtggaacagcctgagagctagaagcacggntgtagtattacgtgtgcgagtgagtagttgtacttatatgtagtcgcgtaggtttggtttacgttacccggttccgtacccggtcggggaccaacgggtacccgtgtccgtaccgtcctccgtcgacgttcctcccgaacgaccggccctacgtcccgtccttccccgtgccctcccg

SEQ ID NO: 37585 - DNA, 622 bp, Homo sapiens
  misc_feature: GYAE6OF02JYV5G.53.33.C11.1.454.CMB.1.raw
  modified_base (441)..(441): a, c, t, g, unknown or other
  misc_feature (441)..(441): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagggcgtggtccagcctgggaggtccctgaaactctcctgtgcagcctctggtattcgtctacaagtgtctaccctttgcactgggtccgccaggctccgaggccgaagggggtctgggagggtggggtcggctacgtttatcctcctagttctggatgggaagaggatggcccttaattacgcagtacctaccggtggaacggggcctaattccaacctagtcctaccgagacgacaacttaccaaagaccactacgtgtatctagactaaagtcggacagcctagacgacgcgtagaacgacgtaccggtntcggttatagttcgtgtgacgtagtgagngttntcttagtntgatcgacgtaggttggtttacgtcccgttacggcccggtgggtaccgtacgggtaccgtcgtaccgccgtctaccgctcgacccttaccgaaccgacgggtcctaccggtccgttcccgtacccggtcgacccgttccg

SEQ ID NO: 37586 - DNA, 721 bp, Homo sapiens
  misc_feature: GYAE6OF02GTB50.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctggggggaggcgtggtccagcctggggaggtccctgaaactctcctgtgcagcctctggattcgtctcaagtgtcttaccctttgccacgttcggggtccgccaggcctccgagggcgaaggggctggaggtggggtggctacttatcctcatctgatggaagagatgcctattacgcagactccggtaggaaggggccgattccaccatcctccagagaacaattaccaaagaaccacactagtatctgacaaatggaacacgcctagagagactaggaaacgacgaacggcttggttagttattacgtaggtcgtacggtagtcggaagtacgttgttacctttaactattagtaatcggtcccgttagggtttacgggttttccgggtttaaccccggttacccggtaccccgggttaccgggggacccggtaaaccggggtaaccccgttcggggttaccccgtacccgtttaccgttaccccgttacgacccggttcccgtttaccccggaaaccccggtaacggggtacccccttaaccggtttcccgggttccccccgttttacccccggtccggggtacccccttcccccgg

SEQ ID NO: 37587 - DNA, 735 bp, Homo sapiens
  misc_feature: GYAE6OF02HAVLA.53.33.C11.1.454.CMB.1.raw
  modified_base (424)..(424): a, c, t, g, unknown or other
  misc_feature (424)..(424): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtctaccctttgcacgtgggtccgccaggcctccgaggcgaaggggctgggaggtgggtggctacttatctcatcgtgagtaggaagagatcgtacctattacgcagtacgtccggtaggaacgggccgtacttacaccactcctaccgagaacgaactaacttaccaaagaaccacactagtatcgtagaactaagtagacagacgtagagacgctacgaagacgacggtntacgtagttaattacgtggtacgacggtagtagaagttaagttcgttactttacgtaagttgaacgttccgtacgttaagggttttcggggtttaacccggttacccgggttcccggtaaccccggggtcgggtaaccccggtaaaccgggttaaccccgttcgggtaccccgtaccccgtttcccggtaccctttaacccggaccgttaacccccgttacccccgaaaaccgggtacccgggtaccccctaccggggttttccccggtttccccccgtttaacccccggtccgggtccccttacccccgg

SEQ ID NO: 37588 - DNA, 529 bp, Homo sapiens
  misc_feature: GYAE6OF02GYQJI.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggcctccaggcaaggggctgggagtgggtggcacttatctcatctgatggaagagatgcctattacgcagactccgtgaaggccgattcaccatctcagagacaattccaagaacacactgtatctgacaaatggacagcctgagagctagaagacgacggctgtagtattactgtgcgagtgagatgtctatatgatgctggttggttcggtaccgttccgacccgtgggccgtacggacctcggtcaccgtctccgtcacgtcctccgaccgacgggccctacgtccgtccctcccgtcggccgtccccg

SEQ ID NO: 37589 - DNA, 534 bp, Homo sapiens
  misc_feature: GYAE6OF02H0GI5.53.33.C11.1.454.CMB.1.raw
  modified_base (267)..(267): a, c, t, g, unknown or other
  misc_feature (267)..(267): n is a, c, g, or t
  modified_base (417)..(417): a, c, t, g, unknown or other
  misc_feature (417)..(417): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtcccctaaactctcctgtgcagcctctggattcgtctcaagtgtctacctttgcactgggtccgccaggctccaggcaaggggctggagtgggtggcacttatctcatctgatggaanagatgcctatacgcagactccgtgaagggccgattcaccatctccagagacaattccaagaacacactgtatctgacaaatggacagcctgaagagctagaacgacgacggctggtgtattactgtgcgagtgagatgttacttatagtnatgctaggttggttcgtaccgtcgacccgtggggccacgggaccctggtccaccgtctcctcgcgtcctaccgaccgtaacggcccacgtccggttccttccccgtcgccgccctcg

SEQ ID NO: 37590 - DNA, 840 bp, Homo sapiens
  misc_feature: GYAE6OF02H1ZCD.53.33.C11.1.454.CMB.1.raw
  modified_base (149)..(149): a, c, t, g, unknown or other
  misc_feature (149)..(149): n is a, c, g, or t
  modified_base (181)..(181): a, c, t, g, unknown or other
  misc_feature (181)..(181): n is a, c, g, or t
  modified_base (268)..(268): a, c, t, g, unknown or other
  misc_feature (268)..(268): n is a, c, g, or t
tcagcgcgtatacacacgaccggtgctcgatttagagtgagctcgttgggtttgggctgagcgtggttttcgtcgttaggctcttttaagaggtgtcagtgtcacgtgcagctggtgcagtcgtgggggaggcgtggtccagcctgggnggtccctgaaactctcctgtgcagcctctggnttcgtctcagtgtcttacccttgcactgggtccgctagggctccgaggcgaagggggctggggagtggggtggactacttactcctnaactcgtgtaagagggtaagcggtaagtcggtaaccttaacgtttaacggactaacggtaacccgtttcccggtaaggggaaaccggggttccggtaacgttttcccgaccctacgttccccttaccggaaggtaacgaaccgttaaacttaacccgaaaggaaaccctaacttaccgttacggttaactaccgtttacaaccgtaaaggtaccgggaaacctacggttaccgtagggtaacggaacggtttacgaaacgggtaacggaaccgtaacgggtccgttagggttttaacgttaacgtttcgtacggttacgggtacggtaggtacgggtaagttacgttcggtttacgtttaacgttacgtacgtaaggttcggtacgtttacggtttcgggttttaccggtaccgtttacccgggacccgggtttaccgggcccgggtaaaccgggaacccgttcggggtaccctacccgttaccgttcctccggtaaccgtcccgttacccgaccggtaacccgggtaccttaccggtacccgttcccgttccccggtccggtcgtccccgg

SEQ ID NO: 37591 - DNA, 639 bp, Homo sapiens
  misc_feature: GYAE6OF02G8VXC.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctggggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtaggaacgggccgattacaccatcctccagagacaattaccaagaacacactgtactctagcaaagtggaactagcctgagagcgtagaacgacacggctgtgtattacgtgtgcgtaggtgagtagtagttcttactatgtatcgacgtaggttcgggttttacggtacccgtttaccggaccccggttcggggacccggtaacgggtaaccccgttcgggtacccgttacccggttcctacccgtacgtaccgtacccgtttaccccgaacccggtaaccgggtacccccgtaacggttcccggttacccccgtttccccccggtccgggtaccccgtcccccgg

SEQ ID NO: 37592 - DNA, 562 bp, Homo sapiens
  misc_feature: GYAE6OF02HD6E1.53.33.C11.1.454.CMB.1.raw
  modified_base (214)..(214): a, c, t, g, unknown or other
  misc_feature (214)..(214): n is a, c, g, or t
  modified_base (318)..(318): a, c, t, g, unknown or other
  misc_feature (318)..(318): n is a, c, g, or t
  modified_base (378)..(378): a, c, t, g, unknown or other
  misc_feature (378)..(378): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtcccttaaactctcctgtgcagcctctggattcgtctcaagtgtctaccctttgcactgggtccnccaggctccaggcaaggggctggagtgggtggcacttatctcatctgagtggaagagatgcctattacgcagactccgtgaagggccattcaccatctccaganacaattccaagaacacactgtactctagacaaagtggaacacgcctagagagctaggaanaccgacggcgtgtgtattacgtgtgcgtagtgagtagtgttacttatatgactgcgtgttggtttacggttccgtaccggtcccggtcggggcccgacgggacctcggtactaccgtctcctcgcgtcctccaaccgacggtaccctcgttaccggtcccttccccgcggtcccgtccgtccgg

SEQ ID NO: 37593 - DNA, 656 bp, Homo sapiens
  misc_feature: GYAE6OF02F3XRZ.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtccttaccctttgccacgtggggtcccgccaggcctccgaggcaaggggctggagtgggtgcacttatctcatctgatggaagagtatcgtacctaattacgacaggaaccttccggtaaggaacgggccgtattaccaccgtatcctaccgagaacgtaactaattaccaaaagaaaccactaaccgtagttaactactagtaactaaaagtggaacagccctaggaagacgagtacgaagaccgacggctgtagtaactttacgtggtagacgtaggtagagtagttcgtacttattaagtgatcgtacgtagttgggtttaccgtacgtccgacccggtcgggactaaccgggaaccttcggacctcccgtacttccgtacgacgtacccgttcccaaccggtaaccggccccttaacggtcccgtttacccccgttaccccgtcgggtacccctcccgg

SEQ ID NO: 37594 - DNA, 627 bp, Homo sapiens
  misc_feature: GYAE6OF02GKQ4S.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtggggtggcacttatctcatctgatggaagagatgacctattacgcagacctccgtaggaacgggccgtatccaccatcctaccagagacaatccaagaacacactgtatctagacaaagtggacacgcctagagacgcgtaggaaacgacgacggcgttagtgtatttacgtggtagacggtagttagagtagttcgtacttatatgagtcggaccgtaggtttcgggtttaccgggtacccgtttccggtaccccggttgggggaacccgtaacggggtaaccccgtcggtaccctaccgttcctacccgtcgacggttcccttacccgaaccgtaccgggtaccctacggttcccggtccccttccccggtcggcccgtaccccg

SEQ ID NO: 37595 - DNA, 550 bp, Homo sapiens
  misc_feature: GYAE6OF02GF0XG.53.33.C11.1.454.CMB.1.raw
  modified_base (318)..(318): a, c, t, g, unknown or other
  misc_feature (318)..(318): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccaganacaattccaaagaacacactgtatctgcaaatggaacagcctagagagctagaacgacgacggctgtgtattactgtgcgagtgagatgtcttatatgatgctaggttggtttcggtaccgttccgaccccgttggggccgacgggtaaccctcggtccaccgtcctccgtcacgtcctaccaccgaacgggtcccacgtcccggttcccttaccccgtcggcccgtccccg

SEQ ID NO: 37596 - DNA, 556 bp, Homo sapiens
  misc_feature: GYAE6OF02FGVP4.53.33.C11.1.454.CMB.1.raw
  modified_base (358)..(358): a, c, t, g, unknown or other
  misc_feature (358)..(358): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccggtgaagggccgattcaccatctccagagacaacttccaagaacacactgtatctgacaaatggaacngcctgagagctagaacgacgacggctgtgtattactgtgcgagtgagtattgtacttactatgatcgcgtaggttgggtttcggtaccgttccgtacccgtcggggccgacgggacccgttcgggtcctaccgtctccgtcacgtccttccgaccgacggccctacgtcccggttccttccccgtcggtcccgtcccg

SEQ ID NO: 37597 - DNA, 710 bp, Homo sapiens
  misc_feature: GYAE6OF02I3PHM.53.33.C11.1.454.CMB.1.raw
  modified_base (260)..(260): a, c, t, g, unknown or other
  misc_feature (260)..(260): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggagcgtggtccagcctgggaggtccctgaaactctcctgtgcagcctctggattcgtctcaagtgtcttaccctttgcacgtgggtccgccaggctccgaggcaaggggctgggagtggggtcgcacttatctnatctgaatggaagagatcgccttaatcgcagtaccttccggtaggacgggcctattccacctatcctaccgagacgacctaattaccaaagaacacacgtgtaatccgtagacctaaagtcggaacacgcctaggacgtacgctaggaaacgacgaccggtacttaggtagttaagtttacgtggtacgacggtaggttacgaggtattacgttaccgttaactagttagtacgttaggtaccgttgggttacgggttttacgggtacccgtttaccggaccccgggttaccgggggaacccgtaaccgggggttaacccgtacgggttcccacccggtttccgttaccggtacgttaccggtaccctttacccggaacccggttaacccgggtaccctaccgggttacccggttccccgttacccccggtccggtaccccgttccccgg

SEQ ID NO: 37598 - DNA, 648 bp, Homo sapiens
  misc_feature: GYAE6OF02IHR8Y.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctagttacgcagactccgtgaagggccattccaccatcctccagacgacaattccaagacacactgactctagacaaatggacagcctagagagctagaacgcacggctgtgtattacgtgtgcgtagtaggagtattcgtactttaacttacgtagtagtacgtccgtagggtttacgggttttacggttacccggtttcccggtaccccggttacgggggtacccgtaaccggggtaacccgttcggtacccgtacccggttcccgttcccgtccgtaccgttacccgttacccgaaccccggaacgggtaccccctaacggttccccggtttaccccgtttccccccggtaccgggtcccgttacccccgg

SEQ ID NO: 37599 - DNA, 724 bp, Homo sapiens
  misc_feature: GYAE6OF02JVXZW.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtcttacctttgcactgggtccgccaggctccgaggcgaacggggctgggaggtgggtcggctacgttatctcatctgagtaggaagagagtcgtaccttaagtaccgctaacggtaccttaccggaggtaaacggggaccttaacgttaccaacctattacccgtacgaacgtaacgtaaactaaacgttaacccaaaacggaaaccctaaccgtacttacggttaatccgtacgaaactaaaacgttcggaaaccgtaacggtacgtagtacggaacgtctaagggaacgtaccgacggtatttacgtagtttactagtgtaggacgtaggtacggtataacgttcttacgttatagttagtgtacggtaccgttaggtttaccgggttacggttacccgtaccggtacccgtacgggaccgtacgggtaccgtcgtaccctcggtcctaccgtcgtaccgttacccgtccgtaaccggtaccgtacccgttacggttcccgttaccccgtaccggtccggtccccgtccg

SEQ ID NO: 37600 - DNA, 865 bp, Homo sapiens
  misc_feature: GYAE6OF02GAEMH.53.33.C11.1.454.CMB.1.raw
  modified_base (253)..(253): a, c, t, g, unknown or other
  misc_feature (253)..(253): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtgctacttancctatactcgtagagtaggaagagtagtcgtactaacgtacgacgacgtaccgtcggtaggacgggtacgtactaccactactcctacgagaacgaacttaactaacgaaacgaaccactacgttagtaacttctacgaactaacggtacgaacgacgtacgtaaggacgtacgtacgtaacggaaaccgacggtacggtacgttacggttaagtttaacgtttaacggttgggtccgggtaacgggtaacgggttaacggtaacgttaaggttttaccgttttaacccgtttaaacgtttaggttaacgtacgttacccggttaccgggtttaggggttttaccgggggtttttaacccggtttacccccggggtttaacccccggtaccccggggggttaacccgggggaacccgggttaaaacccccggggtttaacccgggttccggttaacccccgggtacccctttccccggtaaccgttaaccggtaccccgtttaccccggtaaacccccggtaaaccgggtaccccggtaaccccggtttacccgggttcccccgggtttacccccccgtttacccgggtccccgggtcccccttaccccggg

SEQ ID NO: 37601 - DNA, 628 bp, Homo sapiens
  misc_feature: GYAE6OF02GGH6N.53.33.C11.1.454.CMB.1.raw
  modified_base (214)..(214): a, c, t, g, unknown or other
  misc_feature (214)..(214): n is a, c, g, or t
  modified_base (474)..(474): a, c, t, g, unknown or other
  misc_feature (474)..(474): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccnccaggctccaggcaaggggctggagtgggtgctacttatctcatctgatggaagagatgcctaagttacgcagacgtccgtaggaacgggcctattccacctatcctaccaagacgaactaacttaccaaagaaccacactagtactcgtacgacaaagtcgaacacgccgtagaacgagactagaaacgacgacggtctaggttagtaacgtttacgttggtcgacggtaggtacggagtattcgttactttacgtagngtatcgaccgttaggtttcggtttcggtaccgttccggtacccggtgggacccgtacgggtaccgtggtacccgtaccgtctaccgtcgaccgtcctacccgaaccgacggtaccctacggtcccggttccctccccggtcggacccctcccgg

SEQ ID NO: 37602 - DNA, 749 bp, Homo sapiens
  misc_feature: GYAE6OF02IDE61.53.33.C11.1.454.CMB.1.raw
  modified_base (217)..(217): a, c, t, g, unknown or other
  misc_feature (217)..(217): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctctaagtgtcctacctttgcacgtcgggtccncaggcctaccgaggcaaggggctagggagtgggtcgactacttatcctacattccgtagtagtagggaaagagtagtacgaccttaacgttacgaccgtaacggtaccgtccggtaaggaacggggtccgtaacgtttacccaaccgtacttacctacccgtaaggaactaactaaacttacccgaaaagtaaccaacctaacgtattacgtcgtagtaacgaaagtcggacaacgtccgtagtaagacgtagtacggaacgtaccgacgtcgtaggttgttaacgttacgtggtacggacggtagttaggaagttacgttacgtttacttactagtacgtaagtccgtaacggttaggttttacgggttaccggtttacccggtacccgggtacccggtacggggtacccggtaacggttaaccccgttcgggtacccgtaccgtccgttcccgtaacggacgttccctaacccggaacgtacccggtcctcggttacccgttccccggtttcccgaccggtccgtacccg

SEQ ID NO: 37603 - DNA, 598 bp, Homo sapiens
  misc_feature: GYAE6OF02H0HCS.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctcaggcaaggggctggagtggggtggcacttatctcatctagatggaagagatgcctattacgcagactccgtaggaacggggccgtattccacctatcctaccagacgaactaattaccaaagaacaacacttagtaactcgtagacctaaaagtcggaacacgtacctaggagagctaggaacgacgacggactgtagttattactggtgacgtagaggatagtcgttacttactatagatcgtcgtaggttaggtttacggtaccgttaccgtacccggtgggaccgacggtaaccgtggtacctaccgtctcgtctacgtacctaccgaccgacggtccgtacgtcccgttaccgttccccgtcggccgtcccg

SEQ ID NO: 37604 - DNA, 677 bp, Homo sapiens
  misc_feature: GYAE6OF02JEQ9P.53.33.C11.1.454.CMB.1.raw
  modified_base (252)..(252): a, c, t, g, unknown or other
  misc_feature (252)..(252): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtgcacttanctcatctgatggaagagatgcctattacgcagactccgtaggaacggccattcaccatctaccagagacaattccaaagaacactactgtactctgacaaatggaacagcctagagagactaggaagacgacggacgtgtagttaacgtttacgtgtgacggtagtaggaagtagttacgttacctttaacgtagttgtacgtcggtacccgttaagggtttcgggttttacgggttacccggtttacccggtacccccgggttacgggggaccccggtaaaccggggtaaccccgttcgggtaccctacccggttcccgttacccgtccgtaccggttcccgttaacccgaaccccgggtaaccggtcccccgttaacggttccccggttccccgtttcccccggttccggacccccgtccccg

SEQ ID NO: 37605 - DNA, 689 bp, Homo sapiens
  misc_feature: GYAE6OF02INUUO.53.33.C11.1.454.CMB.1.raw
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtcctacctttgcacgtgggtccgccaggctccgaggccgaaggggctgggagtgggtggctacttanctcgatctagagtggaanagatgaccttattacgcganaccgttcggtaggaaacgggcctacttccaacctcgtacctacgaacgtagaaactaacttaccaaacgtaaccacaacgtagtacttactagtaacaaacgtggaacaacgtccgtagacgtagtcgtagaacgacgtaacggcttgtagtaattcgtgtacgacggtagtaggagtagttacgttaccttaagttagtacgtagttcgaccgtaagggtttcgtttaccgggtacccggttaccgaccccgggttggggtaaccgtaaccgggtaccgttacggtacccgtacccgttacctccggtaaccaccggttaccgtaacccgtaaccgtaccgggccctttacggtcccggttcccctccccgtacgggtcccctaccccgg

SEQ ID NO: 37606 - DNA, 734 bp, Homo sapiens
  misc_feature: GYAE6OF02HKGDS.53.33.C11.1.454.CMB.1.raw
tcagcgcgtatacacacgaccggtgctcgatttagagtgagctcgttgggtttgggctgagctgggttttcctcgttgctctttaagaggtgtccagtgtcacgtgcagctggtgcagtctgggggagcgtggtccagcctgggaggtccctgaaactctcctgtgcagcctctggattcgtctacaagtgtccttaccctttgctacgtgggtccgccaggcctccgaggcgaagggctggagtgggtgctacttatctacatcgtgagtaggaagagactcgtaccttaagttaccgactacggtaccgttacccggtaggaacggggtcccgaagtttccaaccgtacttcctaccgaagacgactaaacttaccaaagaaccaacgtactagtaacgtcgtagaacaaagtcgaacgtacgccgtagaaggtacgacgtaacggaacggaccgtacggtaccgttaggttcgtttaacgtttaccggtggttacggcggtaaggtacggtagtaacgttcgttaccttaacgtagttgacgtcgtacgttagggtttacggtttcgggttacccgttcccgtacccgggtcgggtacccggtacgggtaacccgttggtcccgtaccgttccgtacccgtacgtacgttacccttaacccggaaccgttaccgggaccccttacggttccccgtttacccttcccccggttacgggaccccttaccccgg

SEQ ID NO: 37607 - DNA, 762 bp, Homo sapiens
  misc_feature: GYAE6OF02H6Y9M.53.33.C11.1.454.CMB.1.raw
  modified_base (177)..(177): a, c, t, g, unknown or other
  misc_feature (177)..(177): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctggggaggtccctgaaactctcctgtgcagcctntggattcgtctcaagtgtcttaccctttgcacgtcgggtccgccaggcctccgaggcgaaggggctagggagtggggtcggctacgttatctacatctgagtaggaagagatcgtcctattacgcaggacctcggtaggaacggcctactccactctcacagaagtacacttaccaanaaccactacgtagtactntacgactaaagtcgaacgtcgtaccgtaggaacggtacgtcggtaacgaacgaaccggtacggtacgttggttaacgtttacgttaacgttggtcggtacggtagggtagtaacgttagttacgtttaccttaacgttgtacgtagtcgggtacgttaggggttttacgggtttaccgggttacccggtttacccggtaccccgggttaccggggcccgtaaacccggggtaacccgttcgggtaaccccgtcccgttcccgttacccgtaccggttaccggtaacccgtttaccccggaaccccgggtaaccgggttcccccgttaccgggtttacccccggttttccccccgttacccccgggttaccgggtccccccgtaccccgg

SEQ ID NO: 37608 - DNA, 650 bp, Homo sapiens
  misc_feature: GYAE6OF02FYMLN.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccgaggcaaggggctgggagtggggtggctacttatctcatctgatggaagagatgcctattacgcagctccgtggaagggccgattcaccatcctccagagacaacttccaaagaacacactgtatctgacaaagtggacagtcctagagacgctagaacgacgacggtctgtgtattacgtgtgacggaggtagagtagttgttacttaactagtgtatcggtccgttaggttcgggttttacgggttacccggttacccggtaccccggttcgggggacccggtaaccgggtaaccccgttccgggtacctacccggttccttacccggtaccgaccggttaccctaccccgtaacccggtaaccggggccccttacggttaccccggttccccgttaccccccggtcgggaccccgttcccccgg

SEQ ID NO: 37609 - DNA, 718 bp, Homo sapiens
  misc_feature: GYAE6OF02GQPIP.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtctaccctttgcacgtgggtccgccaggcctccgaggcgaagggggctgggaggtggggtggctacttatctcatctagataggaagagatcgaccttaattacgcacgacctccggtaggaacggggtccgtaattccaaccctatcccgtaccaaggaacgaacctaaacttaacccgaaacgaaacctactaacttagttaactccgtagaacaaaagtcggaacagccgtaggaagacgcgtaagaacgaccgtacggagttaggtacgttactttacgtggtacggacgtaggtagaagtagttacgttacttaacgtagtagtacgtacgtacggttaggtttcggtttaccgggttacccggttaccggtacccgggtacgggtaacccgggtaaccgggtacccgtcgtacccgtacccgttcctacccgttacgtaccgttacccgtacccgaacccggtaccgtacccgttacccggttcccggttccccgtcccggtaccggtccccgtacccg

SEQ ID NO: 37610 - DNA, 640 bp, Homo sapiens
  misc_feature: GYAE6OF02I809O.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaagggggctgggaggtggggtggcacttatctcatctgatggaagagatgcctattacgcagacctccggtaggaacgggccgtattccacctatcctaccagacgacaacttaccaaagaacactactagtaatctacgactaaagtgacacgctagaagagactagaagacgacggctagtatacttacgtgtgcggagtagagtattcgttacttactatgtatcggaccgttaggtttacgggtttaccgggtacccgtttacccggaccccgggttacgggacccggtaacgggtaacccgttcgggtaccctacccgtccttcccgtcaccggttcccgttaacccgaaccggtaccggtcccgtacgttcccggttaccccttccccggtccggtccccgtcccgg

SEQ ID NO: 37611 - DNA, 695 bp, Homo sapiens
  misc_feature: GYAE6OF02GRNI3.53.33.C11.1.454.CMB.1.raw
  modified_base (216)..(216): a, c, t, g, unknown or other
  misc_feature (216)..(216): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggagcgtggtccagcctgggagtccctgaaactctcctgtgcagcctctggattcgtctcaagtgtccttaccctttgcacgtgggtcccnccaggctcgaggcgaaggggctggagtgggtgcacttatctcatctgatggaagagatcgctaattacgcagactccgtaggaacgggccgattcaccatcctaccagagacaattaccaaagaaaccactaactgtactactcgaacaaagtggacacgccgtagaacgtagacgtaggaaacgaccgaacggtcgttaggttagttaactttacgttggtagacggtaggtaggagtaagttgttactttaacgttatacgtagtcgaccgttaggttcggttttaccgggtacccgtttcccggtaccccgggttcggggacccgtaccggggtaacccgtccgggttacccgtaccggtaccttcccggtaccgtaaccggtcccgttaacccgaacccggtaacccgggaccccttacgggttaccccggtttcccccggtttccccccgttaccgggtccccgtaccccccgg

SEQ ID NO: 37612 - DNA, 563 bp, Homo sapiens
  misc_feature: GYAE6OF02I6YLA.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggcctccaggcaaggggctggaggtggggtggcacttatctcatctgatggaagagatgcctattacgcagactccgtgaacgggccgattcaccatctccagagacaattccaagaacacactgtatctgacaaatggacagcctgagagctaggaacgacgacggctgtgtattatgtgcgagtgagtattgttacttactatgatgtccgtaggttcggtttcggtaccgtttccggaccccgtcggggaccgtacgggtaacccgtcggtcctaccgtcctccgtcgacgtccttacccgaccgacggccctcgtcccgttcctccccgtcggccctccccg

SEQ ID NO: 37613 - DNA, 750 bp, Homo sapiens
  misc_feature: GYAE6OF02JDQ31.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccttgcacgtggtccgccaggctcaggcaagggctggagtgggtggcacttatctcatctgagtggaagagagtcgcctattacgcagactccgtaggaacggccgaattccgaactactcctaccgagacgaactaacttaccaaaacgaacaacctactacgtaactctagacaaaagtcggaacacgtccgtaggaacgacgtacgtacgaacggtaaccgacggtacgttaggttacgttaaagtttaccggttaggtacgggacggtaggttacggaagttacgttacggtttaacccttagttaacgtagttaagtccggtacgttaagggtttcgggttttaacgggttacccggtttaacccgtccccggggttcgggtaacccgggtaaacccgggttaacccgttcgggtaccccgtacccggttacccgtttaccccggtacgtaccggttaccccgttacccgtaaacccgggaacccgggttccccaaccgggtttcccgttaacccccggttcccccggttccgggacccggttcccccg

SEQ ID NO: 37614 - DNA, 644 bp, Homo sapiens
  misc_feature: GYAE6OF02I1HRQ.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccgaggcgaaggggctgggaggtggggtggctacgttatcctcatctgatagggaagagatgccttattacgcagactccgtaggaacgggccgtattccaccatcctaccagagacaacttaccaaagaacacactgtatctgacaaagtggacagcctagagagctagaacgacgacggctggtagttattacgtgtcgacggtaggtagagatttttgactttactatagtatacgacgttagggtttcgggtttacggttacccggttcccggaacccgggttccggggacccggtaaccggggtaacccgttcgggtacccgtacccgttccttcccgtaccgtaccgtcccttacccgaaccgtaaccgggcccttacggttcccggttccccttccccggtcggccccgtccccgg

SEQ ID NO: 37615 - DNA, 646 bp, Homo sapiens
  misc_feature: GYAE6OF02HREYM.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtggggtggctacttatctcatctgatggaagagatcgctattacgcagactccgtagaacgggcctattccaccatctccagagacaattaccaaagaacacactagtactcgtagacaaaagtcggaactagcctaggaagacgctaggaacgacgacggtcgttagtcgttaattacgttgtagacgtagtaggagtagttcgtacttactagtagtatcgaccgttaggtttcggttttacgggtaccgtttcccgggtaacccgtcgggggtacccgtacgggtaacccgttgggtacctaccggttcctacccgtccgtaccgtccgttaccccgaaccggtaaccggggtccctaacggttcccggttcccctttacccccggtcgggaccccgttccccg

SEQ ID NO: 37616 - DNA, 1016 bp, Homo sapiens
  misc_feature: GYAE6OF02H7CQ0.53.33.C11.1.454.CMB.1.raw
tcagcgcgtatacacacgaccggtgctcgatttagagtgagctcgttgggtttgggctgagctgggttttcctcgttgcttctttaagaggtgtccagtgtcacgtgcagctggtgcagtcgtgggggaggcgtggtccagccgtgggacggtccctagaaactctccgtgtcgcacgcctcgtggacttccgtctacgaagtcgttccttacccgtttgacctcgttcgggtcccgccaaggccctaccgaagggaccggtaaagggggtcgtaggggtaagggttgggggtacgaccgttaaccttttagcccttacaacgtttccgttggtaaggttacgggaaaaaggtaacggtaacgttccgtaccgtttaaaacgttacccggactaaacggtaaccccgtttaccgggaacgggtaaaccggggtacccgtaactttaccccgaaccctacgttaccccgtaccggaaaacggtacggtaaaacccttaaacgttaaccccgaaaaagtaaacccgtaacttaaccggttacgttaaacttcccggttaaacgaaaccgttaaaacgtaaggggaaccctaacggttcccgttaaaggaaacgggttaacgtacccgaaagggtaaaacccgtaacgggtaccggtacgtttacgggttaaacgttttaccggtaacgttcgggttacggacgggttaaggtaggtaacgttagtttacgttaaccgttttagtaagttacggtacgtaccggtacggttacgggtttacgggttttaacccggtacccgggtttaacccgggtaaccccgggtagggggttaccccggaaaccgggttaaacccgttccgggtaaccccgttacccgtttccccgttaccgtaaccccggttaccggtttaaccccgttaccccggtaaaacccggtccccgggttaaccccgttaccggtttccccccgggtttccccccgtttccccgggtcccggtaccccggttaacccccgg

SEQ ID NO: 37617 - DNA, 639 bp, Homo sapiens
  misc_feature: GYAE6OF02HT2FV.53.33.C11.1.454.CMB.1.raw
  modified_base (593)..(593): a, c, t, g, unknown or other
  misc_feature (593)..(593): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtcgggtccgccaggctccgaggcgaaggggctgggaggtggggtggctacttatctcatctgataggaagagaatgtaccttattaccgacagtacctcccggtaggaaacggggccgtaatttccaaccacttcctaccccgaaggtaaccgtaaacctaaactttaccccaaaaggaaaccctaaccgtaaccgttagtaacttccgttacgaactaaaagtcggaacacggtcctaggacggagcgtaaggaacgaccgacggctagttagtaacttacgtgtgacggtagtagagtagttgttacttactatgatcgcgttaggttggtttacggtccgttccgaccgttcgggaccgacggacctgccgaccgtctccgtncgtcctaccaccgacgcctagtccgttccctcccgtcgccgtcccg

SEQ ID NO: 37618 - DNA, 488 bp, Homo sapiens
  misc_feature: GYAE6OF02H2JZV.53.33.C11.1.454.CMB.1.raw
  modified_base (182)..(182): a, c, t, g, unknown or other
  misc_feature (182)..(182): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (430)..(488): a, c, t, g, unknown or other
  misc_feature (430)..(488): n is a, c, g, or t
tcagcgcgtatacacacgaccggtgctcgatttagagtgagctcgttggggtttgggctgagcttgggttttcctcgttgctcttttaagaggtgtccagtgtcacgtgcagctggtgcagtcgtggggggaggcgtgggtccagcctgggacggtccctagaaactctcctgtgcagcctntggattcgtctcaagtgttctaccctttgctacgtgggtccgaccaggcctccgaggcgaagggggctgggaggttgggngctacttatctnatctgagtaggaagngtancgacctaattaccgcaagtaccgtccgtaggaacggggtcctactttaccacctaactacctcccaagggaactaaccgtaaaactttcccgaaaaaggaaacccaacgtaccttaggtaactccgtaaggaaaccnnnnnnnnnnnnnnnnnnnnnnnnnnnnnnnnnnnnnnnnnnnnnnnnnnnnnnnnnnn

SEQ ID NO: 37619 - DNA, 596 bp, Homo sapiens
  misc_feature: GYAE6OF02H837Z.53.33.C11.1.454.CMB.1.raw
  modified_base (256)..(256): a, c, t, g, unknown or other
  misc_feature (256)..(256): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctacctttgcacgtgggtccgccaggctccaggcaaggggctggagtgggtggcacttatctnatctgatggaagagatgcctatacgcagactcgtgaggccgtattcacatctcagagacaattaccaagaacacactagtatctagacaaagtcggaacacgcctaaggagacgactaggaacgacgacggtactgtagttaacttacgtggtcgacgtagtgtagtattgttacttactatgtatcgtacgttaggttggtttacggtacccgttccgtaccccggttcggggccgtaacgggtacccgtcggtaccgtaccgttccgtccgtcgaccgtcctacccgaaccgaccgggtacccacgttccggttcccgttccccgtcggcccgtcccg

SEQ ID NO: 37620 - DNA, 854 bp, Homo sapiens
  misc_feature: GYAE6OF02FZXKC.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgagtggaagagatcgacctattacgcagtacgtccgtaggaacggggtccgtacgttccaacctactcctaccaagaacgaactaacttaccaaagaaccaactaactgtatctagaactaaagtcggacacgcctagaagacgacgtagaacgacgacgggtcttaggtagtttaacttacgttggtacggtacggtaaggttacggagttacgtttacggtttacctttttaacgttagttcggtaaacgttccgggttaacccggttaaggggtttttacgggggttttttacccgggtttaacccccgggttttacccggggtaaccccccggggtttcgggggggtaaacccccggtaaaaccggggggtttaaccccccgttcgggggttaacccccgttaccccggtttacccggtttacccccggttaaccggttaaccccgggtttacccctttaacccccccgggaaacccccgggttaacccggggggttaccccctttaacccgggggttttcccccccggtttaccccccggtttttaccccccccggggttccggggtacccccccggtttacccccggg

SEQ ID NO: 37621 - DNA, 698 bp, Homo sapiens
  misc_feature: GYAE6OF02I3T3K.53.33.C11.1.454.CMB.1.raw
  modified_base (176)..(176): a, c, t, g, unknown or other
  misc_feature (176)..(176): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtggggaggcgtgggtccagcctgggaggtccctgaaactctcctgtgcagcctntggattcgtctcaagtgtctccttgcacgtgggtccgcaggctcaggcgaagggtctggagtgggtcgctacttatctacgtatcgtgagtaggaagaggtactgacccgttagttaccgacagtaaccgttcgaggaaacggtccgtataccaccgaattccaccgaggaacgaactaattaccgaaagaaccgtaacacgtagtatacctaggtaccaaaggttcgaacgacgtaccgtaaggagtacgtacctaggaaacgtaccgaacggtcctagggttacttacgttaacgtggtacgtacggaggttacgagttacgttcgtacgttacgtaagtgtaaacgtcgtaacgtcgggtttacggttcgtttaccgtaccgtacccgggtacgggtaacccgtaaccggttacccgtacgtacccgtaccgttccgtacctcggtaaccgtccctaaccgacccggtaacggcccgttaaccgttccggttaccccggtcctcccgggtacctcccgg

SEQ ID NO: 37622 - DNA, 811 bp, Homo sapiens
  misc_feature: GYAE6OF02HER5Z.53.33.C11.1.454.CMB.1.raw
  modified_base (220)..(220): a, c, t, g, unknown or other
  misc_feature (220)..(220): n is a, c, g, or t
tcagcgcgtatacacacgaccggtgctcgatttagagtgagctcgttgggtttgggctgagctggttttcctcgttgctcttttaagaggtgtccagtgtcacgtgcagctggtgcagtctggggagcgtggtccagcctgggaggtccctgaaactctccgtgtgtacagcctgtggtattcgtctcgaagtgtccgtacctttgctacgtcgggtccncctaggcctcgaggcgaagggctggagtggtgctagttactctgactcgtgatacggaagagatcgaccttagttacgctagtaccgttccggtaggaacgggtcccgtattacccgaaccgtacgttacccgtacccgtaaggtaaccggtaaacctaaacgttttacccgaaaaacggttaaaaccctaaaccgttaacccgttaggtttaacgttaccgtttaacggaaacccgttaaaaagggtttaccggaaaaccgtacggttaacccgtaggtaaacggtaacccggtacgtttaacgggaaaccggttaaccgtaaccgggttcgttacgtttaacggtttaacgttaaccggttagtcggtaacggtaacgttacggtacgttaagttcgttaaacttacgtaggtaactacgttcgacggttacggtttacggtttacggtacccgttccggtacccgttacgggaccgtaccggaaccgttcgtacccgtacgtcgttaccgtccgtaccgtaccgttacccaaccggtacgttccccgtagttcccggttaccctttcccggtccggtacttaccccgg

SEQ ID NO: 37623 - DNA, 757 bp, Homo sapiens
  misc_feature: GYAE6OF02FNJ2E.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccgccaggctccgaggcaaggggctggagtgggtggcacttatctcatctgatggaagagatgcctattacgcagactccgtagacgggccattcaccatctaccagagactaatccaagaacacactgtactcgtacgacaaaagtcggaacgacgtccgtacgaagacggtactaggaaacgaacgacggtccgttgttacgttaacgtttacgtgtacgacggtagtacggaaggtacgtttcgttacttttaacttagttacgaacgtttcgggtaccttacggggttttacggggttttaccgggtttaccccggtttacccgggttaacccccgggttacggggtaccccgggtaaacccggggtaaccccgtttcggggttaccccgttacccgggttccccgtttacccgttcggtaacccggttaccccgtttaaccccgtaaaccccgggtaacccggggttacccctaccgggttttacccccgggtttcccccttttaacccccccgggtgggttccccccggttccccccgg

SEQ ID NO: 37624 - DNA, 746 bp, Homo sapiens
  misc_feature: GYAE6OF02HE2M0.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagtccgtgggaggtccctggtaaacttctcctgtgctagcctctggtattcgtctcgaagtgtcttaccctttgcgacgtgggtccgccgaggcctccagggcaacgggggtcctgggaggtggggttggacctacgtttagtccttcgattccgttgtacgtagggaagtagtactcgaccttaattacgacgacgtacctccggtaaggaacgggccgtacttccaccgactccgtaccagaacgtactaattaccgaagaaaccgtctaccgttagtacgttcgagtaactaaagtcggaacgtacgaccgtaggaacgacggactacggaaacgtaccgaccggtgttacgttacggttacgtttaccgtggtagtacggtaggtagtaacggtagttacgttacttaacgttacgttacgtagttcgctagggttacggtttacgggtaccccgttccgtacccggggttacgggaacccggtacgggtaacccgtcgggtaaccttcccggtaccgttcgtaacggtacgttccctaaccggtaccggaaccggttcccgacggtttcccggtcccttccccgggtaccgccggtaccccg

SEQ ID NO: 37625 - DNA, 549 bp, Homo sapiens
  misc_feature: GYAE6OF02IO7WS.53.33.C11.1.454.CMB.1.raw
  modified_base (250)..(250): a, c, t, g, unknown or other
  misc_feature (250)..(250): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggagcgtggtccagcctgggaggtccctgaaactctcctgtgcagcctctggattcgtctcaagtgtctaccctttgcactgggtccgccaggctcaggcaaggggctggagtgggtgcacttanctcatctgatggaagagatgcctattacgcagactcgtagaagggccgattccacatcctccagagacattccaagaacacactgtatctgacaaatgacagacctgagagctagagacgacgctgtagtattatgtcgagngtagagatgtntactagtacgtatcgctaggttggttacggttaccgtccgtacccgtgggaccgacgggtaaccctcggttaccaccgttcgtcctctaccgccttccaccggtaacggcccacggttccggtacccttcccgtcggtccgtcccg

SEQ ID NO: 37626 - DNA, 888 bp, Homo sapiens
  misc_feature: GYAE6OF02H1OVL.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccgccaggcctccagggccgaaggggctgggaggtggggtggctacttatctcatctagagtaggaagagtatcgtaccttagttaccgcgaacgtacgtaccggtaggtaacgggccgtaacttaccgaaccctaacttccgtacccgaaggtaacgaacctaaacttaaccgaaaacgaaaccaactaaccgttacgttaacgttaccttacgaacgtaaaagttacggaacgacggtaccgtagggaaacggtacggtaccgtaagggaaacgtaaccggtaaccgggtaccggtttaggttaacggttttaacgtttaacggtggtacgggacggttaaggtacggtaagttaacgttacggttttaccgtttaaacttagttacggtaacgtaccgggttaccggtttaaggggttttacggggttttacccgggttaacccccggggttttccccgggtaacccccggggttaccgggggtaacccggtaaacccggggttaccccgtttacggggttaccccgttaacccgttcccgttacccgtacccggttaacccggttaccccgttaaccccggaacccgggtaaccccgggttacccctttacccgggtttacccccggtttcccccggtttacccccgggtccgggtccccccgttaccccgg

SEQ ID NO: 37627 - DNA, 835 bp, Homo sapiens
  misc_feature: GYAE6OF02ILSAU.53.33.C11.1.454.CMB.1.raw
tcagcgcgtatacacacgaccggtgctcgatttagagtgagctcgttgggtttgggctgagctgggttttcctcgttgcttcttttaagaggtgtccagtgtcacgtgcagctggtgcagtcgtgggggaggcgtggtccagccgtgggacgtccctagaaactctcctgtgcagcctgtggtacttccgtctcgaagttcgttccttacccgtttgaccgtacgttcggggtacccgaccgtaacgggccttaccgaacggggaccggtaaacggggggtccgttagggggtaacgggtttgggggttaccggacttaacctttaacgtcccttacgtaacttcgtaaggtaagttaaggaaacggtaggtaacttcggtaacccttaacgttaccggactaacgggtacccttccgggtaaggaaaccggggttcccgtaaactttcccggaaccttaacttacccgacccgtaaagtacgaaaccttaaccgttaaccgaaacgtacctaaccgtagttaacgttcgactttacgaactaacggtaacggacaacggttacctagggaacgtacgtctacgggaaactccggaacgtcgttaagtcgttaacttcggtaggtcgtaacggtagtacgaagttagttacgttacttacgttagtgtaacgtgtacgttaggttacgggttaccgtaccgttccggtaccgtacgggtacgtacgggtacccgtggttaccctacgttaccgttcgtaaccgtccggtaccttaccgaaccgttaccggccttaccgttcccggtcccgttaccccggtcggtccccgttaccg

SEQ ID NO: 37628 - DNA, 771 bp, Homo sapiens
  misc_feature: GYAE6OF02IIZ41.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtctaccctttgcacgtggtccgccaggctccaggcgaaggggctggaggtggggtggctacttatctcattcgtgagtaggaacgagatcgtacctagttaccgacacgtacctccggtacgggaacggggtacccgtaatttcccgaacctacgttaccctaccgaacggtaaacgaacctaaacctttaccgaaaacgtaaaccaacctaacgttacgtaacttacttagaaccgtaaaagtacggtaaccaacggtcccgtaaggaacgtaacggacgttaacggaacgaaccgtaccgggtacgttaggttacgttaactttacgtaggttggtacggtaaggtaggaggttattcggtttactttaacgtagtacgtattccggacgttagggtttaccggggttttcgtacccgggttccccgtacccgggttacgggacccgtaaccgggtaacccgttcgggtaccctaccggttccctccgttaccgaccgtacccgttacccgaacccggtaccggtacccctcgggttaccccggttcccccgttccccggtccggcccgtccccgg

SEQ ID NO: 37629 - DNA, 808 bp, Homo sapiens
  misc_feature: GYAE6OF02IZYWM.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggaggtccctgaaactctcctgtgcagcctctggattcgtctcaagtgtctaccttgcacgtgggtccgccaggcctccgaggcgaaggggctgggaggtggggtggactacgttatccgtctactctggtatagggaaagaggtatacggccttaagtttaccgactaaggaccgttccggtaggaaacggggccgtacgttaccgaacctacgtacctacccgaaggaacgaactaaaccttaccgaaaacgaaaccactaactacggttaactacgtacgactaaagtacggaacgtacgacccgtaggaacggagtaccgtaaggaacggaacgtaccggtctaggttacgttaattacgtaggttggacggtaggtacggtaagtagttacggtacctttaacgttaagacgttatccgggtaacgtttagggttttccggggtttaccggttaacccccgggtttacccgggtaaccccgggtaggggtaaccccggggtaaacggtaacccgggttccggttaaccccggtcccgttaccgtttcccgtaaccggttacccgttacccgttaacccggaacccggtaacccgggtacccgtaccggtttccccggtttcccggttaccccccggtcgggaccccgttcccccggg

SEQ ID NO: 37630 - DNA, 679 bp, Homo sapiens
  misc_feature: GYAE6OF02G4Z7O.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccgccgaggctccgaggcgaaggggctgggagtgggtggactacttagtctcgattctagagtggaagagatgcctagttacgcagtacctccgtaggacggccgattccaacctatcgtccaagacgactaattaccaagaaccacacgtagtatctgacgaatcgacacgcctagagagcgtagaacgaccgaacggcttagtgttaacttacgtgtgacgagtaggacgtagttcgttaccttaatacgtagtacgtacgccgttaggtttaccggggtttacggtaccccgttacccgggacccggttcggggaacccgtaacgggttaaccccgttgggtacccgtaccgttccgttacccgttaaccgaccggtacccttaacccggaaccccggtaccggtaccccgtaacggtttcccggttaaccccccgtttcccggaccggtccccgttaccccgg

SEQ ID NO: 37631 - DNA, 713 bp, Homo sapiens
  misc_feature: GYAE6OF02IJ84H.53.33.C11.1.454.CMB.1.raw
  modified_base (277)..(277): a, c, t, g, unknown or other
  misc_feature (277)..(277): n is a, c, g, or t
  modified_base (344)..(344): a, c, t, g, unknown or other
  misc_feature (344)..(344): n is a, c, g, or t
tcagcgcgtatacacacgaccggtgctcgatttagagtgagctcgttgggtttgggctgagctgggtttcctcgttgctcttttaagaggtgtccagtgtcacgtgcagctggtgcagtcgtgggggaggcgtgggtccagccgtgggaggtccctaggaaactctcctgtgcagtcctctggattcgtctcaagtcgtctaccttgcacgtgggtccgccaggctccgaggcgaagggctggagtggtggcacttatctcatctagatggaagagntgacctattacgcagacttccgagtaacggcgacttcacctatctcagaacgacaacttaccgaaanaaccgactacgtagtactctacgaactaaaagtcggaaacagtacctagaacggagtaccgaggaaagaaccgacgggtactacggtagttaacttacggtacggtacgtacggaggtaacggtagtagtaacggttaactttacggtaaactggtaacgtacggtaccgttaaggtttacgggttttaccggaacccggttttacccggaaccccgggttaaccggggaaccccggttaaacgggaaccccggttagtaaccccggaccgttaccctacccggtaccgtaacctcccgtaaaccgtaccccggaaacggacccgttaccgttcccggttaacccctccccggttaccgcccggtcccg

SEQ ID NO: 37632 - DNA, 666 bp, Homo sapiens
  misc_feature: GYAE6OF02HMY6Z.53.33.C11.1.454.CMB.1.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (399)..(399): a, c, t, g, unknown or other
  misc_feature (399)..(399): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggaggtccctgaaactctccctgtgcagcctcgtggattccgtctcaaggtcgtctaccctttgccacgtcgggtcccgccaggctccgagggccgaagggggctgggaggtggggnggtccacttatcncatntgagtaggaagagatcgtctaacttacgcgtaagcctcgaggtaacggaccgtatccaactattccaccagaacgactaacttaccaaagtaacaactacgtgtactcgagacaaaagngaacgacgcctaagagacgtgtacgaaacgaccgaacggccgtggttacgttaagtacgtaggttcgagttaggtagtaagtgttacgtttaccgttaatacgtgatacgtccgtaagtttcgggttacggtaccgttacccggtccccgttacggggcccgtacgggacccgtacggttccgacgtaccctcgtccgtagttacctcccgaaccgtaccggaaccgtccggttaccgtcccggttttaccccgccgtccgtacccg

SEQ ID NO: 37633 - DNA, 614 bp, Homo sapiens
  misc_feature: GYAE6OF02FP2IO.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgctattacgcagactcgtagagggcctattcacctatctaccagacgactaacttcaaagaaccacactgtactctagacaaagtcgacacgacctagaagacgacgtagaagacacgggtactggttagtaacttacgtgtacgagtacgtagagtattcgtacttactaagtcgtatcggactagggtttacggtttacggtacccgttccggtacccggttggggacccgtaacgggtaacccgttgggtacctacccgtcgtacccgtagaccgttccttaccgaacccggtaacggtcccctagttcccggtacccttccccggtcggccctcccgg

SEQ ID NO: 37634 - DNA, 856 bp, Homo sapiens
  misc_feature: GYAE6OF02FR8K7.53.33.C11.1.454.CMB.1.raw
  modified_base (251)..(251): a, c, t, g, unknown or other
  misc_feature (251)..(251): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggagcgtggtccagcctgggaggtcctgaaactctctgtgcagcctcgtggacttcgtctcaagtcgtcttacccgtttgcacgtgggtccgccaggctaccgaggccgaaggggctggagtgggngctacttactctacattcgtgactacggtaagagattccgtacttaagttaccgctaaggtaacctccggttaggaacgggtaccgatttaccgaacctacgttaccttaccccgaagaaccgtaaccgtaaaactttaccccgaaaacgtaaaccctaaccgtaacgtttacgtaacttaccgttggaaaacctaaaaggttacgggaaaccaaccgtcgtaacggtaaacggtacggaccttaagggaaaccgaccggtaacggtcgttaggttacgttaaacgtttacggtacggttagacggttaggtaggtaacgtagttacgttaaccgtttaagttaacttagttactaccgggtaccgtttaaggggttccggggtttttaaccgggttaacccggtttaccccgggttaacccccggggttacggggtaacccgggtaaaccgggttaaccccgttaccggggttaccccttacccggtttaccgtcccgttccgtaacccgtttccccggtaacccgtaacccgggtaaccgggtaccccgttaaccggttcccgttaccccggtttcccccggtaccgggtccccggtccccgg

SEQ ID NO: 37635 - DNA, 610 bp, Homo sapiens
  misc_feature: GYAE6OF02GA8NJ.53.33.C11.1.454.CMB.1.raw
  modified_base (460)..(460): a, c, t, g, unknown or other
  misc_feature (460)..(460): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtccttaccctttgcacgtgggtccgccaggctccgaggcgaaggggctggaggtgggtggcacttatctcatctgatggaagagatgcctattaccgcagactccgtggaacggggccgattccacctatcctaccagagaacaacttccaaagaacacacttgtaactctgacaaagtggaacacgtcctagagagtctaggaaacgacgacggacgttgtaggttactttacgtggtgacgagtagagtattgtacttactaagtnagtgacgtaggttggtttcggtaccgttccgacccggtgggaccgacggtacccgtcggtccgtaccgtctcccgtacgtaccgtcctacccgacgtaacccggccctacggttcccggttccccgttccccggtacggcccgtccccgg

SEQ ID NO: 37636 - DNA, 812 bp, Homo sapiens
  misc_feature: GYAE6OF02H70L7.53.33.C11.1.454.CMB.1.raw
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgtggtccagcctgggacgtccctagaaactctcctgtgcagtcctctggtattcgtctacgaagttcgttccttacccgtttgcctacgtcgggtacccncgaggcctccgaggcgaagggctggaggtggngctacttagtctcatctggntagggaaagngtaagtgaccttaagtacgcgacggtaccgttcggaaggaccgggtcctacgttaccaaccgtacttaccgaccgaaggtacaacctaacgttaccaaacgaacctacgtaactgtaactcacgtaactaaacggtcgggaactacgccgtagacgtaggtactaggaacgtcgtaaccggtctacggttaagtttaaacttcgtggtacggtacggaggttaggtaagttactttacggtttaacttaacgttagtaccggtacgtttccgggtaaccggtttagggttttaccgggttttaccgggtaccccggtttaacccggggttccccggggtaacggggtccccggttaaacccggggttacccggttacgggttaaccccgttccgggtttccccgttaccgttccggtaacccgtttcccggttaaccccggaccgggtaaacccggtcccgtttaccgggttcccccggttttacccccgtccccggggttccgaaccccggttcccgg

SEQ ID NO: 37637 - DNA, 820 bp, Homo sapiens
  misc_feature: GYAE6OF02JSMMQ.53.33.C11.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgtggtccagcctgggaggtccctgaactctcctgtgcagcctctggattcgtctcaagtntcttaccctttgcctacgtcgggtcccnccgaggcctccgacgggacgaaggggctgggacgtggggtcggcctacttatcctcgacttccgtagtaagtagggaaagtagtagtccggtacccttaagttaccgacgtacgtaccggttacccggtagggaaccggggtcccttattcccgaccgtactaccgtccgaagtaacgaaccttaacttaacccaaacggaaacctactacgttagttacctcgtaacggaactaaagttccggaaactcggtacctaggaaggttacgacgttaacggaaccgaccgaccgggtacgtttacggtatttaacggttactggtacggtcgggttaaggtacggtaacgtaggtttacccgttacgtttaacgtagttacgaacggttccggtacggtttagggttttacggggttttacccgttacccggttacccgggtacccggtacgggggtaaccctaaaccggggtacccgttccgttacccggacccgtttcccttcggtaacccgttaccgttaccccgtaccggtaaccggtccggtaccccgttaccggtccccggttcccccgttaccgggtacccggtcccgtaccccgg

SEQ ID NO: 37638 - DNA, 888 bp, Homo sapiens
  misc_feature: GYAE6OF02H1A0B.53.33.C11.1.454.CMB.1.raw
  modified_base (171)..(171): a, c, t, g, unknown or other
  misc_feature (171)..(171): n is a, c, g, or t
  modified_base (178)..(178): a, c, t, g, unknown or other
  misc_feature (178)..(178): n is a, c, g, or t
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (656)..(656): a, c, t, g, unknown or other
  misc_feature (656)..(656): n is a, c, g, or t
tcagcgcgtatacacacgaccggtgctcgatttagagtgagctcgttgggtttgggctgagcgtggttttccgtcgttagctcttttaagaggtgtccagtgtcacgtgcagctggtgcagtcgtggggggaggcgtggtccagcctgggacggtcctgaaactctctgtncagcctntggattcgtctacaagttcgtccttacctttgcctacgttgggcccgccgaggcctaccgaggacgaaggggctgggnggtggggtgctaacgtttntcctatacttgaggtagtaggggtaaagtacggatccggtaccttaacgttacgacgtaaccgtacccgtttcccgggaagggaaaaccggggtccccgttacgtttaaccaccccgttaatttccccggtaaccccggaaaggttacctaaaaaccgtaaacctttaaaacccggaaaaccgaaaaacccgttcctacggttaaacttacccgtacgtaacggttaaccgtaaaaacggtcgggaaacctaacggttcccggtaggaacgtaaaccggtcgaaacgggaaccggtaaccggacggtacgtttacggttacgtttaacgttaccgtaggttcggacggtagaggtagtagtcggtttattaattacgttanacggtcgttcgggttaaccgggttttacggttcccggtttacccgggtccccggttaacccgggtccggggtaaacccggtaccggttaaaccgggtccgttacccgttacccgtttcccgtacccgtcggtaccccgttaccgtaaccccgggttaaccgccccggggttaccgttacccggtcccccggtttcccccgtaccccgggttcccggttacccccgttcccgg

SEQ ID NO: 37639 - DNA, 858 bp, Homo sapiens
  misc_feature: GYAE6OF02FLVCC.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctagaaactctcctgtgcagcctctggattcgtctcaagtgtccttaccctttgccacgtgggtcccgccaggctccgaggcgaaggggctgggagtcgggtcggctacttatctcatcgtagagtggaagagatcgaccttaagtaccgacaacgtaccgtccggtaaggaaccggggtccgtaactttacccgaaccgtacttaccgtaccgaaggaacgtaaacctaacgtttaacccgaaaacggtaaaccaacgttaacgttcgttaaatccggttaagaacctaaaagtcggaacctaacggtccgttaacggaaggtacgaccgttaacggaaacgaccgacgggttcttaggttacgttaagtttacggtaggttaggacggtaggtacgaagttacgttacggtttaactttaactaggttacgtacgtacggtaccgttaacggggttttcggggttttaacccgggtttaccccggtttaccccgggtaaccccgggttttaccgggggaaccccggttaaacccggggttacccgtttacccgggtacccttaaccccggttcccgtttaacccgtaccgttacccggttaaccccttaaccccggaaacccgggttacccgggtacccttaaccgggtttacccccgtttcccccggtttacccccggtccgggtacccccgttacccccgg

SEQ ID NO: 37640 - DNA, 666 bp, Homo sapiens
  misc_feature: GYAE6OF02FW4TN.53.33.C11.1.454.CMB.1.raw
  modified_base (328)..(328): a, c, t, g, unknown or other
  misc_feature (328)..(328): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtcctaccctttgcactgggtccgccaggctccaggcgaagggggctgggagtggggtgctacgttatctcattctagatgggaagacgatgacctattacgcagacctccggtaggaacgggccattccaaccgtntacctcagacgaactaacttaccaaagaacacactagtactctgacaaagtcggaacacgccgtagacgacggacgtagaacgaccgaacgtcgtagttagttaagtttacgtaggttcggcgtagtcggagtatgttacttactatagtagtcgcggttaagttcgggtttacgggtacccgttccgggtacccgtacggggacccgtaaccgggtaccgttccgaccgtaccccgttcctccgttaactccgtacccttaccccgaaccggtaccggtacccccgtacggtttccccggtttaccccgtcccccggttcgggaccccgttccccgg

SEQ ID NO: 37641 - DNA, 883 bp, Homo sapiens
  misc_feature: GYAE6OF02HJ6ER.53.33.C11.1.454.CMB.1.raw
  modified_base (327)..(327): a, c, t, g, unknown or other
  misc_feature (327)..(327): n is a, c, g, or t
tcagcgcgtatacacacgaccggtgctcgatttagagtgagctcgttgggtttggggctgagctgggtttcctcgttgcgtctttaagaggtagtccagtgtcacgtgcagctggtgtcagtcgtggggaggcgtggtccagccgtgggacgtccctaggaaactctccgtgtgcacgcctcgtggtattcgtctcgtaagtcgtccttaccctttgcgtacgtcgggtccgccaggctaccgaggcgaagggctacgggaggtcgggtggtcttacgttatccgtactactctagaagtaggaaagagtagtcgtcttagtaccgnaacgaccgtaccggtaggaacggtccgtacttaccaccgtactcctaccgaagtaacgtaaacctaaacgttacccgaaaaacgtaacccgtaaaccgtaccgttaccggttaaccttaccgtaacgtaaaccgttaaaacgggtacgggaaaccgtaacgggtacccggttaagggaacgggtaacgggtaaccggttaaggaaaccggtaacccgtacggtaccgtttaggttaacgtttaaacgtttacccggttagggttaccggtacggtaacgggttacgggtaaagttacggttaacggtttaacgttttacgtaggtttacggacgtttacgggttaccggttaggttttaccggggtttaccggtttaccccggtaacccgggttaaccccgggttaggggtaaccccggttaaaccggttacccgttcgtaccccgttaccccgttcgttaccccgacgttaaccgttacccgttaaccccgaacccggtaaccggtacccctaacggttcccggttcccttaccccgggtcgtacccggtccccg

SEQ ID NO: 37642 - DNA, 698 bp, Homo sapiens
  misc_feature: GYAE6OF02ID78G.53.33.C11.1.454.CMB.1.raw
  modified_base (353)..(353): a, c, t, g, unknown or other
  misc_feature (353)..(353): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtgggtccagcctgggaggtccctgaaactctcctgtgcagcctctggattcgtctcaagtgtctaccctttgcactgggtccgccaggctccgaggcgaaggggctgggagtgggtgcacttatctcatctgataggaagagatgacctattacgcagactcgtgacggccatcacactctcagagacaattaccaaagaacacactagtatctgacaaanggaacacgctagagagcagagacacgggctaggttactagttactggtacgcggtagtggagtaagttgtttaacttacgttagttagtaactcggtacgttacgggtttgggttttccgggttaaccccgggttacccggtacccccggggtttaggggaccccgggtaaaaccgggggtaccccgtttaccggggtaccttacccccgggtttccgttttaccccgcccggtttacccggaccctttaacccccggaaacccggttaaccgggtcccccgttaacggtttccccgggtttacccccctttcccccggggttacccggccccggttccccccgg

SEQ ID NO: 37643 - DNA, 690 bp, Homo sapiens
  misc_feature: GYAE6OF02FK3BP.53.33.C11.1.454.CMB.1.raw
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggagcgtggtccagcctgggagtccctgaaactctcctgtgcagcctctggattcgctcaagtgtcttaccgttgcacgtcgggtccgccaggctccgaggcgaaggggctgggagtgggngcacttanctacatctagatggaagagattcgcccttaagttaccgcaacgtaccttccggtaggaaacggggcctaattccgaccaatccgtaccaaggaacgtaactaacttaccaaagaacacctactagtactcgtagactaaagtcggaacacgccgtaggaagacggtctaacggaacgaccgtaacggtcgttaggtacgtttaacgttacgtggtacgtacggtaggtagaagtacgttgttaaccttagtacgtgtaagtcggaccgttagggttacgggttttccggtacccgggttccggaccccggttcggggtaaccggtaccgggtaccgttacgtacccgtcccggtactccccgtgtaccgtccgttaacccgaccgaacggtaccccgtagttaccccgttcccgtccccggtcggcccttccccgg

SEQ ID NO: 37644 - DNA, 741 bp, Homo sapiens
  misc_feature: GYAE6OF02FUH7A.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtcttaccctttgcacgtgggtccgccaggcctccgaggcgaaggggctggagtgggtggctacttatctcatctgagtggaagagatcgcctagttacgacgtacgtacctcccggtaggaacggggtccgtattaccaacctacttacctaccgaacgaacgaaacctaaacttacccgaaaacgaaaccaactaacttagttaactcctagaactaaacgtggaacacgtccgtagagacggacgtaggaaacgaccgacggtcgttgttacgttaacgttcgtggtacgtacgtaggtgaaggttagttagtttacttacgttatacgtattcggtaccgttagggtttcgggttttaccgggtacccgtttcccgggaccccgggttggggaccccgtaaaccggggttacccgttcgggtaccccgtccgttcccgtacccgttcgtacccggttcccgttaaccccgaacccgggtaacccggtccccgttaccggttccccgggttaccccctttcccccggtccgggtccccttcccccgg

SEQ ID NO: 37645 - DNA, 736 bp, Homo sapiens
  misc_feature: GYAE6OF02J2GT9.53.33.C11.1.454.CMB.1.raw
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtcctaccctttgcacgtgggtccgccaggcctaccgaggcgaaggggctggagtgggngcacttanctcatctgatggaagagtagtagcctaattacgcacgacctcggtaggacggccgtatccacgactctccagacacaacttaccaagaacacactntaactcagaacaatcgaacacgccgtagaganacggtagaacgtacgacggtactaggttacttaatacgtggtacggaccggtaggttagaagtacttacggttacttacgttaacgtgtacgtacggtaccgtttagggtttacgggtttacccggttacccggtttaaccccgggtaccccgggttacccggggcccgggtaaaccgggggttaaccccgtacgggtttaccccgttacccgtaccccgtttacccggtaccggtaaccgtttccccgtaaccccgttaaacccggaacccccgggttaaccgttccccggttacccccggttttacccccgttacccccccgggttcggaaccccccgggttcccgg

SEQ ID NO: 37646 - DNA, 798 bp, Homo sapiens
  misc_feature: GYAE6OF02GLBVD.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgtggtccagcctgggaggtccctagaactctcctgtgcagcctctggattcgtctacaagtcgtccttaccctttgccgtacgtcgggtcccgccgaggcctcccgaggccgaaggggctggaggtgggtgactacgttatctcgattcgagtataggaagagatcgtacctaagttaccgacgacgtaccgtaccggtaggaaccgggtccgtaactttacccgaacctacgtacctaccgaagaacgtaactaaacgttacccgaaaagaaccactacgtacgttactacgtacgtaacaaacgtacggaacgacgtccgtaggaacgtacgtacgtaagaacgaccgtacggtacgttagtacgtttaacgttacgttggtcgtacggtaaggtacgtaagttacgtttcgttactttagtacgtagtacgttcccgtacggttaggtttaccgggttttaccggttaccccggttccccggtaacccgggtacggggtaaccccgggttaacccggttacccggttaccggttaccctacccgtttcccgtacccgtccgtacccgttaccccgtaacccggtaaccccggtaacccggttaccccttaccgggttcccccgttcccccgtttacccccggtccggaccccgttaccccccgg

SEQ ID NO: 37647 - DNA, 817 bp, Homo sapiens
  misc_feature: GYAE6OF02JFGVG.53.33.C11.1.454.CMB.1.raw
  modified_base (212)..(212): a, c, t, g, unknown or other
  misc_feature (212)..(212): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctggggaggcgtggtccagcctgggaggtccctgaaactctcctgtgcagcctctggattcgtctcaagtgtctacctttgcactgggtccncaggctcgaggcgaagggctggagtgggtgctacgttatctcattcgtagagtaggaagagtagtcgtaccgttaattacggccaacggtaccgttacccggtagggaaaccggggtcccgtaacgttaccaacccgtacttaccgttaccgaaacggtaaacggtaaacctaaaacgtttaccccgaaaaacggtaaaccaacctaacgttacggttaaccttacgttacgaacctaaaaaggtcggaaacgtacggtaccgtaggaacgtacgtacgtaaggaaacgtaccggaccggtcgttaggttaagttacgtttacgttggtacgggtacggtaaggtacggtagttaaggttcgtttactttaacgttaatacggtagtccggttacgttacggtttacggggttttacccgggtaacccgggtttcccggtaacccgggttccggggtaacccggtaacccggggttaacccgtcggttacccgtacccgttacctacccgttacgtaccgtttacccgtaacccgtaacccggtaaccgtacccgtttacggtccccggttacccgtttccccggtaccgtccccgttaccccgg

SEQ ID NO: 37648 - DNA, 761 bp, Homo sapiens
  misc_feature: GYAE6OF02GT8ZH.53.33.C11.1.454.CMB.1.raw
  modified_base (484)..(484): a, c, t, g, unknown or other
  misc_feature (484)..(484): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctggggagcgtggtccagcctgggaggtccctgaaacctctccgtgtgcagcctctggtattccgtctcaaggttgtcttacccgtttgcacgtgggtccgccaggctccgaggcgaaggggctagggagtgggtggctacgtttatctactaatcgtgagtaggaagacgtatcgaccttagtacgacgtagtaccgtccgtaggaacgggccgttacttaccgaacctactacctaccgaagaacgtaactaacttacccgaaacgaaaccacgtactagttactctacgaactaaagtcgaacacgtccgtagtacgagaccgtaagaacgacgtacgcgtttaggtacgttactttacgngttggaacgtaggtacggaagtgtttacggtttaacctttagtaacgttgtaacgttcgtaacgttagggtttacgggttttaccgggttaaacccgttccgggaacccgggttccggggaccggttaaaccgggttacccgttacgggttaccgtacccgttccgtaccggttaaccgtaccgttcccgtaaacccgtacccggggtaaaccgtaccccgtaccgggtttaccccggttccccctttaaccccgggcccgttaccccgtaccccgg

SEQ ID NO: 37649 - DNA, 769 bp, Homo sapiens
  misc_feature: GYAE6OF02JMRFF.53.33.C11.1.454.CMB.1.raw
  modified_base (523)..(523): a, c, t, g, unknown or other
  misc_feature (523)..(523): n is a, c, g, or t
tcagcgcgtatacacacgaccggtgctcgatttagagtgagctcgttgggtttgggctgagctgggtttcctcgttgctcttttaagaggtgtccagtgtcacgtgcagctggtgcagtcgtggggaggcgtggtccagcctgggaggtccctagaactctcctgtgcagcctctggattccgtctacaagtgtccttacccgtttgacacgtcgggtcccgaccgacggtcctccgaaggtccgaagggggtcctgggaggtggggtcggacctacttactctcgatcgtagtagtacggaagagtacgtcggtaccgttacgttaccgaccgtacgaccgttccggtagggaacggaccgtagtaccaccgtatccgtaccgagtacgaactaacttaccgaacgtacctaacgtacgtacgtactcgtagaaccgtaagtcgaacgacgtaccgtacggaacgacgtacgtaacggaaaccgtccggtaacggttccttaggtaagtttacgttaccggngggtaacgagggttacgtaggacttacgttcgttaaccgttacgtaagttcgacgtacggttacgtggtttaccgggttacccggtttacccggtaccggtaacccggtcgggtaaaccgttacccggtaaccgttgtaccccgtacgttcccacggttaacctacgttccccggtaaccgaacccggtaccggttcccgtaccggttacccgttcccccggtaacccgtgggtccccgtacccgg

SEQ ID NO: 37650 - DNA, 800 bp, Homo sapiens
  misc_feature: GYAE6OF02JWEWT.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctctgtgcagcctcgtggtattccgtctcaagttcgtccttacccgtttgacctacgtgggtccgccaggtcctccgaggtcgaaggggtctgggaggtggggtcggctacttactcgtcactctaggagtaggaagagtactcggtacctaagttaccgctacgtaccgttaccggagggaaccgggtaccgtacgttaccgaccgtactaccgtaccgaacggtaacgtaacctaacgttaaccgaaaacgaacctaacgtaccgttaggtaccttacgtacggaaactaaaggtaccggtaacgacggtccgtaaggaacgacggtacggtaacggaacgtaccggtacgggtcttacggttagttaacgttacgtcggttacggacggtaggtaacgtaggttacgttcgtttaaccttagtacgtagtacgtccgggttaccgtggggttttacggttacccgggttaaccccgggttaccggtacccggggttaccgggtaccggtaaaccgggtcccgtacggttacctaccggttccgacccggttacctacggttacccggtaaccccgtacggtacccggtaccgtacccggttcccggttacccggtccccgtacggtccgtaccccg

SEQ ID NO: 37651 - DNA, 891 bp, Homo sapiens
  misc_feature: GYAE6OF02ILFSR.53.33.C11.1.454.CMB.1.raw
  modified_base (231)..(231): a, c, t, g, unknown or other
  misc_feature (231)..(231): n is a, c, g, or t
tcagcgcgtatacacacgaccggtgctcgatttagagtgagctcgttgggtttgggctgagctgggttttcctcgttgcttcttttaagaggtgtccagtgtcacgtgcagctggtgcagtcgtgggggaggcgtggtccagcctgggagtccctgaaactctctgtgcagcctctggtacttcgtctacgaagttcgttccttacccgtttgacctacgttcgggtcccnccgaggcctcgagggacgaagggggtctagggaggttgggtcggctactttatcctcattcgtgtacgtagggaaagtagatcgtaccttaagttacgctaacggtacccgttccggtagggaaacgggtccgtaacgtttaccgaaccgtacttccgtaccgaaaggaacgtaaacctaaaccgtttaacccgaaaaacgtaaacctaaccgtaacgttacggttaacttaccgtaacgtaactaaaaggttacgggaacgaaccggtacgttaacgggaacggtaacggaccgtaaagggaaaccggaaccggtaccgggtacgttacggttacgtttaacgtttaccggtggttaccgggtacggtaggttaacgggtaacggttaacgtttcggtttaaccgtttaacgtaacgttacggtacgtacgggtacccgttaggggtttaccgggttttacccgggtttaccccgggttacccggtaccccggggttacggggtacccggtaaccggggtaaccccgttcgggttaccctacccggttcctacccggtccgtccgttacccgttccccgaaacccggtaacccgggtaccccgttacggtttcccccggttacccccgtttaccccggtccggtaccccggttccccgg

SEQ ID NO: 37652 - DNA, 744 bp, Homo sapiens
  misc_feature: GYAE6OF02HU0UC.53.33.C11.1.454.CMB.1.raw
  modified_base (178)..(178): a, c, t, g, unknown or other
  misc_feature (178)..(178): n is a, c, g, or t
  modified_base (326)..(326): a, c, t, g, unknown or other
  misc_feature (326)..(326): n is a, c, g, or t
  modified_base (677)..(677): a, c, t, g, unknown or other
  misc_feature (677)..(677): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctagaaactctcctgtgcagccctntggtattcgtctcaagtgtccttacccgtttgctacgtcggggtcccgaccgagggtccttaccgagggtccgaaagggggtctacggggagttcgggggtcgtacctaacttactcctactagttccgtagaggtaggaagtaagtntcggtaccttattaccggctaacgaaccgtccggtaggaacggggtcctacttccaacccgtactccgtaccgaaggaccgtaaactaacgttacccgaaaagaaccctataacgtagttaccctcgtagaacctaaagtacgggaacctacggtacgaggagactacgtaagaacggtaccgacgttcgtaggttaagttaagttcgtagcggacggtagtagaagtattcggttaacttacgttgtagtcgttacgtaccgttagggtttcgggttaacccggtccggtttacccggacccggtcgggtaccggtacggtaccgttcgggtacctccgttccgttaccnccgtaccgtcctaaccggaccgaccggtcctaccggtcccgttacccgtccccgtcggccctcccgg

SEQ ID NO: 37653 - DNA, 740 bp, Homo sapiens
  misc_feature: GYAE6OF02F9GYI.53.33.C11.1.454.CMB.1.raw
tcagcgcgtatacacacgaccggtgctcgatttagagtgagctcgttgggtttgggctgagctgggttttcctcgttgcttcttttaagaggtgtccagtgtcacgtgcagctggtgcagtcgtgggggaggcgtggtccagccgtgggaggtccctgaaactctcctgtgcagcctctggattcgtctcaagtgtctaccctttgcacgtcggtccgcaggctccgaggacaggggctgggaggtgggtggactacttagtctacgatctcgagtaggtaagagtatgaccttagtaccacgagtacgtcgtaggaacgggccgtataccaaccgatactaccgaagacgaactaacttaccaaacaaccactaacgtagtactcgtacaactaaagtacgaacgacgtaccgtaggaacgacgtgtaacgaacgacggtacggacgttacggttagttactacgttggtagtaacggtagtaaggtagtaaggttcgttactttacgtaagttaggtacttacggtaccggtcggtttagggttttaccccgggtttcgttaacccccggtaccgggttccgggggtaacccggtaaccgggttaacccgtaggttaccccggtacgttacccggtaaccgtccgtaacgtacccggttaacccgaacccggtaaccggttaccgttacccggttaccccgttacccggttccccggttaccggtcccgtaaccccgg

SEQ ID NO: 37654 - DNA, 798 bp, Homo sapiens
  misc_feature: GYAE6OF02FTPU5.53.33.C11.1.454.CMB.1.raw
  modified_base (250)..(250): a, c, t, g, unknown or other
  misc_feature (250)..(250): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctggggaggcgtggtccagcctgggacggtccctgaaactctcctgtgcagcctcgtgattcgtctcaagtgtctaccttgcactggtccgcgaggctcaggcaagggctggagtgggtgctactatctnatcgtgagttaggaagtagattgaccgttagttacgcgacgtaccgttccggtaggaaccggtccgtacttaccgaaccgtatcccttaccgaaggtaacgtaaacctaacttaaccgaaagaaaccactaacgttacgttactccgtacgtaactaaaacggttcggaacctacggtaccgtaaggacgaaccgtacgtacgggtaaacgacccggttaccgggagttacgggtttacgttaaacttttacgggtaggttaacggtacggtaagggttacgaacgggttagtttacgttaaccgtttaacgttagtacggttatccggtaaccggtttagggtttaccggggtttaccgggttcccgtttacccgggtaaccccgggtttaccggggacccgtaaacccgggttacccgtacggttacccgtaccgttaccgtttacccgtcccgaaccttaccccggttaacccgaacccggttaacccggcccgttaccggttcccggtttacccccgtcccccgttcggtaccccgtaccccgg

SEQ ID NO: 37655 - DNA, 792 bp, Homo sapiens
  misc_feature: GYAE6OF02HNZ0U.53.33.C11.1.454.CMB.1.raw
  modified_base (365)..(365): a, c, t, g, unknown or other
  misc_feature (365)..(365): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtcccttaaactctcctgtgcagcctctggattcgtctcaagtgtctacctttgcacgtggtccgcaggctccgaggcgaaggggctggaggtgggtgctacttatctcactctgagtaggaagagatcgacctatacgcagactccgtaggacgggccgtattcaccatcctccgaagagacaacttaccaaagaacactacgttacgtatacgtnaactaaagtacggaacgacggtaccgtggaagagtacgtacggaaaggtaccgtacgggtacgttaggttacggtttaacgtttaccgtggttacgggtaacgggtagggttggtaacggtacgtttacgttaaccgttttaacgttaacgttacgtacgttacggtaccggtttaaggggtttaccgggttttaccggggtttaaccccgggtttacccgggtaccccggggtaccgggggtaccccgggttaaacccgggggtaaaccccgttcggggttaaccccgtacccgggttcccgttcccgtaccggttaaccggttcccccttaacccgtaaccccgggtaacccgggtaacccgttcccggtttacccgggttcccccgttaccccccgggttccgggtaccccgtccccgtaccgg

SEQ ID NO: 37656 - DNA, 675 bp, Homo sapiens
  misc_feature: GYAE6OF02FHCB4.53.33.C11.1.454.CMB.1.raw
  modified_base (214)..(214): a, c, t, g, unknown or other
  misc_feature (214)..(214): n is a, c, g, or t
  modified_base (277)..(277): a, c, t, g, unknown or other
  misc_feature (277)..(277): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagccgtgggaggtcctgaaactctcctgtgcagcctctggattcgctcaagtgtctaccctttgcacgtgggtccnccaggctccaggcaaggggcctgggagtggggtggctacgttatcgtcatcctgagtggaagngatcggccttattaccgcagacctccggtaggaacgggcctattcaccgatctccaagacgaactaacttaccaaagaaaccacctactagtactcgtagactaaaacgtggaacacgtccgttagaacgacacgtagaacaccgacggtctgtagtaacttacgtgtgacgtaggtagagttagttacgttaccgttaattaggacgttaacgtcggtaccgttagggttcgggttttacggtacccggtttacccgggacccgttgggggaccctaaccgggtacccgtacgtaccccgtccgtctccccgttacgtaccgtaccccgttaaccgaccccggtaacgggtcccctaacggttcccggtccccttaccccggtacggcccgtccccg

SEQ ID NO: 37657 - DNA, 671 bp, Homo sapiens
  misc_feature: GYAE6OF02HXBUJ.53.33.C11.1.454.CMB.1.raw
  modified_base (293)..(293): a, c, t, g, unknown or other
  misc_feature (293)..(293): n is a, c, g, or t
  modified_base (447)..(447): a, c, t, g, unknown or other
  misc_feature (447)..(447): n is a, c, g, or t
  modified_base (470)..(470): a, c, t, g, unknown or other
  misc_feature (470)..(470): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctggggagcgtggtccagcctgggaggtccctgaaactcctcctgtagccagcctcgtggattcgtctcaagtgttacctaccctttgcacgtgggtcccgccaggcctccgagggccaaggggctgggtagtgggtaggcacttatctctactctagagtaggtaagagtancgtaccttacttacgcgaagtactccggtagaacggccgtattcaaccgatctaccgaagaacgactaattaccgaaagaaccgtaactaacgtgtaactgttagaacaaacgtaggacctacggcctaggataacggctagaacgacgacggngtacgtagttaatacgtgtaggngagtacggtaagtattggtacttaacctatcgtatcgtgtacggttggtttacgtaccgtttacccggaccggttccgtacggaccggtaacccgttcgtaccgtaccgtaccgttaccgtagtaccgtaccgttacccaaccggtaccggaccccgtaacggttccgttaccccgtcccccgttacggcccttaccccgg

SEQ ID NO: 37658 - DNA, 730 bp, Homo sapiens
  misc_feature: GYAE6OF02JD5F8.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtcgtctacccgtttgcacgttgggtccgccaggcctccgaggcgaaggggctggaggtgggtggcacgttatctcatcgtagagtggaagtagatgcctattacgcagctccgtggaacgggccgtattccacctatcctacgaagacgaactaactacctaaacgaaccgactacgttagtactacgtagaactaagtacggaacgacgtacgtaggaaggacgacgtaagaaccgaacgtaccgggtagttacggttagttaaacgtttccgttaggtcgaggtaggtaaggacggtagtttacgttactttaaacgagttacgtaactccggttacggttagggtttaccggttttaccgggtcccggtttacccggtacccgggtcggggtaacccggtaaccgggtaacccgttcgggtacccgttaccgtcccgttaccgtccggtaccgttcccgttaacccgaacccggtaccgggtcccttacgggtttccccggtcccctttacccccgggtccggtccccgtaccccgg

SEQ ID NO: 37659 - DNA, 865 bp, Homo sapiens
  misc_feature: GYAE6OF02FLWSO.53.33.C11.1.454.CMB.1.raw
  modified_base (311)..(311): a, c, t, g, unknown or other
  misc_feature (311)..(311): n is a, c, g, or t
tcagcgcgtatacacacgaccggtgctcgatttagagtgagctcgttgggtttgggctgagctgggttttcctcgttgccttcttttaagaggtgtccagtgtcacgtgcagctggtgcagtcggtgggggaggcgtggtaccagccgtggggacggtacccttaaactctcctgtcgcgacgtcctcgtggacttccgtctacaaggttcgttccttaccctttgacctaccgttcgggtcccgccgacggtccctaccgaggaccggaaggggtcgtagggtaggtgggggtcggtaccttaacctttntaccttacgacttcgtgtaagtagggtaaaggagtaacgtcggtaccctttaacgttaccggacctaacggtcccgttaccggacggggtaacggggtacctactacctaccgtaccttccgaaccgagtaacgaacgttaacttaacccgaaacgaaacccaacgtcttacgtactaccgtagaaacgtaacgcgaacgacggtctaggtaacggacgtaacggtaaggaaacgggtaccggacggtcgtttaggttacgttaaagttcggttcgggtaggacggtagtaagtcgttagttaacggttacttacgtaagtccgagtaccggttcggttaaggggtttccggtttacccgggttaccggttaccccgggtacccgggtccggggttaacccggaaccggggttccccgttggtaccccgttacccggtaccgtcccgtaaccgtacccggttacccaccggtaacccggtaaccggggtccccgtttaacgttcccccgggttccccgtaccccgggtcccggtacccgtaccccggtacccgg

SEQ ID NO: 37660 - DNA, 824 bp, Homo sapiens
  misc_feature: GYAE6OF02GLCKS.53.33.C11.1.454.CMB.1.raw
  modified_base (255)..(255): a, c, t, g, unknown or other
  misc_feature (255)..(255): n is a, c, g, or t
  modified_base (796)..(796): a, c, t, g, unknown or other
  misc_feature (796)..(796): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgtggtccagccgtgggagtccctgaaactctccgtgtgcagcctgtggattcgctcaagttgtcttaccctttgctacgtgggtccaccgagggcctcgaggcgaagggtctaggagttggggngtactattactctacatctagagtaggaagaggtacttgaccttaagttaccgctaacgtaccgttccggtagggaacgggcccgtaattaccgaacccttagttaccctaaccggaagtacgtaaactaacgttaacccaaacggtaaaccacgtaacgttataacgttctaagaacctaaaaggtcggaacaccggtacttagggaacgtaaccggattaacgggaaaaggtacccggtacggtactttacgggtagttttaaaccgttaggtacgggttacgtacgggtaaggttaacggaggttaactttacggtttaccctttaaaggtacttacgtacgtaccggtaccgggttaaggtttttcgggtttacccgggttaacccggtttaccccggacccgggttaggggtaacccggtaaacccggttaaccggttccggtacccgttaccccggttacctccgtaacgtaccggttccccgtaaaccccgaaccggttacggtaaccccctccggttaccccggtttaccccncccgggttacccgaccccgttaccccgg

SEQ ID NO: 37661 - DNA, 814 bp, Homo sapiens
  misc_feature: GYAE6OF02G0QJX.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccgccaggcctccgaggcgaaggggctggaggtgggtggctacgttatctcatcgtgagtggaagagatgcctatacgcagactccgtaggaacggccgtattcacctatcctaccgagacgaactaacttaccaaacgaaacacctaacgtagtactacgtacgaactaaacgtacggacacggtaccgtaaggaggtacgacgtacgaaacgtaccggacggtcgtttaggtagtttaacttaccggtggtacggtacggtaggtacggtaagtacgtttacgtttacctttaacgttaagttcgtaacgttcgggtaacccggtttaaggggtttttacccggggttttaccggggtttaaacccccgggttttacccccgggtaaccccgggttccggggggtaaacccccggtaaaccgggggttaacccccgtttccggggtaaccccgtttaccccgggttccctttacccgggttcctaaaccccggtttcccgttaacccccggaaacccgggtaaccccgggttacccccgtttaaccgggttccccggttttcccccccggtacccccggtccgggtcccccgtacccccg

SEQ ID NO: 37662 - DNA, 886 bp, Homo sapiens
  misc_feature: GYAE6OF02JBO14.53.33.C11.1.454.CMB.1.raw
  modified_base (212)..(212): a, c, t, g, unknown or other
  misc_feature (212)..(212): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccttgcactgggtccncaggctccaggcagggctggagtgggtggcacgttatctcatctgagtggaagagatgcctattacgcagacgtccgtggaacgggccgaacttcaccctatcctaccgagacgaactaacttaccgaaacgtaacacctaacgttgttaactccgttacgaacgtaaacgtaggaacctacggtaccgtaggaacggtaaggtaccgttagggaaaacgtacccgaacggggtcgtttacgggttagttaactttaccgttagggttagtaccggggtaaggttagggtaaaccggttagtttaacggttaaccccttttaacgtttaacgggttacgggtaaacgttcggttaaccccggtttaggggggtttttacggggtttttaccccgggggtttaaccccggttttaccccggggtaacccccgggtttccggggggggaaacccccgggttaaaccggggttaaaccccccgggttacgggttaccccctaccccgggtttaccccttcccggtttaaccccggtaaccggttcccccgtttaaaccccggaaccccgggttaaaccccggggtccccccgttaacccggggttttcccccgggtttacccccccggtttacccccccggggtttacccggggcccccggtttaaccccccccggg

SEQ ID NO: 37663 - DNA, 782 bp, Homo sapiens
  misc_feature: GYAE6OF02HFJHH.53.33.C11.1.454.CMB.1.raw
  modified_base (259)..(259): a, c, t, g, unknown or other
  misc_feature (259)..(259): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggagtccctgaaactctcctgtgcagcctctggattcgtctcaagtgtctacctttgcacgtgggtccgccaggcctccgaggcaaggggctgggagtgggtggcacttatctanactcgtgagtggaagagtatcggtacctagttaccgacgtaagtaccttcccggtaaggaaacgggtcccgtaagtttaccgaacccgtaacgttcccgtacccgaaggtaaaccggtaaaccctaaaacgtttaccccgaaaaggaaacctaaccgtacggttaggtttaactcgtaacgaccgaaaaagtttacgggaacacggtacccgtaggaacggtaacgtccgtaaggtaaacgacccggtaacggtcgtttaggttacgtttaaacgtttaaccgttggttacggaccggtaggtacggtagtaacgttcgttaccgtttaactagtcgtactcgtaccgttaggttcggtttacgggtaccgttacccggtacccggtacggggcccgtaacggggtacccttcgggaccttaccggtaccgttcccgaacgtacggtacccttacccggaaccggtaacccgggtccctacgtttccggttaccccccgttcccggtacggtccccgtcccgg

SEQ ID NO: 37664 - DNA, 646 bp, Homo sapiens
  misc_feature: GYAE6OF02HBWE1.53.33.C11.1.454.CMB.1.raw
  modified_base (371)..(371): a, c, t, g, unknown or other
  misc_feature (371)..(371): n is a, c, g, or t
  modified_base (471)..(471): a, c, t, g, unknown or other
  misc_feature (471)..(471): n is a, c, g, or t
  modified_base (480)..(480): a, c, t, g, unknown or other
  misc_feature (480)..(480): n is a, c, g, or t
tcagcgcgtatacacacgaccggtgctcgatttagagtgagctcgttgggtttgggctgagctgggttttcctcgttgctcttttaaagaggtgtccagtgtcacgtgcagctggtgcagtctgggggaggcgtggtccagcctgggaggtccctgaaactctcctgtgcagcctctggattcgtctcaagtcgtctaccctttgcacgtgggtccgccgaggcctccaggcaaggggctggagtgggtgcacttatctcatctgatggaagagatgtcctaattacggcaacggacctccggtaggaacggggtccgtaacgttcacctacgtcctaccgaagtacgaactaaacttaccaaagaaccanacttacgtactcgtagaacaaagtcggaactaacgccgtaggactaggacctaagggaacgtaccgaacggtcctaggtatttaacttacgtgggttacncggtaaggngtaacggattgttacttacttagacgtatcggacctaggttcgttggtaccgttccgaccggtcggacgaacgggtcctaggtcctaccgtcgtctcggacacccgttccaaccgccgggtaaccctcgttaccgttccccgtaccccgttacggccccttacccg

SEQ ID NO: 37665 - DNA, 620 bp, Homo sapiens
  misc_feature: GYAE6OF02IUITH.53.33.C11.1.454.CMB.1.raw
  modified_base (174)..(174): a, c, t, g, unknown or other
  misc_feature (174)..(174): n is a, c, g, or t
  modified_base (266)..(266): a, c, t, g, unknown or other
  misc_feature (266)..(266): n is a, c, g, or t
  modified_base (593)..(593): a, c, t, g, unknown or other
  misc_feature (593)..(593): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggagtccctgaaactctcctgtgcagcctntggattcgtctacaagtgtcctaccctttgcacgtgggtccgccaggcctccgaaggctaaagggggctggagttggggtgctacgttatcncatctgatgggaagtagatgcctaattcgactagaccgttccgaggaaacgggtccgattaccaactactcctaccgagtaacgaactaattaccgaaaggaaacctactaacgtagtaactcctagaaccgaaaattaggaccaacgttcctaggaagaagacctaggaaagaccgaaccgtgttatacgttaaagtttacgtggttagcgtaaggtgaagtaacttgtacctaagttatgaactgactcgtaggtttccggtcctaccggccgtgggccaggtaccgtcgtacgactctctcggactcgtacccacgacgtaccncgtccgttccgtcctcggaccctcccg

SEQ ID NO: 37666 - DNA, 819 bp, Homo sapiens
  misc_feature: GYAE6OF02JGNVE.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtcctgaactctcctgtgcagcctctggattcgtctcaagtgtctacctttgcacgtgggtccgcaggcctccgaggcgaaggggtctgggaggtggggtcggctactttatcctacatcgtagtactagggaaagagtagtacgtacccttaagttaccggcgaacgttaccgttaccggtaacggggtaaacggggacccgttaacttaccgaacccgtactaccgttacccgaaaggaaccgtaactaactttaacccgaaaaggtaaacctacgtaaccgttaagtaacttacgtaacggtaacctaaaaggttacgggaactaacggtccgtaacggaaacgtacgtacgtaggaaacggtacgtaaccggtcttaggttagttaacgtttacggtacggttggaaccggttaggtaacgtaggtacgtttacggttaccttaagtagttcggtaacgtaccgttacgggttaacgggttttcgggtttaccggttacccgttacccgggtacccgggttaccggggtaacccgtaaacgggttacccgtacggttacccgtacccggttactcccgtaacgtaacccgttcccgtaacccgaaccgggttaccgtacccgtacgtttccccggtacccgtttcccggtaccggcccgttaccgg

SEQ ID NO: 37667 - DNA, 931 bp, Homo sapiens
  misc_feature: GYAE6OF02F86V1.53.33.C11.1.454.CMB.1.raw
  modified_base (219)..(219): a, c, t, g, unknown or other
  misc_feature (219)..(219): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtccttaccctttgcacgtgggtcccnccgaggctccaggcgaaggggctgggaggtggggtaggctacttatctctatctggatagggaagagatgtacctattaccgcaaggtcccttccggtaggaacggggccgtaactttccaaccctatcctacgaagacgtaacctaaacttaccaaacggaaacaccgtaacgttacgtacttacctaggaaactaaaaggtacggaacctacgaccgttagaaacggtagtaccgtaagggaaaccggtaaccgtaccgggtacgttacggtttaacggtttaaagttttaaaccgtttggggttacggacgggtaaagggtttaggaacggttaaacgtttacgggttttaacccctttttaaattaaccggtttggtacgtttaacccgggggttaccgttaacgggggttttcggggtttttttaacccggggtttaacccccgggggtttttacccccggtacccccgggggtttaacggggggtaaacccccggttacccggggggttaaaacccccgttccggggttaccccggttaaccccgggtttccccgttacccgggtaccctaacccgggtttacccccgttaaaccccggaaccccccgggtttaaacccggggtaccccccgtttacgggttttccccccgggtttccccccgggttttccccccgggtaacccggggtccccggttccccccggg

SEQ ID NO: 37668 - DNA, 679 bp, Homo sapiens
  misc_feature: GYAE6OF02IFWW7.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctacctttgcacgtgggtccgcaggcctcgaggcaaggggctggagtgggtggctacttatctacatctagataggaagagatgacctattacgactagaccttccgtagaacgggtcctaattcgacctatacctccaagaacgactaattaccaaagaacacactagtactgtagaacaagtggaacacgcctagacgacgctaagaacgacgaaccgggctaggtagttacttacgtggtacgcggtaagtaggagtaagttacgttacttaacgttaagtagtagtacggtaccgttagggtttacgggtttacggtaacccggtttaccggaccccggttacgggggaccgtaaaccggggtaccccgttagggtacctacccgttcttaccgtccgaaccgtacccgttaaccccggtaaccgaacgggtcccctaaggttcccggttaccccgtttccccggtccggacccgtccccgg

SEQ ID NO: 37669 - DNA, 789 bp, Homo sapiens
  misc_feature: GYAE6OF02INMME.53.33.C11.1.454.CMB.1.raw
  modified_base (363)..(363): a, c, t, g, unknown or other
  misc_feature (363)..(363): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcagtgtcctaccctttgctacgtgggtcccgccgaggcctccgaggcgaaggggctgggaggtggggtggactacgtttatcctcatcgtagagtgggaaagaggatcgtaccttagttaccgacacgtaccttccggtaggaaccgggccgtacttccaccctatccctaccgaanaacgaactaattacccaaagaacacctactcgtactctagaacctaaagcggtacacggtaccgtagacggagtccgtaaggaacgaccgtaacggtcgttaggttacgttacgtttaggtcggttacggtacgggtaggttagaacggttagttacggtttaactttacgtaacgttagtacgtacggtaccggtttagggttttaccggggtttaccggttacccggtttaccccggtaccccgggttacggggtacccgggtaaaccgggttaaccccggtccggtacccgttacccgtttaccctcccgttaccgttacccggtaccccgttaaccccgtaaacccggtaacccgggtacccccgttacggtttcccccggttcccccgtttaccccccgggtaccggtcccccggtacccg

SEQ ID NO: 37670 - DNA, 743 bp, Homo sapiens
  misc_feature: GYAE6OF02ISV3C.53.33.C11.1.454.CMB.1.raw
  modified_base (255)..(255): a, c, t, g, unknown or other
  misc_feature (255)..(255): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctacccgtttgcacgtgggtccgccaggctccgaggcaagggctggagtgggtggcacttanctcatctgatggaagagatgaccttattacgcgaacgaccttccggtaggaacgggccgtaattccaacccgaattcctaccgaagaacgaactaacttacccgaaaagtaaaccaacgaacttgtaactcgtagaactaaaagttcggaaactacgtaccgtaggacgtaacgtccgtaaggaaacgaccgtaacgggtcttaggttagttaacgtttaccgtaggttacgtacggtaggttagaggtaagttacgtttaccgtttaaacttagttagtaagtacgtaccgttaaggtttcgggtttacggttaacccggtttaccggtaccccggttcggggacccgtaaacgggtacccgttcggtacccttacccggttaccgttccgtaccgtaccggttaccttaccccgaaaccggtaaccggtacccgttaacggttccccggttaccccgtttcccccggttccggcccgttaccccgg

SEQ ID NO: 37671 - DNA, 717 bp, Homo sapiens
  misc_feature: GYAE6OF02GMO6F.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggtattcgtctcaagtcgtccttacctttgctacgtcgggtccgccgacggcctccgaggtcgaaggggtctgggaggttggggtcggtctacttatctcatcgtgtagtaggaagagatcgtaccttaatacgctacgtaccgttaccggtagggaaccgggtcgtacttaccgaacctactccgtacgaacgaacgtaacctaacgttaaccaagaacctacgtaacgttagtactcgacgtaacgtaagtacgaacgacgtacgtagagacgacgtacggaacgaccggtacggttcgttagttaacgttacgtttacgtggttcggtaacggtagttaggtaactgtttacgttacttaacgtgtacgtcgtcgtacggtaggtttccggtttaccggtccgtccggtaccgggcgggtaaccgtaacgggtacccttcggtaccctacccggttctaccggtacaccgttacccgtaccgaacccgggtccgtacgttacccgttcccgggtcccctacccggtcggccccgtcg

SEQ ID NO: 37672 - DNA, 661 bp, Homo sapiens
  misc_feature: GYAE6OF02IFO6T.53.33.C11.1.454.CMB.1.raw
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (273)..(273): a, c, t, g, unknown or other
  misc_feature (273)..(273): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtagggacggtccctagaaacctctcctgngcagcctcgtgattcgtntcgaagtcgtccttaccgttncacgtcggtccncgagtctccgaggacaagggctaggagtgggtacggctacttagtcctnactctgagtaggaacgagtagctacctaagttaccgcgtaacgacgtaccggtaggaaacggccgtaacttaccgaacctacgtacctaccgaagacgtaaactaaacgttaccgaaaagtaaccaaccgtaacgtacgttatacgtaaggaaccaaagtacgacgaaccgtccgtaagagactacgaaggaacctacggagtaccgtagttacgtaactaagttgtacgacgtagtagacgtagtagttactatagtanancgacgtacgttggttccgaccgttccgaccggtacggacgtaacggccgtcgtaccgacgtccgttcgctacgtacctacccgaacgccggtaccacgttcccgtaccgtacccgtgacccgtacg

SEQ ID NO: 37673 - DNA, 757 bp, Homo sapiens
  misc_feature: GYAE6OF02GCDXM.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgtggtccagccgtgggacggtccctgaaactctcctgtgctagccttcgtggtattcgtctacaagttgttccttacctttgcacgtcgggtcccgccaggcctccgaggccgtaagggggctgggacggtggggtggacctactttatccttcgattctgaggtacggaagagtatcgtaccttatacgacgagtacgttccgtaaggacgggtacgtactaccactactctaccgagtacgaatactaaccaaagaacacacttagtactcgtaagtaacgaaagtcgggaactacgtcgtacggaggacgtacgtagggaaaccgtacggaccgtctttagggtacttttacgtttcgtcgggttaggtaaccggtaggttagacgtttgtactttacgttactattagtcgttcgaacggtttgggtttaaccggtttcgggttaccccgtacccgggttacccgggtacgggttacccggaaccgggtttacccgtaggttccccgtaccgttccgtaacccgttcgacccgttacccgttacccgggaacccggtaccggtaccccgttaccggttaccccggtttaccccgtccccggttaccggtccccgttacccgg

SEQ ID NO: 37674 - DNA, 979 bp, Homo sapiens
  misc_feature: GYAE6OF02HTKB4.53.33.C11.1.454.CMB.1.raw
tcagcgcgtatacacacgaccggtgctcgatttagagtgagctcgttgggtttgggctgagctgggtttcctcgttgctcttttaagaggtgtccagtgtcacgtgcagctggtgcagtcgtggggaggcgtgggtccagccgtgggagtccctagaaactctcctgtgcagcctctggattcgtctcgaagtgtcctacctttgactacgtcgggtcccgaccgaggcctccgacgggacgaaacgggggtctaggggtaagtggggtaggacctactttatccggtataacgtcgtaagagtagggaaagagtatacggtaccttagtaaccgacgaggtacccgtccggtaggaaacgggtccgtaacttaccaacccagttacccaccgaagtaaacgaacttaaaacggttcccaaaaacggtaaaccaaccgtacttaacgttagtacctaacgggaactaaaaacggtcggaaacgtacgtaccgtaagggacgttaaacggaccttagggaaaacccgacgtaacggtccggttaacggttaacggtttaactttaaccggttggttaacggaaccgggtaagtaccgggtaaagtaacggttaccggtttaaacgtttaaccgtaagttacggtaaagtccgggttaaccgttaacgggggttttaaccggggttttaacccgggttttaaccccggggttaaccccgggttaacccccggggtttacccgggggggtaaaccccggttaaacccgggggttaaacccccggttacggggtttacccccgtaacccggggttttaccccctttaacccgggttaacccggttaacccccggttacctttaaaccccccgggttaaaaccccccgggtaaaccggttaaccccggttaacccgggtttcccccggtttaccccccggttttacccccgggttacccggtaacccccgggttaacccccggg

SEQ ID NO: 37675 - DNA, 795 bp, Homo sapiens
  misc_feature: GYAE6OF02J1XBD.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggtattcgtctcaagtgtccttaccctttgcacgtcgggtccgaccgaggcctccgaggcgaaggggctgggaggtgggtggactacgttatcctcatcgtgagtaggaagagatgacctacgttacgacgcgtaaaaaaaaaccgtccggttaggaacgggccggtacttaccaacctacttaccttaccgaacgaacggtaacctaaacgttaacccaaacggtaaaccaacgtaacgttacgtaacttcgtaacgtacgtaaaggtacggtaacgacgaccgtagtaacggaacggtacgtaacggaaacgaaccggaacgggtccgtaggttacgtttaaagtttacgttacggtacggtacggtaaggtacggtaagtacgttacgtttacttaacgttacgtagtacgtacggtacgttagggtttccgggtttaccggtttacccggttacccggtacccgggtaccggggtacccggtacccgggtaacccggttccggtacccgttacccgtccgttacccgtccgtaccgttacccgtaacccgtaccggaaccggtacccgtaccggttcccggttaccccgttcccgtcccggtacccgtccccgg

SEQ ID NO: 37676 - DNA, 807 bp, Homo sapiens
  misc_feature: GYAE6OF02GK6DI.53.33.C11.1.454.CMB.1.raw
  modified_base (155)..(155): a, c, t, g, unknown or other
  misc_feature (155)..(155): n is a, c, g, or t
  modified_base (318)..(318): a, c, t, g, unknown or other
  misc_feature (318)..(318): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgtggtccagcctgggacggtcccngaaactctctgtgcagcctcgtggattcgtctacaagtcgtccttaccctttgacgtacgttcggggtcccaccagggtcctccgaaacgggcgaaacgggggtctaggggtaggtaggggtacgctacttatccgtacgattcgttagagtaggaagtaggntcgtaccttaattaccgacacggtacctcgggtaggaacggggaccgtacttaccgacctacttccgtaccaaggtacaacctaaacttccgaaaataaccaactacgtacgtaactacgtacgaactaaagtacggaactacggaccgttaaggaacgacggtacgtaaacggaacgtaaccgtacggtcgttaggttagttaacttacgggttagtaacgggtacgttaaagggtcgtaaggttagttaccgtttacttaacttaagtacggttacgtacggtacgttaagggtttacgggtttcccggtttaaccgttcccggggtaaccggttccggggaacccggtaaaccgggttaaaccccgttggtaccccgtttaccggtcccgttaaccgttccggtaaaccgttcccgtttaacccgaacggtacccggtcccttacggtccccgtttaccccgtcccggtacggtccccttacccgg

SEQ ID NO: 37677 - DNA, 796 bp, Homo sapiens
  misc_feature: GYAE6OF02IYAH2.53.33.C11.1.454.CMB.1.raw
  modified_base (115)..(115): a, c, t, g, unknown or other
  misc_feature (115)..(115): n is a, c, g, or t
  modified_base (304)..(304): a, c, t, g, unknown or other
  misc_feature (304)..(304): n is a, c, g, or t
tcagcgcgtatacacacgaccggtgctcgatttagagtgagctcgttgggtttgggctgagctggttttcctcgttgctcttttaagaggtgtccagtgtcacgtgcagctggtnctagtcgtgggggaggcgtggtccagcctgggaggttccctgaactctcctgtgcagtcctctggtacttcgtctcaagtgtccttacccgtttgctacgtcgggtccgccaggtctccgaggtaccgaaggggtctagggaggtgggtcggcctacttacgtctcagtcgtgtacgtaggaagacgtntcgtctatcgacagtacctacggttaggaacggtaccgtaacttccgaacctacgtcaccgtagaacgaaacgtaaccttacgaaacgtaacctaccaacgttagtacgtccgtaagacctaagtcggaactaacggtctaacgtagacgtacgtaaggaaccgtacggtaacggtctacggtttagtaaccgttcggttcgtaggtaccgttaggtaaccgtagtaggttacgtttacttacgttagtaaggttcctacggtacggtttagggttttcggtttaccgggtttacccgttaacccgggtccggggtaacggtaaccccgggtaaccggtttcccgggttaacgtcccgttaacccgggttcccttaccggtccgttaacccggttcccgtaacccgaaacccggggttaacccgttaccggttacccgggttaccccgtttacccccggttccccggtaaccgggtccccctttaacccggg

SEQ ID NO: 37678 - DNA, 641 bp, Homo sapiens
  misc_feature: GYAE6OF02GAQDN.53.33.C11.1.454.CMB.1.raw
  modified_base (261)..(261): a, c, t, g, unknown or other
  misc_feature (261)..(261): n is a, c, g, or t
  modified_base (386)..(386): a, c, t, g, unknown or other
  misc_feature (386)..(386): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaactctcctgtgcagcctcgtggattcgtctcaagtgtctaccctttgcacgtcgggtccgcaggcctccaggcaaggggctggaggtgggtgctacttagtctnatctagagtggaagagatcgacctattacgcagactccggtaggaacgggctattcacctactctaccgagacgaactaattaccgaaagtaacacgtactgtaactcgtagacaagtcggaacncgaccgtagacgagtcgtagaacgacggacgtcgtaggttcgttaacgtttacgtcggttggacggtaggtaggtagtagttagttaccttagttatagtactacggacgttggttacggggttttaccgtacccggttccgtacccgggtgggtacccgaaccgggttaaccgtcggtaccctaccgtacctccgcgtacgttccctaccgaccggtacgccgacgttcccgtccctacccgccggcctcccgg

SEQ ID NO: 37679 - DNA, 761 bp, Homo sapiens
  misc_feature: GYAE6OF02IEMEZ.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgtggtccagccgtgggacggtcctgaaactctcctgtgcagcctcgtggtattcgtctcaagtcgttccttaccctttgctacgtcgggtccaccgaggtcctcgaggacgaaggggtctggaggtgggtcgctacttagtctcatcgtgagtggaagagatcgtacctaagttcgacagtacctcggtaggaacgggtccgtattcccgacctatcctacgacgacgtaactaacgttaccaaacgaacaaccgtactcgttactcgtagaaccgtaaagtcggaacgacggtcctagggaacgacgtaccgtaggaacgaaccgtaccggtcgttaggttacttaacgtttaccgttggtacggtaccgaaggttggtaaaggttacgtttacgtttaaccttaacgttaagtacgttattccgggtaacgttcgggttttacgggttttaccggttaccccgtttacccggtccccgggttaaccgggtacccgggtaacccggtaaacccgggttccggttaccgtacccgttacccgttccgtaccgtacgtacccgtaacccgtaccgaaccggtcccgtaacgttcccccgttacccgtccccgttcccggacccgtccccgg

SEQ ID NO: 37680 - DNA, 676 bp, Homo sapiens
  misc_feature: GYAE6OF02GANC4.53.33.C11.1.454.CMB.1.raw
  modified_base (294)..(294): a, c, t, g, unknown or other
  misc_feature (294)..(294): n is a, c, g, or t
  modified_base (369)..(369): a, c, t, g, unknown or other
  misc_feature (369)..(369): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtgtcttaccctttgcacgtgggtccgcaggctccgaggcgaaggggctagggagtggggtggactacttatctcatcgtgactggaagagatgacctatacgnagactcgagaacggcatcacatctccaagagaactaataccaaagaacactactgtatactgacaaagtcggaanacgtctaggagacgcgtaggtaacgacgtacgcgtttagtacgtttagtacccgtggtacgacgtaagtcggagtagttacgttacttacgtaatggtaactcgggcgttaaggttcggggttttacgggtacccgttacccggtacccgggtacgggggtaccctaaaaccggggaccttcggggtaaacccctcggttacccttaccggttacgaccgttaccccggtaccctaaaccgggaccgggtaacccctttacggtcccgggtttaacccccttcccggtacgggtcccctaccccggg

SEQ ID NO: 37681 - DNA, 700 bp, Homo sapiens
  misc_feature: GYAE6OF02HBJPO.53.33.C11.1.454.CMB.1.raw
  modified_base (221)..(221): a, c, t, g, unknown or other
  misc_feature (221)..(221): n is a, c, g, or t
  modified_base (257)..(257): a, c, t, g, unknown or other
  misc_feature (257)..(257): n is a, c, g, or t
  modified_base (440)..(440): a, c, t, g, unknown or other
  misc_feature (440)..(440): n is a, c, g, or t
  modified_base (537)..(537): a, c, t, g, unknown or other
  misc_feature (537)..(537): n is a, c, g, or t
  modified_base (566)..(566): a, c, t, g, unknown or other
  misc_feature (566)..(566): n is a, c, g, or t
  modified_base (650)..(650): a, c, t, g, unknown or other
  misc_feature (650)..(650): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggagtcgtggtccagcctgggaggtccctgaaactctcctgtgcagcctacgtggattcgtctacaagtcgtcttaccctttgcacgtcgggtccnccaggcctccgaggcgaaggggcctgggaggtgggngacctacttactcgtcatcgtgagtacggaagtagaacgttcgaaccttagttaccgacgacgtacctcccggtaagggtaaccgggccgtacttacccggaacctacttccgtacccaaaaggactaaccgtaaactttaacccgaaaacggtacaaacctacgtaggttaacctcgttaanaaccgtaaaagttccggaacaccggttaccaggtaacggataccgtaagggaaaccgtaaccgaccgttacgtacggttgttaacgttacgtaaggngtacgagtagtacgagttagtactttagnttgactcgacggttgtttcgggttacgtaccgtccggaccggtaccgggtacgacggaaccgtgacccgtcgtaccctcgtacncgtccaaccgtacgacgtcctacgtccgttaccctccgtacgcccgtccg

SEQ ID NO: 37682 - DNA, 691 bp, Homo sapiens
  misc_feature: GYAE6OF02HJ1RB.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcacgtgggtccgccaggctccaggcgaaggggctgggaggtggggtgctacttatctcatctgatggaagagatcgaccttattacgcacgactccgtaggaacgggccgattcacatctcagagacaattaccaaagaacacactagtatactgacaaagtcggaacagcctagagagtcgtagaacgacgacggtctagttagttagttacgtagtcgtaggagtagagtagttcgtttacttacgttaagtgagttcggtccgttagggtttacgggtttaccgggttacccggttacccggtaccccgggtacgggggtacccgggtaaccgggtaacccggttacgggttacccgtaccccgttccgttacccgttccggaaccggttacccgttaccccgaaacccggtaaccgggtaccccgttacggttccccgggttaccccgtttaccccccgggttccgggtacccccgttccccgg

SEQ ID NO: 37683 - DNA, 800 bp, Homo sapiens
  misc_feature: GYAE6OF02HPPZU.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtctgggggagcgtggtccagcctgggaggtccctgaaactctcctgtgcagcctctggtattcgtctcaagtgtcctacctttgctacgtcggtccgccaggtcctccgaggccgaaggggtctagggaggtgggtcgctacgttatctacgatctagtagtaggaagaggtatcggtacccttaagttaaccgccgtaaggtacccgttacccgggttagggaaaaccggggtccctaacgtttacccgaaaccgtactttaccccgtaccgaaggtaaaccggtaaccttaaacgtttaacccgaaaacgaacctaaccgtaacgttacgttactactaacggaactaaaacgttacggaaccaacggttcccgtaagaacggtaacgtacgtaaggaaacgtaccgacgggtactttagttacggttaacttacgtgtacgagtaggtagacgtagttacgtttactaagttacgagtacgtccgtacgttaaggtttaccgggtttcggtttaaccccggtccggacccgggttacgggacccgtaacgggtaaacccttcggttaccctacccggtttccgaccccgttacgtacggttcccttaaccccgaaccggtaccggttacccctacggttccccggttccccgttcccggaccgggttcccctacccgg

SEQ ID NO: 37684 - DNA, 779 bp, Homo sapiens
  misc_feature: GYAE6OF02INV0U.53.33.C11.1.454.CMB.1.raw
  modified_base (519)..(519): a, c, t, g, unknown or other
  misc_feature (519)..(519): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgtggtcagccgtgggagtccctagaaactctcgtgtgcgacgtccttgtaggtatttccgtctacgaagttcgtcctttacccgtttgacctacggttcgggtcccgaccgaggtcctaccgagggtaccgaagggggtcctagggagggttggggtacgaccttactttactccgtcgtatcgttaaggaagttagggaaagcgtaacgtccgtaccgtttaagtaaccgaccgtaacgtaccccgttacgggaacgggtaccgggtaccttattaccgaacctcgttacccgacgaaaggtaacgttaaacctaaacttaaccgaaaacgacctaacctcgttatacgtacgttaacgaactaacggtcgaactacggtctaaggngtacgcgtaagtaacggcgacgtcgttagtagttaacgtacgtaggtcggagtagtagtacgttagttcggttattacgtagtacgtagtccgtcggttacggttttacgggttacccggtaccgtaccccggtacgggtccgggtaacccggttacggaacccgtttccgtaccgtaccgttcctaccgcgttaccggtccctaacgacccgtaccggtcctacccggtttccgtaccccgtccgtccgcccttcccgg

SEQ ID NO: 37685 - DNA, 771 bp, Homo sapiens
  misc_feature: GYAE6OF02G0DX9.53.33.C11.1.454.CMB.1.raw
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
tcagcgcgtatacacacgaccggtgctcgatttagagtgagctcgttgggtttgggctgagctgggttttcctcgttgctcttttaagaggtgtccattgtcacgtgcagctggtgcagtcgtgggggaggcgtggtccagcctggggacggtccctgaaacctctcctggtgcagcctcgtggattcgtctcaagtcgtccttaccctttgcctacgtcgggtccgaccgaggctccgaggtcgaaaggggtctgggaggtgggtcgctaacttatcnctattcgngtagtaggaagagtatcgtactatacgnacgaccgtcgnggtaacggcctacttccacctgtacctaccggagtaactaaccgtaactaccgaaagaacctaacgacttacgtaactcgtaagacctaaagtcggaactcggtccgtaggagtcggtacgtaacggaacggtcgacggtcgtagttacgtaactttcggtagtacggtacgtagtaggtgttacgtacgtttacttacgtagtacgtagtaccgtcggtttagggtttccggtttaaccggttacccggggttacccggttacccggggtacgggggttaacccggtaaccggggttaaaccgttccgggtacccgttaccccgttaccgtaccggttaccggtacgttacccccggtaacccgtaacccggtaacccgggttacccttacccggtttaccccgggtttccccgtaccccgggttccggttcccccgtacccgg

SEQ ID NO: 37686 - DNA, 768 bp, Homo sapiens
  misc_feature: GYAE6OF02GOX50.53.33.C11.1.454.CMB.1.raw
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctcgtggattcgtctcaagtgtctaccctttgcacgtcgggtccgccaggctccgaggcgaaggggctgggagtgggtggctacttatcncattctgatgggaanagtatgaccttataccgcaggtacctccggtaggacgggtcctagtaccacctactctaccagacgaactaacttaccaaacgaacacactacgtactctagaactaatacggactacgccgtaagacgagtccgtaagaacgaacgacggtcttaggttacgtttaatttaccggtggtacgaacgggtacgtagggtaacgtacgtttccgtatttaacgtttaggtacgttacgtacgggtaccggtttaggtttcggggtttacccggttttaaccccggttcccggttaaccccggggtcggggttaaccccggaccgggttaacccgggttccggttaacccgtacccgggtttcccgttaaccccgttcgttaaccccggttcccgttaaacccccgaaccccggggttaaccgggtacccccttacgggtttaccccccggttacccccgtttaccccggttccgggtacccccgttccccgg

SEQ ID NO: 37687 - DNA, 793 bp, Homo sapiens
  misc_feature: GYAE6OF02H5R2Q.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtggggacggtccctgaaactcctccgtgtgcagcctcgtggtattcgtcctacaagtcgtccttacctttgctacgtgggtcccgcgaggtcctaccgagggcgaaacgggggtctggggaggttcggggtcggacctaacgttatcctacgtacgttcgtaggagttagggaaagaggtactacgtaccttaagttaccgactaacggaccgttaccggtagggaaacccgggtaccgtactacccgaaccacgttcccgtaccgaacggaacgtaaactaaaccttaaccgaaaacgaacctaacgtaactaaggtaccttacgtagaacctaaaggacgtacgaacgtcgtaagacggtgacgaagaccgtacgaacgtcgttagtgttaattacgtggtacgacggtagtggtaagtcgttacgttacgttagtacgtgtaagccgttaggttacgggtttcggttaccggttacccggtacccggtacccgggttaccgggaccggtaaacccggtaccgttaccgggtccctacccgtttcccgtacccgttccgtaaccgtacccgtaccccggaaccgttcccgggtacccgttacgggttccccgtttaccccggtccccgttcccggtacccgtcccgg

SEQ ID NO: 37688 - DNA, 1012 bp, Homo sapiens
  misc_feature: GYAE6OF02HSCL7.53.33.C11.1.454.CMB.1.raw
tcagcgcgtatacacacgaccggtgctcgatttagagtgagctcggttgggtttgggctgagctgggttttcctcgttcgtcttcttttaagaggtgtccagtgtcacggtgcagctggtgcagtcgtgggggaggcgtggtcagtcgtgggaggtccctagaaactctccgtgtgcacgcctcgtggtacttcgtcttacgtaagtcgtaccttaccgtttgcgtacggtcgggtaccgaccgacggtcctaccggacggacggtaaggggtcgtagggtggtcggggtcggacgttaacgttacttaccgtacgtaacgttcgtacgtaggtaacggaagtacgtaacgttcgtaccttacgttaaccggacgtaacggtaccggttaccgggtacgggtaaaccgggtaccgttaacgttaccgtaacccgtacgtaccgtaaccggtaaacggtaaacgtaaacccgttaaaaccttaaacccggaaaacggtaaccgtaaaccgttacggtaacgttaaccgtaacgtaccgtaaacgtaaacggtaacggtaaccgtaacggtaccgtaaggaacggtaacggtaccgtaaacggaccgtaaacggtaccggttacgtttaacggtacgttttaaccggttacgtacgggttacgttaacgggtacggttaagttaacgttacgggtttaacggtttaccttaaagggtttacggtaacgtacggttaacccggttagggtttaccgggttttaaccgggttttacccggggtaacccccgggttttacccgggtaacccggggttaacgggtaaccccggggttaaacggtttaccccgggacgggtttaaccccgtccggggttttccctacccgggtaaccggttacccggtttaaccccggtaaacccgttaaccggggtaccccggtttacccgtttacccgggtttaccccgggttccccccggtttacccgggtacccggttaccccggttaaccccgg

SEQ ID NO: 37689 - DNA, 604 bp, Homo sapiens
  misc_feature: GYAE6OF02GH1KG.53.33.C11.1.454.CMB.1.raw
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcaggtctgggggaggcgtggtccagcctgggaggtccctgaaactctcctgtgcagcctctggattcgtctcaagtgtctacctttgcactgggtccgcaggctccaggcaaggggctaggagtgggnggcacgttatctcatcgtgatggaagagatggcctattacgcagtctcgtaggaggccgattcaccatctcagananaacttccaagacacatgtatctnataaactggacngctagngacgtangaagacgacggcgtgtgtattacgtgtgcgtagtaggagtacgttcgttattacgttagtgtactcgtacgtacggttacggttttacggtacccgtttaccgtcccggttaccgggccgtaacgggtaaccccgttggtacccgtaccgtacccgttcgtcgtacgtcccgttaccgacccgtaaccggaccctacggttcccgtttaccctcccggttacggcccgtaccccg

SEQ ID NO: 37690 - DNA, 781 bp, Homo sapiens
  misc_feature: GYAE6OF02GDBZY.53.33.C11.1.454.CMB.1.raw
  modified_base (171)..(171): a, c, t, g, unknown or other
  misc_feature (171)..(171): n is a, c, g, or t
  modified_base (178)..(178): a, c, t, g, unknown or other
  misc_feature (178)..(178): n is a, c, g, or t
  modified_base (228)..(228): a, c, t, g, unknown or other
  misc_feature (228)..(228): n is a, c, g, or t
  modified_base (454)..(454): a, c, t, g, unknown or other
  misc_feature (454)..(454): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctggggggaggccgtggtccagcctgggaggtccctgaaacctctcctgtncagcctntggtattcgtctacaagtcgtaccttaccctttgcctacgtcgggtcccnccgaggtcctaccgaggcaacggggtctagggacgttgggtcgacctacttagtctacattcctggtatagggaagaagtatacggtccccttaattaccgacgaacggtaccgtcccggtaaggaaccggggacctactttccaacccgatcctaccaaggaacgtaactaacttacccaaaggtaacctaacctacgttagtaactctacggaacgttaaacgngggaacctacggtcccttaagggaacgtaccggaccgttaaggaaccgtaacccgggtaccggtaaccgttaggttaacggtttacctttaacggttcgggtagtaccgggttaagtaccgggtagttaacgttacggttacctttaagtagttacgacgttacgtacgttagggtttaccgggtttaccggtaaccccgtttcccggacccgggtgggtaccctaaaccgggtacccgttcgtaacccgtccgttacctccgtacgtacgtccttacccgaacgaccgtcccgacgttcccgttcccaccccggtcgccctacccg

SEQ ID NO: 37691 - DNA, 769 bp, Homo sapiens
  misc_feature: GYAE6OF02H8T91.53.33.C11.1.454.CMB.1.raw
  modified_base (128)..(128): a, c, t, g, unknown or other
  misc_feature (128)..(128): n is a, c, g, or t
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (428)..(428): a, c, t, g, unknown or other
  misc_feature (428)..(428): n is a, c, g, or t
tcagcgcgtatacacacgaccggtgctcgatttagagtgagctcgttgggtttgggctgagctgggtttcctcgttgctctttaagaggtgtccagtgtcacgtgcagctggtgcagtcggtgggggnggcgtggtccagccgtgggacggtcccctagaaaactctcctgtcgcagcctcgtggtcttcgtctacagtcgtccttccttncgcgtcggtccgcngcctacgaggacggagggtcgnggtggtggngacctacgtactctacatcgtgagtggaagtaggatcgtcgttaagtaccgacgtacgtaccgtccggtaggaacggtcctacctacaaccgtcctcctacgaacgtacgaactaaccgtacaaaacgacgtacctagttacgtacgttacaacgaataaccgacggaaacncggttacgaacgtagacgtaggaaacggtacgaccgtacggtacgttacgttagttacgttaacgtgtacgcggtaggtacggtacgtagttacgttacgttacgtacgtacgtaacgttcggtacgtttcgggttaaccgggttttacccggttcccgggttacccggtaccccgggtaaccgggacccggggttaaaccggtaacccccggtttcgggtaccccgtacccgtacccgttaccggtccgtacccggttaccctaacccgggaaccccggtaccggtacccgttaccggttcccggttccccgtccccggtaccggccccgttaccccggg

SEQ ID NO: 37692 - DNA, 790 bp, Homo sapiens
  misc_feature: GYAE6OF02HXW6E.53.33.C11.1.454.CMB.1.raw
  modified_base (723)..(723): a, c, t, g, unknown or other
  misc_feature (723)..(723): n is a, c, g, or t
  modified_base (729)..(729): a, c, t, g, unknown or other
  misc_feature (729)..(729): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagccgtgggaggtccctagaaactctcctgtgcagtcctctggtattcgtctcaagttgtccttaccctttgcacgtcgggtccgccgaggcctccgaggcgaacggggctggaggtgggtggactacttatcctactatcgtgagtaggaagagtatcgtaccttaacgtacgacgaacggtcctaccggtacggtaaccggggtaccgttacgttacccgtaaccgtacttaccgtaccgaacggtaacgtaaaccttaaacgttaaccccgaaaacggaaaaccctacctaacgttaacgtacgttacctagaaccgtaaaagttacgggaacgtaaccgtaccgtacgaacggtaacggtaccgttaaacggaacggttacggaaccggttccgttttaggttaacgtttaactttacgggttgtaaccgggtagggtaacggtaaggtacgttaagttacggtttactttaactaggtaccgtagtccggtacgttaggtttacgggtttaccgtcccggtacccggcccgggtacggggtaccgtaccgggtacctcggacctacccgttcctaccgngtaccncctaacccgaccgaaccggttcctcgttcccgggttacccctcccggtcggtcccgtaccg

SEQ ID NO: 37693 - DNA, 982 bp, Homo sapiens
  misc_feature: GYAE6OF02GIXQB.53.33.C11.1.454.CMB.1.raw
  modified_base (298)..(298): a, c, t, g, unknown or other
  misc_feature (298)..(298): n is a, c, g, or t
tcagcgcgtatacacacgaccggtgctcgatttagagtgagctcgttgggtttgggctgagctggttttcctgttgctcttttaagaggtgtccagtgtcacgtgcagctggtgcagtcgtggggaggcgtggtccagcctgggaggtccctgaaactctcctgtgcagcctcgtggtacttcgtctcaagttcgtccttaccctttgcctacgtcgggtccgccgaggcctccgaggcgaaggggtctggaggtcgggtgacctaacttatccgtactatcgtggagtaggaaacgngtactcgtaccttagtacgacctagtaccgtaccggtaggaaccgggtacctaacgttaccacctacgttcctaccgaaggtaaacgtaaccctaaacgttaacccaaaacggtaacctaactaaccgttcggttaacttaccgttacggaaaccgtaaacgtacgggaaaacccgtaccgggtaccgttaaacggaacggtaacggtaaccggtttaaacgggaaaacccggtaaccgtaacggggttacccgttaagggttaccgttttaaacgttttaccggtacggggttacgtacggggtaacggttacggaaacggttaagtttacccggttttaattaaaccggtttaaggttaaacggttaccggttaaccggtacccgggttttaaacgggttttacccgggggtttttaaacccgggttttaccccccggggttttaacccgggtacccccgggggttaccgggggtaaaaccccggttaacccggggggttaaccccctttacggggtaaaccccgttccccgttttcccgtacccgttaacccgggttaacccggttaccccgttaacccccggtaacccggtaaccccggggttaccccttaacccggggtttccccggtttaacccccccgttcccccgggttacccggggttacccccgtaccccccgg

SEQ ID NO: 37694 - DNA, 635 bp, Homo sapiens
  misc_feature: GYAE6OF02HQ8VG.53.33.C11.1.454.CMB.1.raw
  modified_base (356)..(356): a, c, t, g, unknown or other
  misc_feature (356)..(356): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtgctacttatctcatcgtgatggaagagatgcctattacgcagactccggtgaacgggcctattcacctatcctaccagaagactaattaccaaagaacacactagtatctanacaaagtcggaacagcctaggagagacgtagaacgacgtacggtcgtagttacgttaatacgtggtacgacgtagtaggagtattgttaccttattatgtatcgtacgtaggtttggtttacggtcccgttaccgtacccggtcgggaccgtacgggtaacccgttgggtacctacccgttctcccgtcgtacgtacccttaccccggaaacccgtaccgggtaccccgtacggttaccccggttccccgtttacccccggtcgggccccgttaccccg

SEQ ID NO: 37695 - DNA, 816 bp, Homo sapiens
  misc_feature: GYAE6OF02JPR84.53.33.C11.1.454.CMB.1.raw
tcagcgcgtatacacacgaccggtgctcgatttagagtgagctcgttgggtttgggctgagctggtttcctcgttgctcttttaagaggtgtccagtgtcacgtgcagctggtgcagtcgtggggacgcgtggtccagccgtgggacggtccctagaaactctccgtgtgcacgtcctcgtggtactttccgtctactaagttcgttaccttacccgtttgccgtacgtcgggtcccgaccgacggtcctaccgaggaccggaacggggtccgtggggtaacggttggggtcggaccttacgtttactcgtcgtaacttcctaggagtagggaagtacgtacgttccggtacttaacgttacgaccgtacggttaccgtccggttaacgggacggtacccgtaacttaccgactacgtacctacggactaaacgtacgtaaacctaaccgaaacgtaaccacctaacgttactaatacgtacaaacgtaacgtcggaactaccgacgtacggaagtcaacgttaggaacaccggcttagtcgttactaagttacgtgagggtaactggtagtacgtagttaccgtttagttactcgtaacgtacggtagtaccgggttaacttttcggggttaacccgtttcgggttacccccggaccgggttcccgggtaaacggtccccgggttaaccgttccggtaccccgttaccgttcccgttaccgtcgttaacccgaccgttaaccccggaaacggtaccccggttcgacccggtttcccccgttaccccgtcccggttacccgtcccggttaacccgg

SEQ ID NO: 37696 - DNA, 750 bp, Homo sapiens
  misc_feature: GYAE6OF02F65EN.53.33.C11.1.454.CMB.1.raw
  modified_base (257)..(257): a, c, t, g, unknown or other
  misc_feature (257)..(257): n is a, c, g, or t
tcagcgcgtatacacacgaccggtgctcgatttagagtgagctcgttgggtttgggctgagctgggttttcctcgttgctcttttaagaggtgtccagtgtcacgtgcagctggtgcagtcgtgggggagcgttggtccagcctgggaggttcccctagaaactctcctgtgcagcctcgtggacttcgtctcaagtcgttcctaccctttgcacgtggtccgccaggcctccgaggcgaaggggctggaggtgggngctacttagtctcatcgtgagtaggaagaagtagtcgtccttaatacgtaccgaggaaccgttcccggttaggaaacggggcccgtaacttaccaaccgtacctcctaccgaagaacgaactaactttaaccaaaggtaaaccacctaacgtagttacttctagtaaccaaagtcggacacgtacctaggaagacgacgtacggaacgacgtacggtacgttggttattacgttacgtggtcggacggtacggtaggtagtagtttacgttactttaacgttagtagtacgtcgtacgttacgggtttcgggtttaccgggtttacccgttacccgggtaccccgggtaccgggggtaacccggtaccgggttaacccgtcgggtacccttccggttcctcccgttacggaccttcccgtaacccgaccggtaacccggaccccttacggttccccgtacccccggtttcccggtacccggtcccgtccccgg

SEQ ID NO: 37697 - DNA, 660 bp, Homo sapiens
  misc_feature: GYAE6OF02FTTNA.53.33.C11.1.454.CMB.1.raw
  modified_base (213)..(213): a, c, t, g, unknown or other
  misc_feature (213)..(213): n is a, c, g, or t
tcagcgcgtatacacacgaccggtgctcgatttagagtgagctcgttgggtttggggctgagctgggttttcctcgttgctcttttaagaggtgtccagtgtcacgtgcagctggtgcagtctgggggaggcgtggtccagcctgggaggtccctgaaactctctgtgcagcctctggattcgtctcaagtgtctacctttgcactgggtccnccaggctccaggcaaggggctggagtgggtgctacttactctcatctagagtaggaagagatcgctattacgcagacctcgtagacgggccgattccaccatcctaccagaacgaactaacttaccaaagaaccacacgtagtatcagactaagtagactagcctagacgacgacgtagaacgacgacggtctaggtacttaagttacgtggtacggagttaggagaaggttagttacgttaccttacgttataggtactacgtacgttagggtttacggtttaccgggttaacccgttccggacccgggttacgggggcccgtaaacggggtacccttcgggtaccctaccgttcctcccgtcgaccggttccctaaccggaacccggtaaccgggtcccttacggttaccccgtttccccgttacccggtccgccccgttacccg

SEQ ID NO: 37698 - DNA, 837 bp, Homo sapiens
  misc_feature: GYAE6OF02JLYZ8.53.33.C11.1.454.CMB.1.raw
tcagcgcgtatacacacgaccggtgctcgatttagagtgagctcgttgggtttgggctgagctgggttttcctcgttgctcttttaagaggtgtccagtgtcacgtgcagctggtgcagtcgtgggggaggcgtggtccagcctgggaggtccctgaaactctcctgtgcagcctctggattcgtctcaagtcgtccttaccctttgacacgtcgggtccgccaggcctccgaggcgaacggggctgggaggtggggtcggtaccacgtttactcctactagtctggtaacgtagggaagaggtatcggtaccttaattaccgctaacggtacccgttaccggtaacgggaacggggtcctaacttacccaaccgtactccgtaccgaagaacgtaactaacttaaccgaaaggaacctaaccgacttagtactacgttacggaaacctaaagtcggaactacggaccgtagaacgacggtacgaaacgaacggaccggtaacggtcgttaacggtgttaacttacgtaggtacggtaacgtaggtacggagtacggttacttacgttacgttaaacgtgtaaccgtcggtaccgttacgggttttaccgggtttaccgggtttacccgggttaaccccggtaccccgggggttacggggtaaccccggttaaacccgggtaacccgggttacccggtacccgttcccggttaccgttacccggtaaccgttaccccgttacccggttaaccccgtacccgggtaaaccgttcccccggtttacggttcccccgtttccccggttacccccggttacccggccccggtttaccccgg

SEQ ID NO: 37699 - DNA, 896 bp, Homo sapiens
  misc_feature: GYAE6OF02IXYLS.53.33.C11.1.454.CMB.1.raw
  modified_base (117)..(117): a, c, t, g, unknown or other
  misc_feature (117)..(117): n is a, c, g, or t
  modified_base (124)..(124): a, c, t, g, unknown or other
  misc_feature (124)..(124): n is a, c, g, or t
tcagcgcgtatacacacgaccggtgctcgatttagagtgagctcgttgggtttgggctgagctgggttttcctcgttgcttcttttaagaggtgtccagtgtcacgtgcagctggtncagtcgngggggagcgtggtccaggccgtgggacgttccctagaaaccttctccgtgtgaccacgccttcgtggtactttccgtcttacaagttcgttaccctttacccgtttgctaccggttcgggcccgacgagggtcctaccgagggtaccggaagggggtctaggggtacgggtcgggtcgaaccttactttacgtcctcggtatcgtagtaacgtagggaagtacgtcgttccgacctttaagtacccgacgtagtacccggttaccgggtaaggtaaaccggggtcctaaccgttcccgaaaccctacttacccggtaaccgaggtaacgtaaccgtaaacgttaacccaaaacggacctaaccgtaacttgtaactacggacgttaaccaaaggtccgataccggtagtaacgagggtacctacggtaacggaacgaaccggttccggtaattttcggaacgtttaacggttaccgtggtacgggacggtaagtaacggttacttaggttacttttacttaacggttgtaacggtaccggtttccggtaaaccgtttgggttttaacccggggtttacccgttttaaacccgggtacccgggtaacccggggtaacgttcccggggaaaccccggtttaaccgttcggttaaccccgttaccgggtccctttaacggcccgtttacccgaaccttaacccccgggtaacggtaccggcccctttacccggttccccggtttacccgtcccggtaccggtccccggttaaccc

SEQ ID NO: 37700 - DNA, 767 bp, Homo sapiens
  misc_feature: GYAE6OF02FXOQ0.53.33.C11.1.454.CMB.1.raw
tcagcgcgtatacacacgaccggtgctcgatttagagtgagctcgttgggtttggggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccagggcctccagggcaagggggctgggaggtggggtggctacttatctcatctgatggaagagatgacctacttacgcacgactccggtaggaacggggccattccactactcctccagacgaactaacttaccaaagaaccactactacgtatcgtagactaaaagtcggaacacgaccgtagagacgactacggaagaccgtacggtctacggttagttactttacgtggttcgacggtaagtcggaaaggtactttacgttaccgtttaatacgttagtaccggttaggtaccggtttaagggttttacgggggttttacccggggtttaaccccggttaccccggggtaccccggggttaaggggggaaccccggtaccggggtaaccccgttcgggggtttacccctacccggtttacccgtacccgtttaccgaacccggtttccccgtttaaaccccggaacccgggttaaccgggtcccctttaaccggggtttccccgttaccccccggtttttccccggccgggtccccgttaacccccgg

SEQ ID NO: 37701 - DNA, 506 bp, Homo sapiens
  misc_feature: GYAE6OF01EMYV4.41.73.G07.1.454.CMB.1.raw
  modified_base (323)..(323): a, c, t, g, unknown or other
  misc_feature (323)..(323): n is a, c, g, or t
  modified_base (433)..(433): a, c, t, g, unknown or other
  misc_feature (433)..(433): n is a, c, g, or t
  modified_base (501)..(501): a, c, t, g, unknown or other
  misc_feature (501)..(501): n is a, c, g, or t
tcagtctatactatcacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgccagactgttgacgacgacttagcctggtaccaacagaagcctggccaggctcccagactcctcatctatgatacttcagtagggcctgtggcatcccagcccgnttcagtggcagtgggtctgggacagacttcactctcacatccaccagccctagacgtcctagaagtattttgctagtttatactgtctacaccgtaagagtgcctcaatntcactttcggcctggacaagtgatatacaaacgactgtgctgcacatctgtcttcactcttcccgctntctag

SEQ ID NO: 37702 - DNA, 164 bp, Homo sapiens
  misc_feature: GYAE6OF01CDYYX.41.73.G07.1.454.CMB.1.raw
  modified_base (162)..(164): a, c, t, g, unknown or other
  misc_feature (162)..(164): n is a, c, g, or t
tcagtctatactatcacgaccggtgctcgatttagctctacgctcagggcacgaccggtgctcgatttagtcacgcgagaaagggaagggggctggccctagcgtgttcctgttcccgccctcctcatagtatagactgagcgggctggcaaggcgcatagnnn

SEQ ID NO: 37703 - DNA, 665 bp, Homo sapiens
  misc_feature: GYAE6OF01ACVRV.41.73.G07.1.454.CMB.1.raw
  modified_base (194)..(194): a, c, t, g, unknown or other
  misc_feature (194)..(194): n is a, c, g, or t
tcagtctatactatcacgaccggtgctcgatttagctctacgctcagggggaggaactgctcagttaggacccagagggaaccatggaagccccagctcagcttctcttcctcctgctactctggctcccagattccaccggcgaaattgtgttgacacagtctccaggcaccctgtctttgtctccagggganagagccaccctctcctgtagggccagtcggagtgttgctaagtacctagcctggtaccaacagaaacctggccaggctcccaggcctcctcatctatgatgcatccaacgaggtcacgtggccaccccagactaggttcaggtggcaggtgggtctgggacagacttcactctcaccgtcagcaatgtacacgcctagaagtatttgcttagtttattacgtgtcagctacgtccgttcctccgacggccgtcctcgtaccggttttaccggggaccggggggtaaccgtaaggggtacggaacgtacgtaccggaacggtaaccggtaaacggttcgggttacgggtaccgttacgggtacccctaacccggttaccgtttacccggtttaccggttttaccccgttttaaccccgttaacccgttttaccccccgtttacccccggttccccgttaacgtttaccccgg

SEQ ID NO: 37704 - DNA, 608 bp, Homo sapiens
  misc_feature: GYAE6OF01EKGFA.41.73.G07.1.454.CMB.1.raw
  modified_base (328)..(328): a, c, t, g, unknown or other
  misc_feature (328)..(328): n is a, c, g, or t
tcagtctatactatcacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggccagactgtgacgacgacttagcctggtaccaacagaagcctggccaggctcccagactcctcatctatgatacttctagtaggcctcgtggcactccccagtccccgtnttcgagtggctaggtcgggtctggggacaggtacttcacgtctaccacctataccaccagacctagacgtcctagtaagtattttacgacgttagttttacttacgtgtactacgtaaccgttaagaacgtcggaccttactaattacttacttaccgttcccggacccgttacgggaacccgtaaggtcggtaaacttaacgtacaaaacgtacgtgtacggctacggacctaccattcgttcgtccttacacttcccttcccgacctcttcgtgtaac

SEQ ID NO: 37705 - DNA, 685 bp, Homo sapiens
  misc_feature: GYAE6OF01BFX53.41.73.G07.1.454.CMB.1.raw
  modified_base (212)..(212): a, c, t, g, unknown or other
  misc_feature (212)..(212): n is a, c, g, or t
  modified_base (466)..(466): a, c, t, g, unknown or other
  misc_feature (466)..(466): n is a, c, g, or t
tcagtctatactatcacgaccggtgctcgatttagctctacgctcagggggatcaggactcctcagttcaccttctcacaatgaggctccctgctcagctccgtggggctgctaatgctctgggtctcgagggtccagtggagatattataatgactcagtcctcccctcctcccgtcggcccgtccaccccgtggagacgcccggcctccnctcctcctgtacggtctagtgagtagttcgttgggaggtacaagaactatactatggtggtacttggttacttcgacgaacggaacggccgggtactacgtcctaccaacctactacctgtactttcgttacggtttcggtccgtaccggtccgggtcccggttccggggtccttcgtacggtacgtacggttcgacggtcgccgtagtcgccactacaaccacactattacttacacacgtcgacactacganacgagacggtaggtcgaggcgtacggtacgttaggttgggttcggttaattcgttaacgctaaccgtactaaccgttaacgttaccccgtaaacccgttaacccgttccgtaaccggtaccgggaaccggtaaacgggtacctacggtaacgtagtaaacggttagtaacggaccggtcgtaggtccgttaccacgtacctaaccgttcgttcgttacg

SEQ ID NO: 37706 - DNA, 791 bp, Homo sapiens
  misc_feature: GYAE6OF01EYPCZ.41.73.G07.1.454.CMB.1.raw
  modified_base (197)..(197): a, c, t, g, unknown or other
  misc_feature (197)..(197): n is a, c, g, or t
tcagtctatactatcacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacngccaccctctcttgcgagggcccggccagactgttgacgacgtacttacgccgtaggtaaccaacgaggaacgccgtgggacccgacgggcccttaccccgaacggtacccttccccttactaactttaccttaagttacggtaacttttaacccgtttaccgttaacgggttaaccggggggtcccctttccggttcgggaccctaaccgttcccccgaaccggtcccccgttctttaccggacggttcggcgtacggggttcgggtcgtacggggacctacggtaccttccgaccttcctaccgtaaccctacgttacccaacccgaacgtacccgtaaggaccgtcccgtaaggtaacgtttagttttacgactttaagttttactttacgtacgttacctaaccgtaaccgttaaaggtacggttccgtaacccttactaaattaccgttaccgttacgtttcccggacccggttacgggaaccgtaaagggttcgtaacttaacgaaccgtaaacgtacgttggtacgccgttacgacccacgtgttccgttcgttccttacgaccttcgttaccgcttagtcgttaag

SEQ ID NO: 37707 - DNA, 290 bp, Homo sapiens
  misc_feature: GYAE6OF02FXIM3.41.73.G07.1.454.CMB.1.raw
  modified_base (286)..(290): a, c, t, g, unknown or other
  misc_feature (286)..(290): n is a, c, g, or t
tcagtctatactatcacgaccggtgctcgatttagctctacgctcagggcacgaccggtgctcgatttagatcgtctgtgttgggtttgggggtgacggctcgcccatggcgcactactggggccagggaaccctggtcaccgtctcctcagcctccaccaagggcccatcggtcttccccctggcgccctgctccaggagcacctccgagagcacagcggccctgggctgcctggtcaaggctacttccatagtatagactgagcgggctggcaaggcgcatagnnnnn

SEQ ID NO: 37708 - DNA, 636 bp, Homo sapiens
  misc_feature: GYAE6OF02IXKLG.41.73.G07.1.454.CMB.1.raw
  modified_base (271)..(271): a, c, t, g, unknown or other
  misc_feature (271)..(271): n is a, c, g, or t
tcagtctatactatcacgaccggtgctcgatttagctctacgctcagggggatcaggactcctcagttcaccttctcacaatgaggctccctgctcagctcctggggctgctaatgctctgggtctcagggtccagtggagatattataatgactcagtctccctctccctggccgtcaccctggagagccggcctccatctcctgtaggtctagtgagagtcttggaggtcagaacatctatgtggactggtacttgcagaagaccgggnagtctccacaactctgatcttatttcgggtccacgtcgggcctccggggtctctgactaggtcagtcgctagtcgcatcgacacacagtactttacactactggacacactacagaccgaggaggtgggaaggtcgtaggacgtaagttgggtttaggggttacttaagtttacgtcgtacgtaactaccttaacggtttacctaacccgttaaaccccgtttaccgttaaccccggttacgggtaaccggtaacggggtaccctaacgggtaacctttacgggaacgttaaacggttaaacggaccggttaaacgtttcgggttacggaccgtttacgacccgtaaccgtaccgttcgttacgg

SEQ ID NO: 37709 - DNA, 641 bp, Homo sapiens
  misc_feature: GYAE6OF02G7JZF.41.73.G07.1.454.CMB.1.raw
  modified_base (328)..(328): a, c, t, g, unknown or other
  misc_feature (328)..(328): n is a, c, g, or t
tcagtctatactatcacgaccggtgctcgatttagctctacgctcaggggggatcagggactcctcagtttcaccttctcacaatgaggctacccgtgctcagctccgtggggtctgctaatgcgtacgtgggtctcgagggtccagtggacgactattatatgactcagtcctccctcgtcccgtggcccgtaccaccccgtggagacgccggcctccatcctcctggtaggtctagtgagtagtcgttggaggtcaagaacatactatggtaggcttggtacttgacaaggaacggaccgggctacgtccacctaaccaacttccngtacttcttaggtttcggtacccacggtccgggccgttccggggtctcgtgacgtgggttcacgtcgacctagtcgctactcaacacgacgtaatctttacacctcgtacgtacaactactacgaacgacgtaagggaggtagggacgtacgttaaggacgtaggttttcggggttacgggttacttaacttcggactactaacgtaccgttaacgttacctaaacccgttaccgttccgacgttcggaacgacggactacgtataggaataacgtacgacgtacgtggtcgcgtacgctaaccttgtctacg

SEQ ID NO: 37710 - DNA, 170 bp, Homo sapiens
  misc_feature: GYAE6OF01COKFQ.21.36.D03.1.454.CMB.1.raw
  modified_base (169)..(170): a, c, t, g, unknown or other
  misc_feature (169)..(170): n is a, c, g, or t
tcagtcgtcgctcgcacgaccggtgctcgattagctgcgtcacgctcttggttgggaagaggaagactgacggtcccacggagttcaggtgctgggcacagcggccctgggctgcctggtcaaggactacttcctcgtctctactgagcgggctggcaaggcgcatagnn

SEQ ID NO: 37711 - DNA, 172 bp, Homo sapiens
  misc_feature: GYAE6OF01EG28R.21.36.D03.1.454.CMB.1.raw
  modified_base (172)..(172): a, c, t, g, unknown or other
  misc_feature (172)..(172): n is a, c, g, or t
tcagtcgtcgctcgcacgaccggtgctcgatttagctgcgtcacgctcttgggtttgggaagaggaagactgacggtcccaggagttcaggtgctgggcacagcggccctgggctgcctggtcaaggactacttccctcgtctctactgagcgggctggcaaggcgcatagn

SEQ ID NO: 37712 - DNA, 177 bp, Homo sapiens
  misc_feature: GYAE6OF01EUXJR.21.36.D03.1.454.CMB.1.raw
  modified_base (174)..(177): a, c, t, g, unknown or other
  misc_feature (174)..(177): n is a, c, g, or t
tcagtcgtcgctcgcacgaccggtgctcgatttagctgcgtcacgctcttgggtttggggaagaggaagactgacggtccccaggagttcaggtgctgggcacagcggccctgggctgcctggtcaaggactacttccctcgtctctactgagcgggctggcaaggcgcatagnnnn

SEQ ID NO: 37713 - DNA, 176 bp, Homo sapiens
  misc_feature: GYAE6OF01EXBSO.21.36.D03.1.454.CMB.1.raw
  modified_base (175)..(176): a, c, t, g, unknown or other
  misc_feature (175)..(176): n is a, c, g, or t
tcagtcgtcgctcgcacgaccggtgctcgatttagctgcgtcacgctcttgggtttgggggaagaggaagactgacggtccccaggagttcaggtgctgggcacagcggccctgggctgcctggtcaaggactacttccctcgtctctactgagcgggctggcaaggcgcatagnn

SEQ ID NO: 37714 - DNA, 176 bp, Homo sapiens
  misc_feature: GYAE6OF01DHCZN.21.36.D03.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagctgcgtcacgctcttgggtttgggggaagaggaagactgacggtcccccaggagttcaggtgctgggcacagcggccctgggctgcctggtcaaggactacttccctcgtctctactgagcgggctggcaaggcgcatagn

SEQ ID NO: 37715 - DNA, 179 bp, Homo sapiens
  misc_feature: GYAE6OF01EOC1I.21.36.D03.1.454.CMB.1.raw
  modified_base (177)..(179): a, c, t, g, unknown or other
  misc_feature (177)..(179): n is a, c, g, or t
tcagtcgtcgctcgcacgaccggtgctcgatttagctgcgtcacgctcttgggttttgggggaagaggaagactgacggtcccccaggagttcaggtgctgggcacagcggccctgggctgcctggtcaaggactacttccctcgtctctactgagcgggctggcaaggcgcatagnnn

SEQ ID NO: 37716 - DNA, 177 bp, Homo sapiens
  misc_feature: GYAE6OF01C5Q1W.21.36.D03.1.454.CMB.1.raw
  modified_base (176)..(177): a, c, t, g, unknown or other
  misc_feature (176)..(177): n is a, c, g, or t
tcagtcgtcgctcgcacgaccggtgctcgatttagctgcgtcacgctcttgggtttgggggaagaggaagactgacggtcccccaggagttcaggtgctgggcacagcggccctgggctgcctggtcaaggactacttccctcgtctctactgagcgggctggcaaggcgcatagnn

SEQ ID NO: 37717 - DNA, 179 bp, Homo sapiens; identical to SEQ ID NO: 37715
  misc_feature: GYAE6OF01AF2EP.21.36.D03.1.454.CMB.1.raw
  modified_base (177)..(179): a, c, t, g, unknown or other
  misc_feature (177)..(179): n is a, c, g, or t

SEQ ID NO: 37718 - DNA, 178 bp, Homo sapiens
  misc_feature: GYAE6OF01C9OKK.21.36.D03.1.454.CMB.1.raw
  modified_base (177)..(178): a, c, t, g, unknown or other
  misc_feature (177)..(178): n is a, c, g, or t
tcagtcgtcgctcgcacgaccggtgctcgatttagctgcgtcacgctcttgggttttgggggaagaggaagactgacggtcccccaggagttcaggtgctgggcacagcggccctgggctgcctggtcaaggactacttccctcgtctctactgagcgggctggcaaggcgcatagnn

SEQ ID NO: 37719 - DNA, 181 bp, Homo sapiens
  misc_feature: GYAE6OF01CQTJD.21.36.D03.1.454.CMB.1.raw
  modified_base (177)..(181): a, c, t, g, unknown or other
  misc_feature (177)..(181): n is a, c, g, or t
tcagtcgtcgctcgcacgaccggtgctcgatttagctgcgtcacgctcttgggttttgggggaagaggaagactgacggtcccccaggagttcaggtgctgggcacagcggccctgggctgcctggtcaaggactacttccctcgtctctactgagcgggctggcaaggcgcatagnnnnn

SEQ ID NO: 37720 - DNA, 179 bp, Homo sapiens; identical to SEQ ID NO: 37715
  misc_feature: GYAE6OF01BO0IG.21.36.D03.1.454.CMB.1.raw
  modified_base (177)..(179): a, c, t, g, unknown or other
  misc_feature (177)..(179): n is a, c, g, or t

SEQ ID NO: 37721 - DNA, 178 bp, Homo sapiens; identical to SEQ ID NO: 37718
  misc_feature: GYAE6OF01CHSBF.21.36.D03.1.454.CMB.1.raw
  modified_base (177)..(178): a, c, t, g, unknown or other
  misc_feature (177)..(178): n is a, c, g, or t

SEQ ID NO: 37722 - DNA, 187 bp, Homo sapiens
  misc_feature: GYAE6OF01DD9CC.21.36.D03.1.454.CMB.1.raw
  modified_base (175)..(187): a, c, t, g, unknown or other
  misc_feature (175)..(187): n is a, c, g, or t
tcagtcgtcgctcgcacgaccggtgctcgatttagctgcgtcacgctcttgggtttgggggaagaggaagactgacggtcccccaggagttcaggtgctgggcacagcggcctgggctgcctggtcaaggactacttccctcgtctctactgagcgggctggcaaggcgcatagnnnnnnnnnnnnn

SEQ ID NO: 37723 - DNA, 177 bp, Homo sapiens
  misc_feature: GYAE6OF01CET23.21.36.D03.1.454.CMB.1.raw
  modified_base (176)..(177): a, c, t, g, unknown or other
  misc_feature (176)..(177): n is a, c, g, or t
tcagtcgtcgctcgcacgaccggtgctcgatttagctgcgtcacgctcttgggttttgggggaagaggaagactgacggtcccccaggagttcaggtgctgggcacagcggccctgggctgcctggtcaaggactacttcccgagcgacactgagcgggctggcaaggcgcatagnn

SEQ ID NO: 37724 - DNA, 177 bp, Homo sapiens
  misc_feature: GYAE6OF01E0HIR.21.36.D03.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagctgcgtcacgctcttgggttttgggggaagaggaagactgacggtcccccaggagttcaggtgctgggcacagcggccctgggctgcctggtcaaggactacttccctcgtctctactgagcgggctggcaaggcgcatagn

SEQ ID NO: 37725 - DNA, 178 bp, Homo sapiens; identical to SEQ ID NO: 37718
  misc_feature: GYAE6OF01BA8GU.21.36.D03.1.454.CMB.1.raw
  modified_base (177)..(178): a, c, t, g, unknown or other
  misc_feature (177)..(178): n is a, c, g, or t

SEQ ID NO: 37726 - DNA, 178 bp, Homo sapiens; identical to SEQ ID NO: 37718
  misc_feature: GYAE6OF01DCWLN.21.36.D03.1.454.CMB.1.raw
  modified_base (177)..(178): a, c, t, g, unknown or other
  misc_feature (177)..(178): n is a, c, g, or t

SEQ ID NO: 37727 - DNA, 179 bp, Homo sapiens
  misc_feature: GYAE6OF01DQNUE.21.36.D03.1.454.CMB.1.raw
  modified_base (178)..(179): a, c, t, g, unknown or other
  misc_feature (178)..(179): n is a, c, g, or t
tcagtcgtcgctcgcacgaccggtgctcgatttagctgcgtcacgctcttgggttttgggggaagaggaagactgacggtcccccaggagttcaggtgctgggcaacagcggccctgggctgcctggtcaaggactacttccctcgtctctactgagcgggctggcaaggcgcatagnn

SEQ ID NO: 37728 - DNA, 179 bp, Homo sapiens; identical to SEQ ID NO: 37715
  misc_feature: GYAE6OF01BDC4G.21.36.D03.1.454.CMB.1.raw
  modified_base (177)..(179): a, c, t, g, unknown or other
  misc_feature (177)..(179): n is a, c, g, or t

SEQ ID NO: 37729 - DNA, 180 bp, Homo sapiens
  misc_feature: GYAE6OF01CAGER.21.36.D03.1.454.CMB.1.raw
  modified_base (177)..(180): a, c, t, g, unknown or other
  misc_feature (177)..(180): n is a, c, g, or t
tcagtcgtcgctcgcacgaccggtgctcgatttagctgcgtcacgctcttgggttttgggggaagaggaagactgacggtcccccaggagttcaggtgctgggcacagcggccctgggctgcctggtcaaggactacttccctcgtctctactgagcgggctggcaaggcgcatagnnnn

SEQ ID NO: 37730 - DNA, 203 bp, Homo sapiens
  misc_feature: GYAE6OF01DAM6Y.21.36.D03.1.454.CMB.1.raw
  modified_base (182)..(203): a, c, t, g, unknown or other
  misc_feature (182)..(203): n is a, c, g, or t
tcagtcgtcgctcgcacgaccggtgctcgatttagctgcgtcacgcgttcgttgggttttggggggaagaggaagactgacggtccccccaggagttcaggtgctgggcacagcggccctgggctgcctggtcaaggctacttccctcgtctctactgagcgggctggcaaggcgcaatagnnnnnnnnnnnnnnnnnnnnnn

SEQ ID NO: 37731 - DNA, 178 bp, Homo sapiens; identical to SEQ ID NO: 37718
  misc_feature: GYAE6OF01AVAY4.21.36.D03.1.454.CMB.1.raw
  modified_base (177)..(178): a, c, t, g, unknown or other
  misc_feature (177)..(178): n is a, c, g, or t

SEQ ID NO: 37732 - DNA, 179 bp, Homo sapiens; identical to SEQ ID NO: 37715
  misc_feature: GYAE6OF01BICGY.21.36.D03.1.454.CMB.1.raw
  modified_base (177)..(179): a, c, t, g, unknown or other
  misc_feature (177)..(179): n is a, c, g, or t

SEQ ID NO: 37733 - DNA, 183 bp, Homo sapiens
  misc_feature: GYAE6OF01BSSZD.21.36.D03.1.454.CMB.1.raw
  modified_base (178)..(183): a, c, t, g, unknown or other
  misc_feature (178)..(183): n is a, c, g, or t
tcagtcgtcgctcgcacgaccggtgctcgatttagctgcgtcacgctcttgggttttgggggaagaggaagactgacggtcccccaggagttcaggtgctgggcacagcggccctgggctgcctggtcaaggactacttccctcgtctctaactgagcgggctggcaaggcgcatagnnnnnn

SEQ ID NO: 37734 - DNA, 182 bp, Homo sapiens
  misc_feature: GYAE6OF01AZH90.21.36.D03.1.454.CMB.1.raw
  modified_base (179)..(182): a, c, t, g, unknown or other
  misc_feature (179)..(182): n is a, c, g, or t
tcagtcgtcgctcgcacgaccggtgctcgatttagctgcgtcacgctcttgggttttggggggaagaggaagactgaccggtcccccaggagttcaggtgctgggcacagcggccctgggctgcctggtcaaggactacttccctcgtctctactgagcgggctggcaaggcgcatagnnnn

SEQ ID NO: 37735 - DNA, 530 bp, Homo sapiens
  misc_feature: GYAE6OF01BCPN0.21.36.D03.1.454.CMB.1.raw
tcagtcgtcgctcgcacgaccggtgctcgatttagctgcgtcacgatctctcttgggggacgggttgtagctggtgctcccactatgatagatttccccaatccactcctgtccctcacctgcgctgtctctggcggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatccggtccttccccctggccgcccctgcctccgacggacgccacccgtccgagacgcacacgccggccctgggctgccgtcgg

SEQ ID NO: 37736 - DNA, 779 bp, Homo sapiens
  misc_feature: GYAE6OF01BZVIS.21.36.D03.1.454.CMB.1.raw
  modified_base (245)..(245): a, c, t, g, unknown or other
  misc_feature (245)..(245): n is a, c, g, or t
  modified_base (326)..(326): a, c, t, g, unknown or other
  misc_feature (326)..(326): n is a, c, g, or t
tcagtcgtcgctcgcacgaccggtgctcgatttagctgcgtcacgatcgtctcgttgggggacgggttgtagctggtgtcgtcccactatgatagatttccccaagtccactcctgtccctcacctcgcgctacgtctcgtaggccggctccgatcagtaagtacgtaactggtggagttcgggtccgccgacgccccgagggacggggccgagtggagttagggaaatctatcagtaggtgganccaccgagacctaccgtaacccgtccctacgaaggacgtacgagtaccaccatactcagtacgacgaacgtccaagaaccngttcctccgtagaacgcgtgacgtctcgtgtcgaccggccgacggacgccggtcgtagtacttacgttggcgtacgtaaggttaaaggggtttcggaggttcggtaccgacggtacgggtacccgtacccggtgggacccgtaacgggtacccctgggtcccgtaccgtccgtacccgtcgtaccggtcccgtaacccgtaaccggtaccgggtcccgtacggttacccggttaccccgttcccccgtcgggtacccccttacccgtacccgtacccgaaacggtccgtaacccgtacccggtaccgggtcggggtacccaccggtaccgggtcccggtacccgtcgggtaccgttccggtaccggttacggtaccggtaaccggtaccttacccgttcccgtcgttacccttaccgtacggtcggtaccggtccggtccgtcgggtacccgg

SEQ ID NO: 37737 - DNA, 920 bp, Homo sapiens
  misc_feature: GYAE6OF01C3DD5.21.36.D03.1.454.CMB.1.raw
tcagtcgtcgctcgcacgaccggtgctcgatttagctgcgtcacgatctctcgttgggggacgggttgtagctggtgcctcccactatgatagtactttccccaatccactcctcgtccctcacctgcgctcgtctcgtggcgcctcatcagaagtagtacgtggtggtacggttcggcccgccgaccgaccccggaggggaacggggccggaggtggagtagggaaactctacgtcagtaggtggacaccgacgacgtacctacccgaccccgtcctagaacgtacgtacgacgtaccaactatacgtacgtaacgtaacgaacgtaacgtaccgaaacgtacccgttaccgtttaccccgtaccgaaggtaccgtacggtacgtaccgttccgttcggttaccggtacccgggaccccggaccgggtaaccggacccggttacccgggttccgttagttaacgtttcggttacggtacggtacggttaaaggggtttacggggtttaggtacgggttaccggttacgacggtaaccgggtaccccggtccggggtacggacccggtaccgggtaccgtcgggtaccctacccgttcccgtaccgtaccgtacccgtaccccctaaccccgggtaaccggacccggttccccgttaacccgggttccccgtttcccccgttaccccgccgtaaccccctcccgttacccgaacgacgtccccggtacccgtaccgggttcccgggaccgggaccgtcccggtccgggtcccgtacccgggtcgtcccggttaaccggtcccggtaacgggtaaccgtaacccggtttacccgtttccccgttccgttcccccggtaagtttccccggtaaaggggtcccgggttaaccgggtcccggggttaccggagggaaccccggg

SEQ ID NO: 37738 - DNA, 227 bp, Homo sapiens
  misc_feature: GYAE6OF01COHED.21.36.D03.1.454.CMB.1.raw
  modified_base (192)..(227): a, c, t, g, unknown or other
  misc_feature (192)..(227): n is a, c, g, or t
tcagtcgtcgctcgcacgaccggtgctcgatttagctgcgtcacgctcttgggttttgggggaagaggaagactgaccggtcccccaggagttcaggtgcgtgggcacgaggccggccctgggcctcgccgtgggtacaaggactaccttccctcgtctctacgtgagcgggctggacgacggcgacatagnnnnnnnnnnnnnnnnnnnnnnnnnnnnnnnnnnnn

SEQ ID NO: 37739 - DNA, 175 bp, Homo sapiens
  misc_feature: GYAE6OF02GFOKZ.21.36.D03.1.454.CMB.1.raw
  modified_base (174)..(175): a, c, t, g, unknown or other
  misc_feature (174)..(175): n is a, c, g, or t
tcagtcgtcgctcgcacgaccggtgctcgatttagctgcgtcacgctcttgggtttggggaagaggaagactgacggtccccaggagttcaggtgctgggcacagcggccctgggctgcctggtcaaggactacttccctcgtctctactgagcgggctggcaaggcgcatagnn

SEQ ID NO: 37740 - DNA, 176 bp, Homo sapiens
  misc_feature: GYAE6OF02I9AMQ.21.36.D03.1.454.CMB.1.raw
  modified_base (174)..(176): a, c, t, g, unknown or other
  misc_feature (174)..(176): n is a, c, g, or t
tcagtcgtcgctcgcacgaccggtgctcgatttagctgcgtcacgctcttgggtttggggaagaggaagactgacggtccccaggagttcaggtgctgggcacagcggccctgggctgcctggtcaaggactacttccctcgtctctactgagcgggctggcaaggcgcatagnnn

SEQ ID NO: 37741 - DNA, 171 bp, Homo sapiens
  misc_feature: GYAE6OF02GX2ZU.21.36.D03.1.454.CMB.1.raw
  modified_base (169)..(171): a, c, t, g, unknown or other
  misc_feature (169)..(171): n is a, c, g, or t
tcagtcgtcgctcgcacgaccggtgctcgatttagctgcgtcacgctcttggtttgggaagaggaagactgacggtcccaggagttcaggtgctggcacagcggccctgggctgcctggtcaaggactacttcctcgtctctactgagcgggctggcaaggcgcatagnnn

SEQ ID NO: 37742 - DNA, 178 bp, Homo sapiens; identical to SEQ ID NO: 37718
  misc_feature: GYAE6OF02F9UEX.21.36.D03.1.454.CMB.1.raw
  modified_base (177)..(178): a, c, t, g, unknown or other
  misc_feature (177)..(178): n is a, c, g, or t

SEQ ID NO: 37743 - DNA, 179 bp, Homo sapiens; identical to SEQ ID NO: 37715
  misc_feature: GYAE6OF02FK2JS.21.36.D03.1.454.CMB.1.raw
  modified_base (177)..(179): a, c, t, g, unknown or other
  misc_feature (177)..(179): n is a, c, g, or t

SEQ ID NO: 37744 - DNA, 177 bp, Homo sapiens; identical to SEQ ID NO: 37716
  misc_feature: GYAE6OF02IC1CU.21.36.D03.1.454.CMB.1.raw
  modified_base (176)..(177): a, c, t, g, unknown or other
  misc_feature (176)..(177): n is a, c, g, or t

SEQ ID NO: 37745 - DNA, 179 bp, Homo sapiens
  misc_feature: GYAE6OF02J4F9D.21.36.D03.1.454.CMB.1.raw
  modified_base (171)..(171): a, c, t, g, unknown or other
  misc_feature (171)..(171): n is a, c, g, or t
  modified_base (177)..(179): a, c, t, g, unknown or other
  misc_feature (177)..(179): n is a, c, g, or t
tcagtcgtcgctcgcacgaccggtgctcgatttagctgcgtcacgctcttgggttttgggggaagaggaagactgaccggtcccccaggagttcaggtgctgggcacagcggccctgggctgcctggtcaaggactacttcctcgtctctactgagcgggctggcaaggcncatagnnn

SEQ ID NO: 37746 - DNA, 194 bp, Homo sapiens
  misc_feature: GYAE6OF02HMYD7.21.36.D03.1.454.CMB.1.raw
  modified_base (178)..(194): a, c, t, g, unknown or other
  misc_feature (178)..(194): n is a, c, g, or t
tcagtcgtcgctcgcacgaccggtgctcgatttagctgcgtcacgctcgttgggttttgggggaagaggaagactgacggtcccccaggagttcaggtgctgggcacagcggccctgggctgcctggtcaaggactacttccctcgtctctactgagcgggctggcaaggcgcatagnnnnnnnnnnnnnnnnn

SEQ ID NO: 37747 - DNA, 177 bp, Homo sapiens; identical to SEQ ID NO: 37724
  misc_feature: GYAE6OF02GP6VY.21.36.D03.1.454.CMB.1.raw
  modified_base (177)..(177): a, c, t, g, unknown or other
  misc_feature (177)..(177): n is a, c, g, or t

SEQ ID NO: 37748 - DNA, 187 bp, Homo sapiens
  misc_feature: GYAE6OF02F0VNN.21.36.D03.1.454.CMB.1.raw
  modified_base (177)..(187): a, c, t, g, unknown or other
  misc_feature (177)..(187): n is a, c, g, or t
tcagtcgtcgctcgcacgaccggtgctcgatttagctgcgtcacgctcgttgggtttgggggaagaggaagactgacggtcccccaggagttcaggtgctgggcacagcggccctgggctgcctggtcaaggactacttccctcgtctctactgagcgggctggcaaggcgcatagnnnnnnnnnnn

SEQ ID NO: 37749 - DNA, 179 bp, Homo sapiens; identical to SEQ ID NO: 37715
  misc_feature: GYAE6OF02HOYU5.21.36.D03.1.454.CMB.1.raw
  modified_base (177)..(179): a, c, t, g, unknown or other
  misc_feature (177)..(179): n is a, c, g, or t

SEQ ID NO: 37750 - DNA, 178 bp, Homo sapiens; identical to SEQ ID NO: 37718
  misc_feature: GYAE6OF02G03ME.21.36.D03.1.454.CMB.1.raw
  modified_base (177)..(178): a, c, t, g, unknown or other
  misc_feature (177)..(178): n is a, c, g, or t

SEQ ID NO: 37751 - DNA, 177 bp, Homo sapiens; identical to SEQ ID NO: 37724
  misc_feature: GYAE6OF02F1JF1.21.36.D03.1.454.CMB.1.raw
  modified_base (177)..(177): a, c, t, g, unknown or other
  misc_feature (177)..(177): n is a, c, g, or t

SEQ ID NO: 37752 - DNA, 179 bp, Homo sapiens
  misc_feature: GYAE6OF02HVZX5.21.36.D03.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagctgcgtcacgctcttgggttttggggggaagaggaagactgacggtccccccaggagttcaggtgctgggcacagcggccctgggctgcctggtcaaggactacttccctcgtctctactgagcgggctggcaaggcgcatagn

SEQ ID NO: 37753 - DNA, 616 bp, Homo sapiens
  misc_feature: GYAE6OF02JD5I1.21.36.D03.1.454.CMB.1.raw
tcagtcgtcgctcgcacgaccggtgctcgatttagctgcgtcacgatctctcttgggggacgggttgtagctggtgctcccactatgatagatttccccaatccactcctgtccctcacctgcgctgtctctggcggctccatcagaagtagtaactggtggagttgggtccgccagcccccagggaaggggccggagtggattggggaaatctatcatagtgggagcaccagctacaacccgtcctcaagagtcgagtcaccatatcagtagacaagtccaagaaccagttctccctgaagctgagctctgtcgaccgccgcggacacggccgtgtattattgtgcgagtaaaggggttttggagttggttaccgcagggtacgaccccgtggggccagggaaccctggtcaccgtctcctcgacgcctccaccgaacgggcccacgtccggtccttccccgtcggccctacccctccctaccaacgcgaccacccgtcgtcgggggccacgacgccggcccgtcgggcctcggcccgttggtaccgaacggtaccttaccgttccccggaacggtccggaccggaccgtcggacggccgggtccgtgggaccgg

SEQ ID NO: 37754 - DNA, 613 bp, Homo sapiens
  misc_feature: GYAE6OF02G45DV.21.36.D03.1.454.CMB.1.raw
  modified_base (352)..(352): a, c, t, g, unknown or other
  misc_feature (352)..(352): n is a, c, g, or t
  modified_base (440)..(440): a, c, t, g, unknown or other
  misc_feature (440)..(440): n is a, c, g, or t
tcagtcgtcgctcgcacgaccggtgctcgatttagctgcgtcacgatctctcttgggggacgggttgtagctggtgctcccactatgatagatttccccaatccactcctgtccctcacctgcgctgtctctggcggctccatcagaagtagtaactggtggagttgggtccgccacgcccccgaggggaaggggccggagtggattggggaaatctatcatagtgggagcaccagctacaacccgtccctcaagagtcgagtcaccatatcagtagacaagtccaagaacccagttcctccctgaagctgagctctgtcgaccgccggcggacacggccgtgtattattgngcgaaggtaaaggggttttggagttgggttaccgcgtacgggtaccgacccgtgggggcccaggggaccctggtcgaccgtctcctcncgcctccaccgacgggcccacgtccggtccttccccgtcgccaccctcctccacgcgccaccgtcgtcggggcacgacggccggtcccgtcgggccgtcggccgtcggtaccgaacggtaccttaccgtccccgacgccgacggaccgtcggacggccgggtcgtcggaccgg

SEQ ID NO: 37755 - DNA, 586 bp, Homo sapiens
  misc_feature: GYAE6OF02GUJZ2.21.36.D03.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagctgcgtcacgatctctcttgggggacgggttgtagctggtgctcccactatgatagatttccccaatccactcctgtccctcacctgcgctgtctctggcggctccatcagaagtagtaactggtggagttgggtccgccagcccccagggagggccggagtggattggggaaatctatcatagtgggagcaccagctacaacccgtccctcaagagtcgagtcaccatatcagtagacaagtccaagaaccagttcctccctgaagctgagctctgtcgaccgccgcggacacggccgtgtattatgtgcgagtaagggttttggagtggttaccgngagggtacgacccgtggggccagggaccctggtccaccgtctcctcacgcctccaccgacgggcccagtccggtccttcccccgtggccaccccgtcctacccaacgacgccaccgtcgtcggggccacgacgccggccgtgggcctcgccgtcggtaccgaacggtccttaccgttccctcgtcctcctacgtcgacggtcgggtctggacg

SEQ ID NO: 37756 - DNA, 195 bp, Homo sapiens
  misc_feature: GYAE6OF02HM1IV.21.36.D03.1.454.CMB.1.raw
  modified_base (180)..(195): a, c, t, g, unknown or other
  misc_feature (180)..(195): n is a, c, g, or t
tcagtcgtcgctcgcacgaccggtgctcgatttagctgcgtcacgcttcgttgggttttggggggaagaggaagactgacggtcccccaggagttcaggtgctgggcacagcggccctgggctgcctggtcaaggactacttccctcgtctctactgagcgggctggcaaggcgcatagnnnnnnnnnnnnnnnn

SEQ ID NO: 37757 - DNA, 615 bp, Homo sapiens
  misc_feature: GYAE6OF02HCR07.21.36.D03.1.454.CMB.1.raw
  modified_base (253)..(253): a, c, t, g, unknown or other
  misc_feature (253)..(253): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
tcagtcgtcgctcgcacgaccggtgctcgatttagctgcgtcacgatctctcttgggggacgggttgtagctggtgctcccactatgatagatttccccaatccactcctgtccctcacctgcgctgtctctggcggctccatcagaagtagtaactggtggagttgggtccgccagcccccagggaaggggccggagtggattggggaaatctatcatagtgggagcaccagctacaacccgtccctcaagngtcgagtcaccatatcagtagacaagtccaagaaccagttcnccctagaacgctgganctctgtcgaccgccgcggaccacggccgtagtattagttgtgacgagtaaaggggttttgagttggttaccgcgacgggtaccgaccccgtggggcccaggggaccctggtccgacccgtctccgtcacgccctccgaccgacgggcccagtccgtccttcccctcggccacccgtctccagacgccaccgtcgtcggggaccacgcggccgccgtcgggcctcggccgtcggtaccgaacgggtacctaccgttcccgtccgttccttaccgttacgtacggacggccggtacgtaggaccgg

SEQ ID NO: 37758 - DNA, 179 bp, Homo sapiens
  misc_feature: GYAE6OF02ISAXY.21.36.D03.1.454.CMB.1.raw
  modified_base (178)..(179): a, c, t, g, unknown or other
  misc_feature (178)..(179): n is a, c, g, or t
tcagtcgtcgctcgcacgaccggtgctcgatttagctgcgtcacgctcttgggttttggggggaagaggaagactgacggtcccccaggagttcaggtgctgggcacagcggccctgggctgcctggtcaaggactacttccctcgtctctactgagcgggctggcaaggcgcatagnn

SEQ ID NO: 37759 - DNA, 766 bp, Homo sapiens
  misc_feature: GYAE6OF02GYA3N.21.36.D03.1.454.CMB.1.raw
  modified_base (308)..(308): a, c, t, g, unknown or other
  misc_feature (308)..(308): n is a, c, g, or t
  modified_base (361)..(361): a, c, t, g, unknown or other
  misc_feature (361)..(361): n is a, c, g, or t
  modified_base (466)..(466): a, c, t, g, unknown or other
  misc_feature (466)..(466): n is a, c, g, or t
tcagtcgtcgctcgcacgaccggtgctcgatttagctgcgtcacgatctcgtcttgggggacgggttgtagctggtgctcccactatgatagatttccccaatcactcctcgtcctcctacctcgcgctcgtctctggcggctccgtactcacgaagtaagtaacgtaggtggaggttcgggtccgccgaacgcccccgacgggaacgggggccgggtaacggtcgggtagtaggggtaaaggtctatacgagtacggtgggaggcaccagctaccgaacccgcctacaaagcgtcgatcgacccaanactcgtagagaacaacgtccaaacggaactacgtcctacctccgtaaggtacngcgtacgtccttgacgaccggcccggcgaccgtcggccggtacttgtacttcggtgcgtaaagtacgggggttagtacgttcggttaccggacgtagggtaaccnccccgggttggggaacccggcgggtaaaccctgggtcccgtacccgtccggtacctcgaaccgtcccgtaccgaacgaccggaacccgacctcggtccgttccccgcggttacccacccttccgtacccggtaaccacggtaccaccgttaccggtcgggtacgaaccgtacgggcccggccggtccgggtcgtaccggtccgttccgtacgggtaacggaacccggtttacccgtcccgtttcccggaccgttccccgttaaccggttcggttacggcccgggttacgtccggggaacc

SEQ ID NO: 37760 - DNA, 894 bp, Homo sapiens
  misc_feature: GYAE6OF02HQPOY.21.36.D03.1.454.CMB.1.raw
  modified_base (230)..(230): a, c, t, g, unknown or other
  misc_feature (230)..(230): n is a, c, g, or t
  modified_base (455)..(455): a, c, t, g, unknown or other
  misc_feature (455)..(455): n is a, c, g, or t
tcagtcgtcgctcgcacgaccggtgctcgatttagctgcgtcacgatctctcttgggggacgggttgtagctggtgctcccactatgatagatttccccaatccactcctgtccctcacctgcgctgtctctggcgctccatcagaagtagtaactggtggagttgggtccgccacgcccccgaggggaagggccggagtggagttggggaaatctatcagtagtgggancacagctaccaacccgtcctacaagcgtcgagtccacatatcagtagacaagtccaaagaacctagttcctacccgtagaacgtccgtaggaacgtcgttcgtacggtcgaccccggtcccggcggaaccgtaccgggtccgttaggttaactttaggttcggtacggaccggtaaagggttaaacgggggtttttggaacggttaccggggtttaaaccccggnggtaaccgggggttaacccgtaacccccgggttggggggaccccgtaacgggggtaaccccgttggggtaccccgtacccgttaccccgttcccgtaaccgtacggaccccctttaacccgaaacccggtaaaccggggtacccctaaccggttaccccggttaccccgtttaccccccggtacggtaccccgttaccccgttaccccgtaacccgtaaacggtccgtaacccgtaacccgttcggggtaccgggggtaccaaccggtaacccggggcccggggtacccgtacgggggtccctaccgggtaccccggttacggggtacccgtaaaccgggtttaccccttacccggtttccccgtacccggtttacccgttacccgtttaccggtaccgggttaaccgggcccggggttaccggtacgggtaacccggg

SEQ ID NO: 37761 - DNA, 187 bp, Homo sapiens
  misc_feature: GYAE6OF02FYFWJ.21.36.D03.1.454.CMB.1.raw
  modified_base (178)..(187): a, c, t, g, unknown or other
  misc_feature (178)..(187): n is a, c, g, or t
tcagtcgtcgctcgcacgaccggtgctcgatttagctgcgtcacgctcttgggtttggggggaagaggaagactgacggtccccccaggagttcaggtgctgggcacagcggccctgggctgcctggtcaaggactacttccctcgtctctactgagcgggctggcaaggcgcatagnnnnnnnnnn

SEQ ID NO: 37762 - DNA, 981 bp, Homo sapiens
  misc_feature: GYAE6OF02G9VTZ.21.36.D03.1.454.CMB.1.raw
  modified_base (294)..(294): a, c, t, g, unknown or other
  misc_feature (294)..(294): n is a, c, g, or t
tcagtcgtcgctcgcacgaccggtgctcgatttagctgcgtcacgatctctcttgggggacgggttgtagctggtgctcccactatgatagatttccccaatccactcctgtccctcacctgcgctgtctctggcggctccatcagaagtagtaactggtggagttgggtccgccagcccccgagggaaggggccggagtggagttggggaaatctatcatagtgggagcaccagctaccaacccgtccctcaagagtcgagtcaccatatcagtagacaagtccaaagaaccngttcctcccgtagaacgtctaggacgtcttcgtaggtcggaccccggtccggccgggaaccgaccggggtccgttaggttaacgttttaacgtttgggtacggaccggttaaaggggttaaaagggggttttttcgggaacgggtttacggggtttaaccccggacgggtaaccggggggttaaccccggtaacccccgggtttgggggggaccccgtaaccggggggtaaacccccgtttggggttaccccggtaaccccggtttcccgttaccccgttaccgtaacccggtaccccgttaccccgaaaccccgggtaaacccggggtaccccccgtaaccgggtttacccccggggttccccgttttaccccccccggttacgggtaccccccgttaacccccgtacccccgtttaacccccgaaacgggtacccggtaccccgttaacccccggtttccgggtaccgggggggtaccccgaacccgggtaacccggggtccccggggtacccccgggttccgggggcccgttacccgggtccccggttaccgggtaccggtaaacccggggttaaccccgtttaaccccggtttcccccgtttacccggtttacccgtttacccgtttaaccggttaccgggtaacccggggtcccggggttaccggttaccggggtaacccgg

SEQ ID NO: 37763 - DNA, 189 bp, Homo sapiens
  misc_feature: GYAE6OF02GE2DS.21.36.D03.1.454.CMB.1.raw
  modified_base (178)..(189): a, c, t, g, unknown or other
  misc_feature (178)..(189): n is a, c, g, or t
tcagtcgtcgctcgcacgaccggtgctcgatttagctgcgtcacgctcttgggttttggggggaagaggaagactgacggtcccccaggagttcaggtgctgggcacagcggccctgggctgcctggtcaaggactacttccctcgtctctactgagcgggctggcaaggcgcatagnnnnnnnnnnnn

SEQ ID NO: 37764 - DNA, 185 bp, Homo sapiens
  misc_feature: GYAE6OF02FQGEY.21.36.D03.1.454.CMB.1.raw
  modified_base (179)..(185): a, c, t, g, unknown or other
  misc_feature (179)..(185): n is a, c, g, or t
tcagtcgtcgctcgcacgaccggtgctcgatttagctgcgtcacgctcttgggttttggggggaagaggaagactgacggtccccccaggagttcaggtgctgggcacagcggccctgggctgcctggtcaaggactacttccctcgtctctactgagcgggctggcaaggcgcatagnnnnnnn

SEQ ID NO: 37765 - DNA, 895 bp, Homo sapiens
  misc_feature: GYAE6OF02G78XC.21.36.D03.1.454.CMB.1.raw
  modified_base (874)..(874): a, c, t, g, unknown or other
  misc_feature (874)..(874): n is a, c, g, or t
tcagtcgtcgctcgcacgaccggtgctcgatttagctgcgtcacgatctctcgttggggggacgggttgtagctggtgcctcccactatgatagactttccccaatccactcctgtccctcacctgcgctgtctcgtggcggctccatcagaacgtagtaacgtgggtggtaggttcgggtccgccgaccgaccccgaaggggaacggggccggaggtaggtaggttagggaaacttctaactacgtagttacgggtggggacacaaccgacgtaccgtaaccctaaccccgttaccccgtacaaacggcgttacggaacggttaccaacccgtaaattaccgttacgaacggttaacgaaccgtaaacgttcccgaaaacggtaaaaccccttaccggtttacccttaccccgttaagggaaacgcgttacggaacgccttacgttcggtaaccggaccccggcccgacgggtaacccgtacggtccggttagttacttagtttaggccggtaacgtagggtttaaaggggttttgggacgtttacgggttaccggacgttaacggggtacccgtaacccgggtaccggggtacgaaaccggggtacccgttcggggtaccgacccggttaccgttaccgtacccgacggtacccctaacccggtaaccgacgggtacccctaaccggtcccggttaccccgttccccggtcccggtcccgtacccctacccgaccgtaaccggccgtaaccctccggttaccggtcggggacctaccggacgggtcccgggtccggtacggtcgtcgtaccgtcgggaaccgttaacggtaccttaccgttaccccgtcgttcccgtacctcggtaaccggnggtccggtacggacgtaccgg

SEQ ID NO: 37766 - DNA, 559 bp, Homo sapiens
  misc_feature: GYAE6OF01C3CQZ.17.5.A05.1.454.CMB.1.raw
  modified_base (301)..(301): a, c, t, g, unknown or other
  misc_feature (301)..(301): n is a, c, g, or t
tcagcgtagactagcacgaccggtgctcgatttagatagatagacagggggctctgggagaggagcccagcactagaagtcggcggtgtttccattcggtgatcagcactgaacacagaggactcaccatggagttggggctgagctgggttttcctcgttgctcttttaagaggtgtccagtgtcaggagcagctggtggagtcgtgggggaggcgtggtccagccggggatgcccctgagactctcctgtgcagcgtctggattcaccttcagcagttatggcatgcacgtcgggtccnccgaggctccgaggccgaagggggctagggaggtgggtagcgtagtttagttgggtttgagtggaagcaatacatactatcgaccgtacgtccgtaggaacgggccgattccaccatcctacagagacaatccaaagaaccacgctagtatacgtaggaaatggaacgtcaagtcctaggagacgtacgaaagaccgtacggcgttggtagttaacttacgtggtagacggtaagacgggtacccaagtagagtaccg

SEQ ID NO: 37767 - DNA, 707 bp, Homo sapiens
  misc_feature: GYAE6OF02FRXHP.17.5.A05.1.454.CMB.1.raw
  modified_base (355)..(355): a, c, t, g, unknown or other
  misc_feature (355)..(355): n is a, c, g, or t
  modified_base (408)..(408): a, c, t, g, unknown or other
  misc_feature (408)..(408): n is a, c, g, or t
tcagcgtagactagcacgaccggtgctcgatttagatagatagacagggggctcgtgggtagacggagcccagcactagaagtcggcggttcgtttccattcggtgatcagcactgaacaccagaggacctcaccatggagttggggctgagtcgtgggttttcctcgttgcctcttttaagaggttgtcccgagtgtcacggagctaggctttgggtcggtaggttcgtgggggaggcggtgggtcccaggccggggaatccgacccctgagacttcttcctggtgccagtcgtactgggtattccaccctttcacgcgtagttatgggcagttggcctacggtcggggtcccnccgtaggccttccgacggaccgaaagggggtcctaggggacggttggggtacncgtaacggtttagttttcggggtttggaagttgggtaacgccgtaaaatttacctaattaactaactacggacccgtacgtttccggtttaggaacgggtcccgtaagttttccgaacccgtagtccctacgaggtacgaacctaaattaccgaaaggtaaccacgtcgtagtactaccgtaaggaaattcgaacgtcgtacgtccttaggaccgtagtaccgaacgtacgacggtacttaggtacgttacgttacgtggtacggcggtacggtacgggaccgtaagttacgtagtacg

SEQ ID NO: 37768 - DNA, 520 bp, Homo sapiens
  misc_feature: GYAE6OF02GN2GP.17.5.A05.1.454.CMB.1.raw
tcagcgtagactagcacgaccggtgctcgatttagatagatagacagggggctctgggagaggagcccagcactagaagtcggcggtgtttccattcggtgatcagcactgaacacagaggactcaccatggagttggggctgagctgggttttcctcgttgctcttttaagaggtgtccagtgtcaggagcagctggtggagtctgggggaggcgtggtccagccggggatgcccctgagactctcctgtgcagcgtctggattcaccttcagcagttatggcatgcacgtgggtccgccaggctccgaggcaaggggctgggagtgggtagcagtttatttgggtttgattggaagcaatacattactatgccgactcggtagaagggccattcaccatctaccaagacgacaacttccaaagacacgctagtatcgaggaaatgaagcagcctgagagtcgaagcacggctggtatagttacgtggtcgacggtaggacggaccgtaatagtaggac

SEQ ID NO: 37769 - DNA, 744 bp, Homo sapiens
  misc_feature: GYAE6OF02IY5FX.17.5.A05.1.454.CMB.1.raw
tcagcgtagactagcacgaccggtgctcgatttagatagatagacagggggctctgggagaggagcccagcactagaagtcggcggtgtttccattcggtgatcagcactgaacacagaggactcaccatggagttggggctgagcgttgggtttttcctcgttgcttcttttaagaggttgtccagtgtcgaggagcagcgtggtggagtcgtgggggaggcgtggtccaggccgggatcgccccgtagacgactcctccgtgtcgcagcgttcgtggacttccaccttcgacgcgtagttacgtggactagtcgacgtacggtcggggtacccgaccgacggcctaccggacgggacggaacgggggtcgtaggggtaggtggggtacgtcgtaaggtttttacgtttgggttttaggagtagggaacgtacctaaagttaacgtaacttacgtaagtaccgtacccggtaacgtccgggtaaggtaaaccggggtaccgttaacttcccgaaccgtaccgttacccgtaaccggaacggaaccgtaaactaaaccgttaccgaaaccggtaaaccgaccggttaccttaggttaaccgttaacggtaaaggtaaacgtcggaacgtacgtaacgtccgttaaggacggtaacgtacggaacgtaccgtacggtaggtttagtacgttaagttacgtagttaggaccgggtaggtaaccgggtacctaatacggtgaaccgg

SEQ ID NO: 37770 - DNA, 444 bp, Homo sapiens
  misc_feature: GYAE6OF01ENK5P.24.4.A04.1.454.CMB.1.raw
  modified_base (353)..(353): a, c, t, g, unknown or other
  misc_feature (353)..(353): n is a, c, g, or t
  modified_base (440)..(444): a, c, t, g, unknown or other
  misc_feature (440)..(444): n is a, c, g, or t
tcagactactatgtcacgaccggtgctcgatttagagtagtgatcagggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctggggccaggggaccctggtcgccgtctcctccgcctccaccaagggcccatcggtctcccctgcgcctgctccaggngcacctccgagagcacagcggccctgggctgcctggtcaaggactacttccacatagtagtctgagcgggctggcaaggcgcatagnnnnn

SEQ ID NO: 37771 - DNA, 495 bp, Homo sapiens
  misc_feature: GYAE6OF01E4I7P.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagcctccacgactcgtcatctatgatacatccaaaaggccgctggcgtcccagccaggttcgctggcagtgggtctgggacagacttcactctcaccatcagcagcctggagactgaagatttgcaatgtattactgtcagcagcgtgacaactggcctcccatatactacttttggccagggaccaagctggacatcgagacgaactgtgctgcaccatctgtcttc

SEQ ID NO: 37772 - DNA, 495 bp, Homo sapiens
  misc_feature: GYAE6OF01BH361.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagcctccacgactcgtcatctatgatacatccaaaagggccgctggcgtcccagccaggttcgctggcagtgggtctggacagacttcactctcaccatcagcagcctggagactgaagatttgctaatgtattactgtcagcagcgtgacaactcggcctccatatactacttttgccaggggaccaagctgacatcgagacacgtgtcggctcgcacatctgtctc

SEQ ID NO: 37773 - DNA, 473 bp, Homo sapiens
  misc_feature: GYAE6OF01DYT2T.24.4.A04.1.454.CMB.1.raw
  modified_base (441)..(441): a, c, t, g, unknown or other
  misc_feature (441)..(441): n is a, c, g, or t
  modified_base (452)..(473): a, c, t, g, unknown or other
  misc_feature (452)..(473): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagacatggtctatctgcagatggacagcctgcgcactgaggacacagcctgtctattactgtagcgcgatcagaagtggcgggaacctggggctactcctttgactcctggggccaggggaccctggtcgccgtctccctccgcctccaccaagggcccatcggtctccccctggcgccctgctccagacgcacctccgagagcacagcgccctggctgcctggtcaaggtctacgttccactatagtagtctgagcgggctgggcaacggngaccgagtagnnnnnnnnnnnnnnnnnnnnnn

SEQ ID NO: 37774 - DNA, 449 bp, Homo sapiens
  misc_feature: GYAE6OF01D9L5D.24.4.A04.1.454.CMB.1.raw
  modified_base (355)..(355): a, c, t, g, unknown or other
  misc_feature (355)..(355): n is a, c, g, or t
  modified_base (442)..(449): a, c, t, g, unknown or other
  misc_feature (442)..(449): n is a, c, g, or t
tcagactactatgtcacgaccggtgctcgatttagagtagtgatcagggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctggggccaggggaccctggtcgccgtctcctccgcctccaccaaggcccatcggtcttcccctggcgccctgctccaggngcacctccgagagcacagcggccctgggctgcctggtcaaggactacttccacatagtagtctgagcgggctggcaaggcgcatagnnnnnnnn

SEQ ID NO: 37775 - DNA, 451 bp, Homo sapiens
  misc_feature: GYAE6OF01A4TB8.24.4.A04.1.454.CMB.1.raw
  modified_base (446)..(451): a, c, t, g, unknown or other
  misc_feature (446)..(451): n is a, c, g, or t
tcagactactatgtcacgaccggtgctcgatttagagtagtgatcagggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctggggccagggggaccctggtcgccgtctcctccgcctccaccaagggcccatcggtcttccccctggcgccctgctccaggagcacctccgagagcacagcggccctgggctgcctggtcaaggactacttccacatagtagtctgagcgggctgggcaaggcgcatagnnnnnn

SEQ ID NO: 37776 - DNA, 504 bp, Homo sapiens
  misc_feature: GYAE6OF01CE51W.24.4.A04.1.454.CMB.1.raw
  modified_base (426)..(426): a, c, t, g, unknown or other
  misc_feature (426)..(426): n is a, c, g, or t
tcagactactatgtcacgaccggtgctcgatttagagtagtgatcaggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccacaaaagcctggccagcctccacgactcgtcatctatgatacatccaaaagggccgctggcgtcccagccaggttcgctggcagtggtctgggacagacttcactctcaccatcagcagcctggagactgaagattttgctagtttattactgccagcagcacagtgactggccnctcacgtttcggcggagggaccaagggtggagagtcaaacgactgtggctggcaccatctagtcttcatcttcccgcc

SEQ ID NO: 37777 - DNA, 456 bp, Homo sapiens
  misc_feature: GYAE6OF01BT6VK.24.4.A04.1.454.CMB.1.raw
  modified_base (439)..(439): a, c, t, g, unknown or other
  misc_feature (439)..(439): n is a, c, g, or t
  modified_base (445)..(456): a, c, t, g, unknown or other
  misc_feature (445)..(456): n is a, c, g, or t
tcagactactatgtcacgaccggtgctcgatttagagtagtgatcagggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctggggccaggggaccctggtcgccgtctcctccgcctccaccaagggcccatcggtcttcccctggcgccctgctccaggcgcacctccgagacgcacagccggccctgggctgcctggtcaaggactacttccacatagtagtctgagcgggctggcaaggcncatagnnnnnnnnnnnn

SEQ ID NO: 37778 - DNA, 466 bp, Homo sapiens
  misc_feature: GYAE6OF01A2RJV.24.4.A04.1.454.CMB.1.raw
  modified_base (360)..(360): a, c, t, g, unknown or other
  misc_feature (360)..(360): n is a, c, g, or t
  modified_base (453)..(454): a, c, t, g, unknown or other
  misc_feature (453)..(454): n is a, c, g, or t
  modified_base (456)..(466): a, c, t, g, unknown or other
  misc_feature (456)..(466): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactccttgactcctggggccaggggacctggtcgccgtctcctccgcctccaccaacgggcccatcggtccttcccctggccgccctgctccaggacncacctccgagacgcacagcggccctgggctgcctggtcaaggactacttccacatagtgtctaggacgcgggctgggcaagggcgacagtagnngnnnnnnnnnnn

SEQ ID NO: 37779 - DNA, 466 bp, Homo sapiens
  misc_feature: GYAE6OF01CMQRD.24.4.A04.1.454.CMB.1.raw
  modified_base (458)..(466): a, c, t, g, unknown or other
  misc_feature (458)..(466): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgtaacgccagtgagggccgattcaccgtctcccgagacaataccaagaacatggtctatctgcagatggacagcctgcgcactgaggacacagctgtctattactgtgcgcgatcagaagtggcgggaacctggggctactcctttgactccgtggggccacggggacccctggtccgccgtctcctcccgcctccaccaagggcccatcggtccttcccctggccgccctgcctccaggacgccacctccgagagcacagccggccctggggctgcctggtcaaggactacttccacatagtagtctggagcgggctgggcaagggcgcatagnnnnnnnnn

SEQ ID NO: 37780 - DNA, 788 bp, Homo sapiens
  misc_feature: GYAE6OF01D2QQL.24.4.A04.1.454.CMB.1.raw
  modified_base (266)..(266): a, c, t, g, unknown or other
  misc_feature (266)..(266): n is a, c, g, or t
tcagactactatgtcacgaccggtgctcgatttagagtagtgatctagggggtagggaacgtggactcagttaggaccctaggacgggaaccagtacggaagccccgaagccctcagtccttctcctttccctccttcgtccttactcttcggcctcccgagcccatccaccggaggaattgtgttgacgcagtctccacggccaccctgtctttgtcctccgagggagacgacgcccaccctctcctgcgagggccagtcaagtntacgtagctagctagctaactagcctggaccagcacgaaccgtcgtcctggcctccgagtcctcctcatcgtagtggtcgccgtccaccgacggccctacgtcggccgtacggcggacgtacggttcgaggtcggactaggtcggttcgtttagggacctacggtaccttactaccgtctactacttaccgacgttccggaacgtaacggtaccgttacgggaaccgttacccggttaaagtttacgttttacggacgttaacgggttacgttacgtttaaccgttcgtaccgtacggttacggtttcccgggtttaccggttccccgtttacccgtttacccgttacccgtttaacggtttacccggtttaaccgttaccgggtttttaccgggaaccccggttacggggttacccggtaacgggttaccgggttacgggtaaccgttacggtaaccgtaacgggtaccgttaacgttcgggtaccgttacgttaccggtaccctccgttaccgttcccgg

SEQ ID NO: 37781 - DNA, 505 bp, Homo sapiens
  misc_feature: GYAE6OF01CBEG0.24.4.A04.1.454.CMB.1.raw
  modified_base (370)..(370): a, c, t, g, unknown or other
  misc_feature (370)..(370): n is a, c, g, or t
  modified_base (488)..(488): a, c, t, g, unknown or other
  misc_feature (488)..(488): n is a, c, g, or t
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagtctccacgactcgtcatctatgatacatccaaaagggccgctggcgtcccagccaggttcgctggcagtgggtctgggacagacttcactctcaccatcancagcctggagactgaagtattttgctaatgtattactgtcagcagcgtgacaacgtggcctccctatatactacttttggcctaggggaccaagctggacatcgagtacgaagtgtgntcgcaccatctgtcttc

SEQ ID NO: 37782 - DNA, 452 bp, Homo sapiens
  misc_feature: GYAE6OF01DLG80.24.4.A04.1.454.CMB.1.raw
  modified_base (443)..(443): a, c, t, g, unknown or other
  misc_feature (443)..(443): n is a, c, g, or t
  modified_base (447)..(452): a, c, t, g, unknown or other
  misc_feature (447)..(452): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctggggccaggggaccctggtcgccgtctcctccgcctccaccaagggcccatccggtcttcccctggccgcccctgctccaggacgcacctccgagagcacagcggccctgggctgcctggtcaaggctacttccacatagtagtctgagcgggctgggcaaggcgnatgnnnnnn

SEQ ID NO: 37783 - DNA, 531 bp, Homo sapiens
  misc_feature: GYAE6OF01DA96J.24.4.A04.1.454.CMB.1.raw
  modified_base (517)..(531): a, c, t, g, unknown or other
  misc_feature (517)..(531): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtggaggggccgattcaccgtctcccgagacaataccaagaacatggtctatctgcagatggacagcctgcgcactgaggacacagctgtctattactgtgcgcgatcagaagtggcgggaacgtgggctactcttgactccgtcggggcgacggggaccctggtccgccgtctccctccgcctccaccgaacgggcccagtccggtccttccccgtggccgcccctgcctccgaggacgccaccgtccgagacgccacgacggccggcccgtgggcctcggcccgtgggtaccgaaacggtccttaaccgtttacccaacgtacgttaggtacggttcgtaggacgggccggggtctcgggacgtaacgggccgacagtaggcnnnnnnnnnnnnnnn

SEQ ID NO: 37784 - DNA, 436 bp, Homo sapiens
  misc_feature: GYAE6OF01B0KRO.24.4.A04.1.454.CMB.1.raw
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (428)..(436): a, c, t, g, unknown or other
  misc_feature (428)..(436): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactccgtggggccaggggaccctggtcgccgtctcctccgcctccaccagggcccatcgtctccccnggcncctgctcngncactcgngagcacagcgcctggctgcctgtcaaggactactcacatagtagtctgagcggctggcaggcgcatagnnnnnnnnn

SEQ ID NO: 37785 - DNA, 520 bp, Homo sapiens
  misc_feature: GYAE6OF01D9KJE.24.4.A04.1.454.CMB.1.raw
  modified_base (341)..(341): a, c, t, g, unknown or other
  misc_feature (341)..(341): n is a, c, g, or t
  modified_base (493)..(493): a, c, t, g, unknown or other
  misc_feature (493)..(493): n is a, c, g, or t
  modified_base (496)..(497): a, c, t, g, unknown or other
  misc_feature (496)..(497): n is a, c, g, or t
  modified_base (499)..(499): a, c, t, g, unknown or other
  misc_feature (499)..(499): n is a, c, g, or t
  modified_base (501)..(505): a, c, t, g, unknown or other
  misc_feature (501)..(505): n is a, c, g, or t
  modified_base (507)..(509): a, c, t, g, unknown or other
  misc_feature (507)..(509): n is a, c, g, or t
  modified_base (511)..(520): a, c, t, g, unknown or other
  misc_feature (511)..(520): n is a, c, g, or t
tcagactactatgtcacgaccggtgctcgatttagagtagtgatcagggggtccgccagtctccaggcggcggtctgcaatgggtggcagttgtctcttatgatggcttttcacacctactatgcaacgccagtgagggccattcaccgtctcccgagacaataccaagaacatggtctatctgcagatggacagcctgcgcactgagacacagctgtctattactgtgcgcgatcagaagtggcggaacctgggctactcctttgactccgtggggccaggggaccctggtcgccgtctcctccgcctccacgacgggccctagtccggtccttccccgnggccgcccctgcctccacggacgccacctccgagacgccacgagccggccctgggcctcggccgtggtaccaaggtacctacttcccaatattacgtagtcctaggacggccgggtactcgggaccgaaagggtcccgacgtaagttacggntgnngngnnnnngnnncnnnnnnnnnn

SEQ ID NO: 37786 - DNA, 567 bp, Homo sapiens
  misc_feature: GYAE6OF01BKAMS.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccgaggggacacagccatcctctcctgcagggccagtcacgcctctcgtccaaccccttagcctggttaccaaacaaaacgcctcggccacgcctccacgactcgtcatctatgatacataccgaaaaggccgacgtcggcgtcccacgccaggttcgcgtggcgaggtgggtcgtggacagacttcgactctacacactcagcagcctaggacgactagaagtattttcgactaatgttaattactgtcagtacagcgtagactacgtcgcctaccattactacttacgtttcggaccgtaacgggaccaagtcgtacggactacgtacgaagtaccgtaacgtgtacggtctacgtaccacctacttctcgttcttaccg

SEQ ID NO: 37787 - DNA, 606 bp, Homo sapiens
  misc_feature: GYAE6OF01D232I.24.4.A04.1.454.CMB.1.raw
  modified_base (353)..(353): a, c, t, g, unknown or other
  misc_feature (353)..(353): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (587)..(591): a, c, t, g, unknown or other
  misc_feature (587)..(591): n is a, c, g, or t
  modified_base (594)..(606): a, c, t, g, unknown or other
  misc_feature (594)..(606): n is a, c, g, or t
tcagactactatgtcacgaccggtgctcgatttagagtagtgatcaggggggtccgccagtctccaggcggcggtctgcaatgggtggcagttgtctcttatgatggcttttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactctttgactccgtgggccaggggccctggtccgccgtcctccctccgccctcccaccgaacgggcccacttccggtcctttcccccgnggcccgcccctcggcctccgacgggacgtccacccgtcccggagacgccgaaccgacggcccgggccccgtcgggtcgtccgtcccggttcgggtacccgtaaaagggtacccttaaccgtttacccgaaccgtaacgtttaacgggtttacggttcccgttagggaaccggtccgggggaccttacgggggacctaaacggggggcccgaccgtaagttaggccgtgngcngnnnnngcnnnnnnnnnnnnn

SEQ ID NO: 37788 - DNA, 675 bp, Homo sapiens
  misc_feature: GYAE6OF01BC2E6.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtccaaccccttagcctggttccaacaaaacgcctggccagcctccacgactcgtcatctatgatacataccgaaaagggccgctcggccgtcccagccgtaggttcgcgtggcaggtgggtcgtgggacagacttcactctcaccatcagcacgcccgtagggacgtaccgtaggtaaagtagttttacgactaaagttacgtttaactttaacgttggttacctaaggtaccgaacggtaccgtacgaaccgtaaccgttccgggtaccctacccgtaattaactttaaccgttaccggtttttacgggacccggtaacgggggtaaccctaacgggtaccgtacgggaacctaacgtaccgaaacggtaaccggtaaacggttcgggtacgggtaccgtacggtacctaaccctatttcccgttacggttccctttacccgg

SEQ ID NO: 37789 - DNA, 458 bp, Homo sapiens
  misc_feature: GYAE6OF01E0TZD.24.4.A04.1.454.CMB.1.raw
  modified_base (448)..(458): a, c, t, g, unknown or other
  misc_feature (448)..(458): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctggggccaggggaccctggtcgccgtctcctccgcctccaccaagggcccatcggtcttcccctggcgccctgctccaggacgcacctccgagacgcacagcggccctgggctgcctggtcaaggtactacttccacatagtagtctgagcgggctgggcaaggcgcatagnnnnnnnnnnn

SEQ ID NO: 37790 - DNA, 582 bp, Homo sapiens
  misc_feature: GYAE6OF01AWAGT.24.4.A04.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (277)..(277): a, c, t, g, unknown or other
  misc_feature (277)..(277): n is a, c, g, or t
  modified_base (365)..(365): a, c, t, g, unknown or other
  misc_feature (365)..(365): n is a, c, g, or t
tcagactactatgtcacgaccggtgctcgatttagagtagtgatcgagggggaggaactgctcagttaggacccagacgggaaccatggaagccccagctcagcttctcttcctcctgctactctggctcccagatgccaccggagacattgtgttgacacagtctccagccacctgtctttgctccgaggggaanagccaccctntccngcagggcagtganaatgtagaattgtagctgtancaacanaaacatgaccaggctacccgctcctanatctatgatgacatccaaagtacgggccacgtggctatccccaagaccaggttacagtggcagtgggctgggactagacttcacgtcncgacatcaagcaggtagtagagccgtagaagttattttcggcttagttttaactacgtgtacgactcgtaccgtagacaacgttccggacccttacgttttccggacccttaggggaccaacgacggtacggacctataaccggaaacgaacgttggtacggtaccttccggacttaacccagtttacctaggtttcccttacgtaactttcccccg

SEQ ID NO: 37791 - DNA, 511 bp, Homo sapiens
  misc_feature: GYAE6OF01B9B0U.24.4.A04.1.454.CMB.1.raw
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (460)..(460): a, c, t, g, unknown or other
  misc_feature (460)..(460): n is a, c, g, or t
  modified_base (487)..(488): a, c, t, g, unknown or other
  misc_feature (487)..(488): n is a, c, g, or t
  modified_base (492)..(511): a, c, t, g, unknown or other
  misc_feature (492)..(511): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcggaacctggggctactcctttgactcctggggccaggggacctggtcgccgtctcctccgcctccaccaacgggcccatcggtccttccccgtggccnccctgcctccgaggtacnccacctccgagacgcaacgagccggcccgtgggcctgcccgtggtccaaacgggaccttaccttccaactacgtaagttacgttctgacggcgggnttacggggcaagggcgcgaagttacgnnacgnnnnnnnnnnnnnnnnnnnn

SEQ ID NO: 37792 - DNA, 585 bp, Homo sapiens
  misc_feature: GYAE6OF01B7QY9.24.4.A04.1.454.CMB.1.raw
  modified_base (558)..(558): a, c, t, g, unknown or other
  misc_feature (558)..(558): n is a, c, g, or t
  modified_base (560)..(561): a, c, t, g, unknown or other
  misc_feature (560)..(561): n is a, c, g, or t
  modified_base (564)..(564): a, c, t, g, unknown or other
  misc_feature (564)..(564): n is a, c, g, or t
  modified_base (566)..(570): a, c, t, g, unknown or other
  misc_feature (566)..(570): n is a, c, g, or t
  modified_base (572)..(585): a, c, t, g, unknown or other
  misc_feature (572)..(585): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcggaactgggctactcctttgactccgtggggccaggggaccctggtccgccgtctccctccgcctccaccgtaacgggcccctacgtccggttcccttcccccgtcgggcccgtccccgtcggcccttaccgaggacgcccaaccgtcccggaagacgccaccgacggcccggcccgtgggcctcggcccgttcgggtaccaaacgggtacccttaaccgttcccaaacgtacgtttaacggttaacgttcgtacgggaacgggtccggggtacgttcgggaaccgtaagggccgtaccgtaagtacggngnngcngnnnnngnnnnnnnnnnnnnn

SEQ ID NO: 37793 - DNA, 473 bp, Homo sapiens
  misc_feature: GYAE6OF01CDG2L.24.4.A04.1.454.CMB.1.raw
  modified_base (194)..(194): a, c, t, g, unknown or other
  misc_feature (194)..(194): n is a, c, g, or t
  modified_base (226)..(226): a, c, t, g, unknown or other
  misc_feature (226)..(226): n is a, c, g, or t
  modified_base (416)..(416): a, c, t, g, unknown or other
  misc_feature (416)..(416): n is a, c, g, or t
  modified_base (451)..(473): a, c, t, g, unknown or other
  misc_feature (451)..(473): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgagggccattcaccgtctcccgagacaataccaagaacatggtctatctgcagatggacngcctgcgcactgagacacagctgtctattacngtgcgcgatcagaagtggcgggaacctggggctactcttgactctggggccagggggaccctggtcgccgtctccctccgcctccaccaagggccccatccggtccttccccgtggccgcccctgcctccgagcgccacctccgagacgcacagccggcctgggctcgcctggtcaaggctacttaccanatagtatcgtgacgcggctggcaaggcgcagtcgnnnnnnnnnnnnnnnnnnnnnnn

SEQ ID NO: 37794 - DNA, 491 bp, Homo sapiens
  misc_feature: GYAE6OF01DG32Z.24.4.A04.1.454.CMB.1.raw
  modified_base (235)..(235): a, c, t, g, unknown or other
  misc_feature (235)..(235): n is a, c, g, or t
  modified_base (340)..(340): a, c, t, g, unknown or other
  misc_feature (340)..(340): n is a, c, g, or t
  modified_base (469)..(476): a, c, t, g, unknown or other
  misc_feature (469)..(476): n is a, c, g, or t
  modified_base (478)..(491): a, c, t, g, unknown or other
  misc_feature (478)..(491): n is a, c, g, or t
tcagactactatgtcacgaccggtgctcgatttagagtagtgatcagggggggtccgccagtctccaggcggcggtctgcaatgggtggcagttgtctcttatgatggctttcacacctactatgcaacgccagtgaggggccattcaccgtctcccgagacaataccaagacatggtctatctgcagatggacagcctgcgcactgaggacacagctgtctattacgtgtgcgngatcagaagtggcggaacctggggctactccttgactcctgggccaggggaccctggtcgccgtctcctccgcctccaccacgggcccagtccgtcttcccccgngccgcctgctccaggcgccacctcgacgagcacacgcggccctgggcctcgcctggtacaacggtacctacttccactagtacgtagtctggacggtcgggctggacgtaacgggccgacagtagctgnnnnnnnngnnnnnnnnnnnnnn

SEQ ID NO: 37795 - DNA, 724 bp, Homo sapiens
  misc_feature: GYAE6OF01EGOGW.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagacgaccgccggagaggtgtgttgtcgcacgtcccgaggccaccctgttcgttgtctccgagggacacacgccactcctctcctgcgacggcagtcacgtcctctccgtacctaacccttagtccgttacggttaaccaaacgaaaacgccgtacggacccacgtccctaccgacgtacctcgtactactctaatcgtaactaactaacgtaaccgaaacgggcccgtacgtcggccgtacccgacgtccgtagggttccgcgtcggtcgtagggttcgggtacgtaggacacgtacttcgacttctacgacctatcgacgtcgacggtccgtaggaacgtacgtacgtaaagtttgtttacgacgttaagttagttaacttacgtcgtaacgtacgactacggacgttagaaccgttaccgtacgacccttacgtaacttacgtacgtttaccggtttacggaccggtaaccggggaacctaacggtacgtaacggtaaccgtaagttaaccggaacggtaaccggtaacgttcgggtacgtaccgtaaccgtacctaacgttaccgttcgtttaccgttccgtttaacccg

SEQ ID NO: 37796 - DNA, 744 bp, Homo sapiens
  misc_feature: GYAE6OF01C16DD.24.4.A04.1.454.CMB.1.raw
  modified_base (718)..(718): a, c, t, g, unknown or other
  misc_feature (718)..(718): n is a, c, g, or t
  modified_base (728)..(728): a, c, t, g, unknown or other
  misc_feature (728)..(728): n is a, c, g, or t
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccgaggggacacacgccatcctctcctgcgaggccagtcacgcctctccgtaccaaccccttagcctggttaccaacaaaacgcctaggccacgcctccacgactcgtcatctatgactacataccgaaaaggccgacgtcggaccgtcccgaaggtccgtaagggtttccgcgttacgggcgtaagggttcgggtacgtacgggtaacctaggtacctttaccgtaaccgtttcccttaaccgaaccctaacgttacgaacgtaccggtaacggtcccggttacgggaacggtaaccgttaggtaaaccggtttaattttttagggaacccttaaaggtttacgtttaaacgttttaacgttcggttaccgtaacggaccgtaaggtaccggtttaacggaaccgttaaacccgtccgggtacccctacccgtaaactttaacgtttaacccgttacgtttttaccgggacccggtaacgggggtacctaacggtacgtacggactacgtacgaacgaacgtacgtggtcgntacgccaacncgttactgttcttacc

SEQ ID NO: 37797 - DNA, 702 bp, Homo sapiens
  misc_feature: GYAE6OF01BGJXB.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcacctgtcgttgtctccgagggacacagccatcctctcctgcagggccagtcagagtgttagcagcagctactagcctggtacagcagaaacctggccgtggctcccgaggtcctcctcattctagtcggtcgccgtaccaccgacgggccctacgtcgggtccgtcggaccggtaacgtacgggtttaccaggggttacggccggtaaggttcggggttccgttttacgggggaacctacgggttacctttacccgtaaccttcccgttcaaacgttcctacgttacccggaacgtacggtaaccgtgggaaaccgtcccggtaaaaggttcgttttacgacgtaggttacgttaactttacgtgttactacggttcgtttcggttttccgtaccccgttccttacccgttaccgttaagttccgttaaccgtttaccgtttcgggaccgttacgggttccacggtcgtaggtaacgtacgtacgacggtacgtaacgtggtacggtcgttagaccctactgttcgttaccg

SEQ ID NO: 37798 - DNA, 694 bp, Homo sapiens
  misc_feature: GYAE6OF01ATSW1.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtacctaacccttagcctcggttaccaaacaaaacgccgtacggccacgccctaccaccgactcgtacactctatgatacactaccgaaaacgggccgcgtcggccgtacccgacgtaccgtacggttccgcgtcggctagggtcggtcgtaggacacgtacttcactcctacactatcgagcacggtccgtagggaacgtacgtaggtaagttacgttttacggaacttaagttacggttaactttacgtacgtacgtaacggtaccgtaaggtaccggtacgtaaccgtaacggttcccgggtacccttaacccgtaatttaaccgttaaccgtttaccggttttaccgggaacccggtaacgggggaacctaacgggtacgtacgggaactaacgtacgtaacggacgtaacggttcggtcggtacgtacgtacctaccgtacttccgtcgttccttaccg

SEQ ID NO: 37799 - DNA, 519 bp, Homo sapiens
  misc_feature: GYAE6OF01CIUVC.24.4.A04.1.454.CMB.1.raw
  modified_base (488)..(488): a, c, t, g, unknown or other
  misc_feature (488)..(488): n is a, c, g, or t
  modified_base (500)..(500): a, c, t, g, unknown or other
  misc_feature (500)..(500): n is a, c, g, or t
  modified_base (502)..(519): a, c, t, g, unknown or other
  misc_feature (502)..(519): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcggaacctggggctactctttgactccgtggggccaggggaccctggtccgccgtctcctccgcctccaccgaacgggcccagtccggtccttcccccgcggccgcccctcgcctccgaggcgccacccgtccgagacgcacgacggccggccctggggctcggccgtggtacaaaggaccttaccttacccacgtaattacggttagtccgtaggaggccgggctgggacgtaagggccncgaacgtaggcngnnnnnnnnnnnnnnnnnn

SEQ ID NO: 37800 - DNA, 637 bp, Homo sapiens
  misc_feature: GYAE6OF01EUWHA.24.4.A04.1.454.CMB.1.raw
  modified_base (319)..(319): a, c, t, g, unknown or other
  misc_feature (319)..(319): n is a, c, g, or t
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtccaaccccttagcctggttaccaacaaaaagcctaggaccacgcctccacgactcgtacatctatgatacaataccgaaaagggccncgtggccgtcccagccgtaggttcgcgtggcctaggtcgggtacgtcgggactacggacttcacgtctacaacctatacagacgagccgtaggagacgtagaagttatttagactaatgttaacttatagtactagcagtcgtagacaacgttcggaccctacgtttaccggcccttgggaacccacggtacgtacggacctaacgtaccgaaaccgtaccgttacggtacggtccgttacggaccctaacccttacgtacccgtttacggttaccctttaccctaaccttttccccgttccccgtcctttaaaccgg

SEQ ID NO: 37801 - DNA, 780 bp, Homo sapiens
  misc_feature: GYAE6OF01BJPGP.24.4.A04.1.454.CMB.1.raw
  modified_base (244)..(244): a, c, t, g, unknown or other
  misc_feature (244)..(244): n is a, c, g, or t
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccgaggggacacagccatcctctcctgcaggccagtcagcctctcgtaccaacccttanccgtcggttaccaaaacgaaaaacgtccgtcggacccgacgacccgttacccaaccggtaaccttccgtactaacgttactaattacgtaaactaactaacgtaaacccggaaaaacggggtcccgacgttaccggacccgttacccacggtacccgttaacgggttcgtaccgtcgggtaccgttaacgggttcgggttaccggtaggggtaaccacggtaaccctttaccgaccttccgtaccctaacctagttaccgacgaccgtaacggtaccggtaggaacgtaacgtaggtaaacgttaccgtttagaactaagtttacggtaatttaccgtgttacgagtcgaacggtcgtacgaacgtacgtaccggtccctacctaacgttaactaacccgttacgtttacggacccggtaaggggtaacctaaggtccggaacggtactaacgtaccggtaaaggaacccgttaacgtccggtacgtacgttaccggtacctaacgtacccgtttacgttccggttccgttaaccc

SEQ ID NO: 37802 - DNA, 619 bp, Homo sapiens
  misc_feature: GYAE6OF01AZNH5.24.4.A04.1.454.CMB.1.raw
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (612)..(612): a, c, t, g, unknown or other
  misc_feature (612)..(612): n is a, c, g, or t
tcagactactatgtcacgaccggtgctcgatttagagtagtgatcagggggtccgccagtctccaggcggcggtctgcaatgggtgcagttgtctcttatgatggctttcacacctactatgcaacgccagtgagggccattcaccgtctcccgagacaataccaagaacatggtctatctgcagatggacagcctgcgcactgaggcacagctgtctattacngtgcncgatcagagtggcggactgggctactctttgactccgtggccaggggacctggtcgccgtctcctccgcctccaccaacgggccctagtccggtccttcccccgtggccgtcccgtcgcctccgacgggacgccgaacccgtccgacgacgaccgaccgacgccgggtccccgttcggggccttcggcccgttgggtacccgtaaacgggtacccttaaccgtttcccgaacgtaacgtttaacggttacggttaccgtttacgggaccgggtaccgggggtaccgttacggggaccgtaaaccggggtaccggtaccggtaaagttacggactcggacgcgacgcgtacgcgtacgtcgcgcgacgcgacgacgcgtcacanctgtgcg

SEQ ID NO: 37803 - DNA, 942 bp, Homo sapiens
  misc_feature: GYAE6OF01CTFO3.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctccagacgaccgcggagaaggtgtgttgtcgcacgtcccaggccacctgtcgttgtcctccgaggggagacgacgccctaccctctccgtgcgacggccaggcggtagttgttaagtaagtacgtaggtcgtacggtaaccaacgaacgaaccgtcggaccgacggtcctacccgacggtcctccgtactacttacgtatgtacgttacgtaccgtaacccgaaccggtaccgggtccccgttacggtaccgtaccccgtaacggtccggttacggggttttccggttcggggtccgggtttacggggtaccgtacggggtaacttaaggtttaaccgtttccaaccgttccgttaaccaaccgtacgtaccggaccggtcccggtacccttaccgtaggtttaccgttaaggtaaacgtttacgttttacggttacccttttaaacgtttttactttaccgttaacggtttaaccctaaaacgtttacgtttacgggttaaccggttcggttaaccggtttcccgggttacccctttaaacccggtttacgttttaaccgggttttacccgggaacccggggttaaaccggggttaaacccgtaaaacgttaggggtaaacccgttaaaccgtaaaacccgggtaaaaccgttaccgggttacgggtaccggtaccgttacgaaccctacccgttaattcccggttaacccgttttaccgttaacccttcccggttttaacccccgttacccgttaaaccctaacccgttttaacgttaaaccggtaaaccttttacggttaacgttaacccggg

SEQ ID NO: 37804 - DNA, 469 bp, Homo sapiens
  misc_feature: GYAE6OF01DHGLT.24.4.A04.1.454.CMB.1.raw
  modified_base (332)..(332): a, c, t, g, unknown or other
  misc_feature (332)..(332): n is a, c, g, or t
  modified_base (460)..(469): a, c, t, g, unknown or other
  misc_feature (460)..(469): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgagggccgattcaccgtctcccgagacaataccaagacatggtctatctgcagatggacagcctgcgcactgaggacacagctgtctattaccgtgcgcgatcagagtggcggactgggctactcttgactcgtgggccaggggcctggtcgccgtctccctccgcctccgaccacggcccatccggtccttccccgnggccgccctgcctccgacggaaccacccgtccgacgagccagacgcgccctgggctcgccgtggtcaaggtactacgttccaacatacgttagtcctaggacgcgggtctggactaaggcgacatagnnnnnnnnnn

SEQ ID NO: 37805 - DNA, 528 bp, Homo sapiens
  misc_feature: GYAE6OF01EY8TE.24.4.A04.1.454.CMB.1.raw
  modified_base (229)..(229): a, c, t, g, unknown or other
  misc_feature (229)..(229): n is a, c, g, or t
  modified_base (349)..(349): a, c, t, g, unknown or other
  misc_feature (349)..(349): n is a, c, g, or t
  modified_base (507)..(528): a, c, t, g, unknown or other
  misc_feature (507)..(528): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattacngtgcgcgatcagaagtggcgggaacctggggctactcctttgactccgtggggcccaggggaccctggtccgccgtctccctccgcctccaccaacgggcccatccggtccttcccccgnggcccgccctgcctccgagggacgccaccgtccgagacgcacgacgccggcccgtgggcctcggccgtgggtaccaaaggtcctaccttccaactagttaggtaacgtctggacggccgggtctaggggacaacggggtccgacgtaacgtaggctgnnnnnnnnnnnnnnnnnnnnnn

SEQ ID NO: 37806 - DNA, 596 bp, Homo sapiens
  misc_feature: GYAE6OF01DF2D6.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccagggacacagccatcctctcctgcagggccagtcagcctctcgtcaacccttagcctggttccaacaaaagcctggccagcctccacgactcgtcatctatgatacataccaaaagggtccgactcggctcccgagcctaggttccgctggcaggtgggtctgggacagacttcactctcaccatcagcacgtcctggacgactacgtaagtattttagactaagttagtaattacgttgtacagtcagtcgtacgaactaacgtcggaccctcccgtaattactaccttacgttttacggaccgtaacggggaaccaagtcgtaggacctaagtaccgtaacgaacgaacgttcggtacgggtaccgtacggtaccctaaccctagttaccttcggttcctttacccg

SEQ ID NO: 37807 - DNA, 810 bp, Homo sapiens
  misc_feature: GYAE6OF01DTVEV.24.4.A04.1.454.CMB.1.raw
tcagactactatgtcacgaccggtgctcgatttagagtagtgatcaggggggaggaactgctcagttaggacccagagggaaccatggaacgccccagctcagcttctcttcctcctgctactctcggcctccaggacgaccggccggagaaggtgtgttgtcgcacgtccccaggccacccttgtcgttcgtctccgacgggacacacgccactcctcctcctcggcgacgggccacgtcacgccttctccgttaccctaaccccgttacgccgttacggttaacccaaacgtaaaaccggccgtacggacccacgtcccctaccaccgtactccgtactacttctagtacgtaactaacaaccgtaaccggaaaacgggcccgtacgtaccgggaccctacccgcggtaccggtacggtttcccgcgttacgggcggttacggttcggggtaccgtacgggtaacctacgtaaccttccgaaccgtttccaaccgtaacctaacgtaccgtacgtaccgtaccgtacccgggtaaggaaccgtacggttagttaaacggtttagtttaacggaacttaagttaacttacgttaacgtacgtacgtaagtccggtaaacgtcggtaaccgaaccgttacggtaccccggtacccttaaccgtaaacgttaccgtttaacccggttacgtttaccgggaaccggtaacggggtaaccaacggtcggttaacaaccggtaacgtaccgaaggttacccggaaaggttcggacgttacgactacctactataccggtttgttccctttaacg

SEQ ID NO: 37808 - DNA, 550 bp, Homo sapiens
  misc_feature: GYAE6OF01A18Q7.24.4.A04.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (527)..(527): a, c, t, g, unknown or other
  misc_feature (527)..(527): n is a, c, g, or t
  modified_base (529)..(534): a, c, t, g, unknown or other
  misc_feature (529)..(534): n is a, c, g, or t
  modified_base (536)..(541): a, c, t, g, unknown or other
  misc_feature (536)..(541): n is a, c, g, or t
  modified_base (543)..(550): a, c, t, g, unknown or other
  misc_feature (543)..(550): n is a, c, g, or t
tcagactactatgtcacgaccggtgctcgatttagagtagtgatcaggggggtccgccagtctccaggcggcggtctgcaatgggtggcagttgtctcttatgatggcttttcacacctactatgcaacgccagtggaggggccgattcaccgtctcccgagacaataccaagaacatggtctatctgcagatggacagcctgcgcacgtggaggacncgagctgtctattcngtcgcgcgatcaggaaggtgggacggaccgtgggcctaccttcgttcgaccgtccggtcgggcccgtacggggcccgttggtccgtccgttccgtcccgtcccgcctcccgacgaccgggccctacgtccggttcccttccccgcggcccgtcccgtcgcctccgaggaccgccaccgtcgacggcgacgaccgacggcccggccgtcggctcggccgtcggtacgacggtacctaccgtcaacgtagtcgtagtctggacggcggctgggacgaggacgcgtagtagctgacngnnnnnngnnnnnngnnnnnnnn

SEQ ID NO: 37809 - DNA, 554 bp, Homo sapiens
  misc_feature: GYAE6OF01A8R3F.24.4.A04.1.454.CMB.1.raw
  modified_base (174)..(174): a, c, t, g, unknown or other
  misc_feature (174)..(174): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (529)..(529): a, c, t, g, unknown or other
  misc_feature (529)..(529): n is a, c, g, or t
  modified_base (531)..(532): a, c, t, g, unknown or other
  misc_feature (531)..(532): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (546)..(547): a, c, t, g, unknown or other
  misc_feature (546)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
tcagactactatgtcacgaccggtgctcgatttagagtagtgatcagggggtccgccagtctccaggcggcggtctgcaatgggtgcagttgtctcttatgatggctttcacacctactatcgcaacgccagtgagggccgattccaccgtctcccgagacaataccaagaacntggtctactcgtgcagatcggacagcctgccgcacgtgacgacacagctgcttattacnggtncgngatcagaagtcgggcgaacggtgggcctacttccgtttgacctccggtcgggccgacgggacctggtccgccttcgtcctccgcctcgaccgacggccagtccgtcccttccccgnggccncctcgcgtacccgaggccgcctacccgtcgaggaccgacgacacggcccggtccgttcggctcggccgtacggactaacccggcttacctccacgtagtacgtacgtccgtagacggcgggtactggaaccgacgggtacgagacgtaggcacnggctgngacgnagngnncncngngcgtcgcnncngngcg

SEQ ID NO: 37810 - DNA, 542 bp, Homo sapiens
  misc_feature: GYAE6OF01B3AR8.24.4.A04.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (519)..(525): a, c, t, g, unknown or other
  misc_feature (519)..(525): n is a, c, g, or t
  modified_base (527)..(529): a, c, t, g, unknown or other
  misc_feature (527)..(529): n is a, c, g, or t
  modified_base (531)..(534): a, c, t, g, unknown or other
  misc_feature (531)..(534): n is a, c, g, or t
  modified_base (536)..(540): a, c, t, g, unknown or other
  misc_feature (536)..(540): n is a, c, g, or t
  modified_base (542)..(542): a, c, t, g, unknown or other
  misc_feature (542)..(542): n is a, c, g, or t
tcagactactatgtcacgaccggtgctcgatttagagtagtgatcagggggggtccgccagtctccaggcggcggtctgcaatgggtggcagttgtctcttatgatggctttcacacctactatgcaacgccagtggaggggccattcaccgtctcccgagacaataccaagaacatggtctatctgcagatggacagcctgcgcactgagacanagctgtctattacngtgcgcgatcagagtggacggaaccgtgggctactcgttgactcggcgggaccgacgggtcctggtcgccgtctcctccgcctacccgacgaacggccctacgtccggttcccttaccccgtcggcccgtccctcgcccgtccgaggacgcctaacccgtcggagacgacaacgcggaccggcccgtggcctcggaccgtcggtaaccgaaggtaccttactaccgactagttaacgtcggcgtaggacggtccggtcgtacggaacgtaacggctacgagtacgcagtnnnnnnngnnncnnnncnnnnngn

SEQ ID NO: 37811 - DNA, 867 bp, Homo sapiens
  misc_feature: GYAE6OF01D8W6S.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggccaccctgtcgttgtctccgagggacacagccatcctctcctgcagggccagtcagcctcgtcgtaccaaccccttagcctaggttaccaaacaaaacgcctaggaccagccctacacgactcgtcatactatgactacactaccgaaaagggcctcgtacggccgtacccacggccgtaagggtttcgacgttcgggaccgtaagggttcgggttaccggttagggtaaccacgggttacctttaccgaaaccgtttccctaccgtaaaccctaacttacccgaccgtacgtaaacgggtttcggtaaaacgggtacggttaccccgtttaaggtaaacggttttaacgtttttcggaaccgttttaaacgggttttttaactttaaccggtttaacgttacccggtaacggttacccttaaaccgggttaccgtaaaccgtaaacccggtttcggacccccgttaaaccggtttttcccgggaacccccggtttacgggggtaaacccctaacggggttaacccggttaaccgggtaaccgttaacccgttaacccggaaaacccggttaaccgttagggtaccgggtacgttaccggaaccctaacccgtaacgttccgtttaccgggttacttttacccggtaaacccttttaacccggttaccccggactttaaaccccgtcgttaaaaccgg

SEQ ID NO: 37812 - DNA, 553 bp, Homo sapiens
  misc_feature: GYAE6OF01BUN2E.24.4.A04.1.454.CMB.1.raw
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (392)..(392): a, c, t, g, unknown or other
  misc_feature (392)..(392): n is a, c, g, or t
  modified_base (532)..(553): a, c, t, g, unknown or other
  misc_feature (532)..(553): n is a, c, g, or t
tcagactactatgtcacgaccggtgctcgatttagagtagtgatcgagggggggtccgccagtctccaggcggcggtctgcaatgggtggcagttgtctcttatgatggctttcacacctactatgcaacgccaggtgaggggccattcaccgtctcccgagacaataccaagaacatggtctatctgcagatggacagcctgcgcactggagacacagctgtctattctggtgcgcgatcaggaagtggcggaactggggctactcctttgaccgtccgagggggccaggggtaccccgtggtccgtcccgtcctcccgtcccgcctacccgaaccgaacgggcccctagtccgtccctttccccgnggccncccgtgcctccgaggaccncgtacccgtccggaagtcggaccaccgacggcccggtcccgtgggcccttggcccgttcggaactaacggaccttacgttaccacggtattacgtacgtcgtaggacggcggtgtacggcgaacgggccgtacaagtcgnnnnnnnnnnnnnnnnnnnnnn

SEQ ID NO: 37813 - DNA, 774 bp, Homo sapiens
  misc_feature: GYAE6OF01CSK81.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggccacctgtcgttgtctccgaggggacacacgccatcctctcctgcacgggccagtcgagtcctcgtccgtaccctaaccccttagcccttacggttacccaaacgaaaacgcctcggcccacgccctccaaccgacttccgtacactacctatgataacactaaccgaaaacgggcccgacgtcggaccgtcccagccgtaacggttcgaccgtggcgtacggtgggtccgtaggacgagtaccgttcaccgtctccacctactcgactcgacgtcgtaggagaccgtaggtaacgttaagttttacgaacttaagttacgtttaactttacgttacgttacgaacgtacgtaacggtaccggtacggtaaaccgtaacccggtaccgtaccccgtaaccccgttaactaaccgtttaaccgttaccgttttttaccgggaacccgggtaacggggtacccgtaacgggtcccggttaacggtaaaccgtaacgtaccggtaaaaccgggaccgttaaaccgggttaccgggttacggtacccggttacgtaccccggttaaccctaaccgtttaccgtttccggtttaaccccttttaccccgg

SEQ ID NO: 37814 - DNA, 572 bp, Homo sapiens
  misc_feature: GYAE6OF01DA1IA.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggtaccaacaaagcctggccagcctccacgactcgtcatctatgatacatccaaaaagggccgctcggcgtcccagcccaggttcgctggcagtgggtctgggacagacttcactctcacctatcagcagcctggagactgaagtatttgactaatgtaattactgtcagcagcgtgactaactcggcctcccatactactacgttttggacccgtaaggggaccctaaggtaccgtaggaaccgtagtaccgtaacggaaccgtaaacgttcggtacgggtaccttcggaccccaaacgtacgttcctcggttccctttaacccg

SEQ ID NO: 37815 - DNA, 699 bp, Homo sapiens
  misc_feature: GYAE6OF01CARWL.24.4.A04.1.454.CMB.1.raw
  modified_base (240)..(240): a, c, t, g, unknown or other
  misc_feature (240)..(240): n is a, c, g, or t
  modified_base (655)..(655): a, c, t, g, unknown or other
  misc_feature (655)..(655): n is a, c, g, or t
  modified_base (664)..(665): a, c, t, g, unknown or other
  misc_feature (664)..(665): n is a, c, g, or t
  modified_base (672)..(673): a, c, t, g, unknown or other
  misc_feature (672)..(673): n is a, c, g, or t
  modified_base (681)..(681): a, c, t, g, unknown or other
  misc_feature (681)..(681): n is a, c, g, or t
  modified_base (689)..(689): a, c, t, g, unknown or other
  misc_feature (689)..(689): n is a, c, g, or t
  modified_base (693)..(693): a, c, t, g, unknown or other
  misc_feature (693)..(693): n is a, c, g, or t
  modified_base (695)..(695): a, c, t, g, unknown or other
  misc_feature (695)..(695): n is a, c, g, or t
tcagactactatgtcacgaccggtgctcgatttagagtagtgatcgagggggtccgccagtctccaggcggcggtctgcaatgggtggcagttgtctcttatgatggctttcacacctactatgcaacgccagtgagggccgattcaccggtctccgagacaataccaagacagtggtctaatctgcagatggacagcctgcgcacgtgaggaccacgagctgtactattacgtggtcgngtacgatcgaggaagttcgggacgggaaaccgtggggtcctaacgtttccttttaggacctccgtacgggggccgtacggggtaccctcgggttaccgtcccgttccgtcccgtacccgcccgttaccccgaaccgaaccgggggcccctaacgttccccgggtccccgtttcccccgtagggtcccgtccccgtcgtcccgtaccgtaacgggacgccgtaacccgtccggaacgaacgcccgaaaccgcggcccgggtcccggtagggtccgttcccggacgttacgggtaccgaaaacgggttacccttaacccggtttaccaacggtactaaacgggttcgtacccggtagggtaaccggcggggtaccttacggggaccgtaaacgggcccgtaacggtaacgagtcgancgagctcgnngacgcgnngagctcgncgacgcgngcgngngtcg

SEQ ID NO: 37816 - DNA, 657 bp, Homo sapiens
  misc_feature: GYAE6OF01A0TQH.24.4.A04.1.454.CMB.1.raw
  modified_base (200)..(200): a, c, t, g, unknown or other
  misc_feature (200)..(200): n is a, c, g, or t
  modified_base (448)..(448): a, c, t, g, unknown or other
  misc_feature (448)..(448): n is a, c, g, or t
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccgaggggacacganccatcctctcctgccagggcctaggtcacgcctctcgtaccaaccccgttagccttaggttaccaaactaaaagcctaggacccagcctcccacgactcgtacactctactgatacataccaaaacgggccgactcggcgtacccagaccgaggttcgcgtaggcaggtcgggtctcgggacagtactcgactctacaactactcagtcacgtccgtaggagactagaacgttatttcgactaagttntaacgttactagtactacgtactacgtacggtacgtaacgacctggtacccctacctaagttaacttaaccgttacgttttaccggaccgtaacggggaacccctaaggccgtaagggtaaccaaacgttaccggaaacggtaaccgtaacggttggtaccggtaccttacgacccgtaacctacgtttccgttcgttaccttaacccc

SEQ ID NO: 37817 - DNA, 777 bp, Homo sapiens
  misc_feature: GYAE6OF01A7VN5.24.4.A04.1.454.CMB.1.raw
  modified_base (750)..(750): a, c, t, g, unknown or other
  misc_feature (750)..(750): n is a, c, g, or t
  modified_base (754)..(754): a, c, t, g, unknown or other
  misc_feature (754)..(754): n is a, c, g, or t
  modified_base (756)..(756): a, c, t, g, unknown or other
  misc_feature (756)..(756): n is a, c, g, or t
  modified_base (761)..(761): a, c, t, g, unknown or other
  misc_feature (761)..(761): n is a, c, g, or t
  modified_base (764)..(775): a, c, t, g, unknown or other
  misc_feature (764)..(775): n is a, c, g, or t
  modified_base (777)..(777): a, c, t, g, unknown or other
  misc_feature (777)..(777): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactggaggacacgagtcctgtcttatttacgtgtcgcgcgtatcgaaggaaggtgggaccggggtaaccgttcggggggtacctttaaccgtttcccgttttcggtaacccgtttcccgggttacggggggaccccggaccgggggggtacccccgtttcgggggttcccggtccccggtttcccgttcccccgtccccggtcccccgttaccccgaaaccccggtaaccgggggccccctaacgtttcccccgggtttccccgttttcccccccgtcggggtccccggtcccccgttacggccccttaacccggacggggaccgtacccgaaccccgttacccgggacggaaccggtcccgaaccgaccggggtaccccgggtccccggttcgggggtcccttccgggtccccggttacggggttaccggtaaaccgggtaacccttaaccgtttaccaacctaacggttaacggttaacgttcggtacggaccgggcggggttccgacgggtaacggaacgggccgacgttaaggagtcgatgngacngngacgncgnnnnnnnnnnnngn

SEQ ID NO: 37818 - DNA, 495 bp, Homo sapiens
  misc_feature: GYAE6OF02GWLJ9.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagcctccacgactcgtcatctatgatacatccaaaagggccgctggcgtcccagccaggttcgctggcagtgggtctgggacagacttcactctcaccatcagcagcctggagactgaagattttgcaatgtattactgtcagcagcgtgacaactggcctccatatacacttttgcctagggaccaagctggacatcgagacgaactgtgctgcaccatctgtcttc

SEQ ID NO: 37819 - DNA, 455 bp, Homo sapiens
  misc_feature: GYAE6OF02HIMJN.24.4.A04.1.454.CMB.1.raw
  modified_base (448)..(455): a, c, t, g, unknown or other
  misc_feature (448)..(455): n is a, c, g, or t
tcagactactatgtcacgaccggtgctcgatttagagtagtgatcagggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctggggccaggggaccctggtcgccgtctcctccgcctccaccaagggcccatcggtcttccccctggccgccctgcctccaggacgcacctccgagagcacagccggccctgggctgcctggtcaaggctacttccacatagtagtctgagcgggctgggcaaggcgcatagnnnnnnnn

SEQ ID NO: 37820 - DNA, 504 bp, Homo sapiens
  misc_feature: GYAE6OF02IFA93.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctcttgtcaaccccttagcctggttccaacaaaagcctggccagcctccacgactcgtcatctatgatacatccaaaagggccgctggcgtcccagccaggttcgctggcagtgggtctgggacagacttcactctcaccatcagcagcctggagactgaagtattttgcaattgtattactgtcagcagcgtgacaactggcctccatactactacttttgccgtaggggaccaagcgtggacatcagacgaactgtgctcgacaccatctcgtcttc

SEQ ID NO: 37821 - DNA, 455 bp, Homo sapiens
  misc_feature: GYAE6OF02INA3E.24.4.A04.1.454.CMB.1.raw
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (446)..(455): a, c, t, g, unknown or other
  misc_feature (446)..(455): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctggggccaggggaccctggtcgccgtctcctccgcctccaccaagggccatcgtcttcccnggcnccctgctccaggacncacctccgagngcacacgccggccctgggcctgcctggtcaaggactacttccacatagtagtctgagcgggctgggcaaggcgcatagnnnnnnnnnn

SEQ ID NO: 37822 - DNA, 499 bp, Homo sapiens
  misc_feature: GYAE6OF02FW8KL.24.4.A04.1.454.CMB.1.raw
  modified_base (329)..(329): a, c, t, g, unknown or other
  misc_feature (329)..(329): n is a, c, g, or t
  modified_base (481)..(481): a, c, t, g, unknown or other
  misc_feature (481)..(481): n is a, c, g, or t
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagcctccacgactcgtcatctatgatacatccaaaagggccgctggcgtccagccaggttcnctggcagtgggtctgggacagacttcactctcaccatcagcagcctggagactgaagattttgcaatgtattactgtcagcagcgtgacaactggcctcccatatactacttttgcctagggaccaagctggacatcgagacgaactgtcgntggcaccatctgtcttac

SEQ ID NO: 37823 - DNA, 512 bp, Homo sapiens
  misc_feature: GYAE6OF02JAFMC.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggctagcctccacgactcgtcatctatgatacatccaaaaggccgctggcgtcccagccaggttcgctggcagtgggtctggacagacttcactctcacatcagcagtgtagagcctgaagattttgctagtttattactgtcagctaccgtgacaacgtgcccactttcggcccttggaccagacgtcggactactccaacgactgtcgctgcacctatctgtcttcactccttcccgctactctacg

SEQ ID NO: 37824 - DNA, 540 bp, Homo sapiens
  misc_feature: GYAE6OF02FZSN1.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagcctccacgactcgtcatctatgatacatccaaaagggccgctggcgtcccagccaggttcgctggcagtgggtctgggacagacttcactctcaccatcagcagcctggagactgaatatttgctactttattctgtcaacacttatggttgactggcctccgtactacttttggccgtacggggaaccaacgtggacatacgaaacgtactgtacggcgttgaccaccgattcgtgttccttactacttcccttccccgcctattacccg

SEQ ID NO: 37825 - DNA, 595 bp, Homo sapiens
  misc_feature: GYAE6OF02JPL3P.24.4.A04.1.454.CMB.1.raw
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(580): a, c, t, g, unknown or other
  misc_feature (579)..(580): n is a, c, g, or t
  modified_base (583)..(583): a, c, t, g, unknown or other
  misc_feature (583)..(583): n is a, c, g, or t
  modified_base (585)..(587): a, c, t, g, unknown or other
  misc_feature (585)..(587): n is a, c, g, or t
  modified_base (589)..(589): a, c, t, g, unknown or other
  misc_feature (589)..(589): n is a, c, g, or t
  modified_base (591)..(595): a, c, t, g, unknown or other
  misc_feature (591)..(595): n is a, c, g, or t
tcagactactatgtcacgaccggtgctcgatttagagtagtgatcagggggtccggccgagtctccaggcggcggtctgcaatgggtggcagttgtctcttatgatggctttcacacctactatgcaacgccagtgagggccgattcaccgtctcccgagacaataccaagaacatggtctatctgcagatggacagcctgcgcactgaggactacagctgtctattactgtgcgcgatcagaatggcggaacctggggctacgtccctttgacttccgtcggggccaggggaccctggtccgcccggtcctccttccggcctccgtacccgaaggggccccagttccggttccgttcccccgttggcccgtcccgtacgcctcccgaggtacgcccaccgtccgacgacgccaccgacgacccggccctggggccctcggcccgttggggtacccgaaaggaccgtttacccgttccgaaccacgtttaacggtccgttaaccgttcgggacggacccggtccgttgggaccgaacggtccggcccaagtaacggcctaggcagccgagccngngngnncgncnnncncnnnnn

SEQ ID NO: 37826 - DNA, 475 bp, Homo sapiens
  misc_feature: GYAE6OF02I8FF4.24.4.A04.1.454.CMB.1.raw
  modified_base (456)..(475): a, c, t, g, unknown or other
  misc_feature (456)..(475): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcggaacctggggctactctttgactcctggggccaggggacccctggtcgccgtctcctccgcctccaccaagggcccatcggtcttcccctggccgccctgctccaggacgcacctccgagacgccacacgccggcccgtgggcctcgcctggtcaaggactacttccacatagtagtctggagcgggctcggcaaggcgcagtacgnnnnnnnnnnnnnnnnnnnn

SEQ ID NO: 37827 - DNA, 498 bp, Homo sapiens
  misc_feature: GYAE6OF02FSCIO.24.4.A04.1.454.CMB.1.raw
  modified_base (380)..(380): a, c, t, g, unknown or other
  misc_feature (380)..(380): n is a, c, g, or t
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagcctccacgactcgtcatctatgatacatccaaaagggccgactggcgtcccagccaggttcgctggcagtggtctggacagacttcactctcaccatcagcagcctggganactagaagtattttgctaatgtattaactgtcagcagcgtgacaactgcctccatactactactttggccagggacaagctgacatcgaagacaactgtgctgcaccatctgtcttac

SEQ ID NO: 37828 - DNA, 456 bp, Homo sapiens
  misc_feature: GYAE6OF02FE3D8.24.4.A04.1.454.CMB.1.raw
  modified_base (444)..(456): a, c, t, g, unknown or other
  misc_feature (444)..(456): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctggggccaggggaccctggtcgccgtctcctccgcctccaccaagggcccatcggtcttccccctggcgccctgctccaggagcacctccgagagcacagcggccctgggctgcctggtcaaggactacttccacatagtagtctgagcgggctggcaggcgcatagnnnnnnnnnnnnn

SEQ ID NO: 37829 - DNA, 542 bp, Homo sapiens
  misc_feature: GYAE6OF02H1EDP.24.4.A04.1.454.CMB.1.raw
  modified_base (519)..(542): a, c, t, g, unknown or other
  misc_feature (519)..(542): n is a, c, g, or t
tcagactactatgtcacgaccggtgctcgatttagagtagtgatcaggggggtccgccattctccaggcggcggtctgcaatgggtggcatttgtctcttatgatggcttttcacacctactatgcaacgccagtgaggggccgattcaccgtcctcccgagacaataccaagaacatggtctatctgcagatggacagcctgcgcactgaggacacagctgtctattactgtgcgcgatcagagtggcggacgtgggctactcttgcctcgtggggccgacggggcctggtccgccgtctccctccgcctccaccgacggccctagtccggtcccttccccgtggcccgtcccctgccctccgaggacgccacccgtccgagacgccacgacggcccggtcccgtgggcctcggcccgttgggtacccgaaacggtaccttaccgttcccaacgtaagttacggttacgtcgtagggacggccggggtactcgggacgaacgggccgacgaagtacgnnnnnnnnnnnnnnnnnnnnnnnn

SEQ ID NO: 37830 - DNA, 458 bp, Homo sapiens
  misc_feature: GYAE6OF02HAT1K.24.4.A04.1.454.CMB.1.raw
  modified_base (373)..(373): a, c, t, g, unknown or other
  misc_feature (373)..(373): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (449)..(458): a, c, t, g, unknown or other
  misc_feature (449)..(458): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctggggccaggggaccctggtcgccgtctcctccgcctccaccaagggcccatccggtccttccccctggccgccctgctcccaggcgcacctccganacgcacagccgccctgggctgcctggtcaaggctacttccacatagtagtctgngcgggctggcaaggcgnatagnnnnnnnnnn

SEQ ID NO: 37831 - DNA, 486 bp, Homo sapiens
  misc_feature: GYAE6OF02HTJWW.24.4.A04.1.454.CMB.1.raw
  modified_base (339)..(339): a, c, t, g, unknown or other
  misc_feature (339)..(339): n is a, c, g, or t
  modified_base (463)..(463): a, c, t, g, unknown or other
  misc_feature (463)..(463): n is a, c, g, or t
  modified_base (465)..(472): a, c, t, g, unknown or other
  misc_feature (465)..(472): n is a, c, g, or t
  modified_base (474)..(486): a, c, t, g, unknown or other
  misc_feature (474)..(486): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccattcaccgtctcccgagacaataccaagaacatggtctatctgcagatggacagcctgcgcactgaggacacagctgtctattctgtgcgcatcagaagtggcgggaacctggggctactccttgactccgtgggccaggggccctggtcgccgtctcctccgcctccaccagggcccatcggtctccccgtggccncctgcctccgaggacgccacctccgagagccacgagccggccctgggcctcgcctggtcaacggacttacctccactataggtacttcgtaggagtcgggctgggacaaagggcgcgagtagcngnnnnnnnngnnnnnnnnnnnnn

SEQ ID NO: 37832 - DNA, 476 bp, Homo sapiens
  misc_feature: GYAE6OF02JIRLH.24.4.A04.1.454.CMB.1.raw
  modified_base (228)..(228): a, c, t, g, unknown or other
  misc_feature (228)..(228): n is a, c, g, or t
  modified_base (451)..(453): a, c, t, g, unknown or other
  misc_feature (451)..(453): n is a, c, g, or t
  modified_base (457)..(476): a, c, t, g, unknown or other
  misc_feature (457)..(476): n is a, c, g, or t
tcagactactatgtcacgaccggtgctcgatttagagtagtgatcagggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattacngtgcgcgatcagaagtggcgggaacctggggctactctttgactcctgggccaggggaccctggtcgccgtctcctccgcctccaccaggcccatcggtctcccctgccgccctgctccagacgcaccgtccgagacgcacagccggccctggcctgccgttcggcaacggactacgttccacgatagttacgtctcggagcggtctggcaaggcgcgatagnnngctnnnnnnnnnnnnnnnnnnnn

SEQ ID NO: 37833 - DNA, 703 bp, Homo sapiens
  misc_feature: GYAE6OF02F356H.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtctgtgtctccaggggaaagagccaccctctcctgcagggccagtgagaatgttggcagcaacttagcctggtaccagcagaaacctggccaggctcccgaggcctcctcctctatcgctcgtcctcccgaccacgggccccctgggtcgtccccgagccgtagggtttccgttgggcgggttggggttcgtcggggactaggtacgttttaccacgttctcccgaacctagttccacggcccggtccctccgacgttctaggtaagtatttttcgctaacttttatttctgttaccgtaactacttaagttcgggttacgtaaccgtcggttacccgtcccggttaccttaccggtttttgggaccccggtaacgggggtaacccgtaaaacggttacgggtaacggtaacgtaaccgaaaaccggtaacgttacgggtacggtcctacggaccttaaccgaacttccgttcgttacctttcgtaaccttttccgttacccccgtcttacttaccgtacgtaaccg

SEQ ID NO: 37834 - DNA, 497 bp, Homo sapiens
  misc_feature: GYAE6OF02G2H6O.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagcctccacgactcgtcatctatgatacatccaaaaggccgctggcgtcccagccaggttcgctggcagtgggtctgggacagacttcactctcaccatcagcagcctggagactgaagtattttgcaatgtattactgtcagcagcgtgacaactcggcctccatatactactttgccagggaccaagctagacatcgaagacaacgtgtagctagcacatctgtctac

SEQ ID NO: 37835 - DNA, 456 bp, Homo sapiens
  misc_feature: GYAE6OF02GP6YU.24.4.A04.1.454.CMB.1.raw
  modified_base (443)..(443): a, c, t, g, unknown or other
  misc_feature (443)..(443): n is a, c, g, or t
  modified_base (449)..(456): a, c, t, g, unknown or other
  misc_feature (449)..(456): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctcccgagacaataccaagaacatggtctatttgcagatggacagcctgcgcactgaggacacagctgtctattactgtgcgcgatcagaagtggcgggaacctggggctactcctttgactcctggggccaggggaccctggtcgccgtctcctccgcctccaccaagggcccatccggtcttccccctggccgccctgcctccaggagcacctccgagagcacagcggccctgggcctgcctggtcaagggactactccacatagtagtctgagcgggctggcaaggcncatagnnnnnnnn

SEQ ID NO: 37836 - DNA, 482 bp, Homo sapiens
  misc_feature: GYAE6OF02H2FVS.24.4.A04.1.454.CMB.1.raw
  modified_base (453)..(453): a, c, t, g, unknown or other
  misc_feature (453)..(453): n is a, c, g, or t
  modified_base (460)..(461): a, c, t, g, unknown or other
  misc_feature (460)..(461): n is a, c, g, or t
  modified_base (464)..(482): a, c, t, g, unknown or other
  misc_feature (464)..(482): n is a, c, g, or t
tcagactactatgtcacgaccggtgctcgatttagagtagtgatcagggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcggaactggggctactctttgactctgggccaggggacctggtcgccgtctcctccgcctccaccaagggcccatcggtctcccctggccgccctgctccaggacgcacctccgagagccacagccggccctgggcctcggcccgtggtccaaagggtacctacttcccactatacgtacgtctggagtcgggctggcaagggtccncgatagnncannnnnnnnnnnnnnnnnnn

SEQ ID NO: 37837 - DNA, 650 bp, Homo sapiens
  misc_feature: GYAE6OF02IA107.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagcctccacgactcgtcatctatgactacataccgaaaacggggccgacgtcggaccgtcccacgcccgtagggttccgcgttcggcgagggttcgggtcgtacgggaacctacggtaccttcgaccttccgtaccaacctataccgacgccacggtccgtagggacgtacgtaggtaagttagtttttcggactaaagttagttaactttacgtgttacagtcgtaggtcgtacgaacgtaacgtccggaccttacccaattactaccgttacgttttacggaccgtaacggggaacctaacggtcgtacgactacgtacgaacggaacgtacgtggttacggtcgtacgacctaccgtacgttccgttcgttaccttaccg

SEQ ID NO: 37838 - DNA, 682 bp, Homo sapiens
  misc_feature: GYAE6OF02JXLOA.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtccaacccttgcctcggtaccaaacaaacgcctcggccacgcctccacgtactcgtcatctatgactacactaccgaaaacgggccacgtcggccgtcccagccgtaggttccgcgtggcgtaggtcgggtcgcggacacggtacttacgacttccgtaccactacgtaccacggaccgacgtccgtagggacgtaccgtaggtaaacgttagttttacgactaagttacgttaacttacgtacgtacgacgtacgacgtcggtacgaaccgtaacgtccggtacccttacccgtattaaccttaaccgttaccgttttacggacccggttaacgggaacccgtaacggtaccgtacggtacctacgttaccgaaccggtaaccgtaacggttcggtaccggtacgtaccggacctaccgtacgttccgttaccggttacctttaacccgg

SEQ ID NO: 37839 - DNA, 579 bp, Homo sapiens
  misc_feature: GYAE6OF02HLX1H.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagcctccacgactcgtcatctatgatacactaccaaaagggccgactcggcctcccagcccaggttcgctggcaggtcggtctgggacagacttcactctacaccatcagcacgccgtggacgactgaagtattttagctaatgttattactgtacagcagcgtagaacacgtcggaccctaccgactactaccttacgttttacggaccgtaacgggaacctaacggtcgtacggactacgtaccgaaggaccgtaaacgtcggtacggtaccgtacggacctaccgtacttccgttacgttctttacccg

SEQ ID NO: 37840 - DNA, 508 bp, Homo sapiens
  misc_feature: GYAE6OF02GV4O5.24.4.A04.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (486)..(508): a, c, t, g, unknown or other
  misc_feature (486)..(508): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgagggccattcaccgtctcccgagacaataccaagaacatggtctatctgcagatggacagcctgcncactgaagcacagctgtctattacngtgcgcatcagaagtggcggaactgggctactcctttgactccgtgggccaggggccctggtcgccgtctcctccgcctccaccacgggccctatcggtcccttccccnggccnccctcgcctccgaggacnccaccgtccgagacncaacgcgccggtccctgggctacgccgtcggtacaacggaccttacttccgactagttacgttacgtcagggacgccgggtcgtgggaccgaagggcccgagaacgttagcgnnnnnnnnnnnnnnnnnnnnnnn

SEQ ID NO: 37841 - DNA, 868 bp, Homo sapiens
  misc_feature: GYAE6OF02GA337.24.4.A04.1.454.CMB.1.raw
tcagactactatgtcacgaccggtgctcgatttagagtagtgatctaggggggaggaacgtgcgtcaccgttacggacccgtacgaggggaacctatggaagtccccgagctcagcttctcttcctcctgctaactctggctcccaggagtaccggccggagaaggtgtggtttgtcgcagtcccctaaggctaccctgtcgttgtcgtccaggggacacagccgatcctcgtccgtgtcgacgggccacggtcggacgcctacgtccgtccaacctacgttacgcccgttacgggttcccaaacgtaaaacggcccttacgggaccctaggcccttaccgtaaccggtaaccttccggttactacttaccttaacgttacggtaaccttaacccgaacgttaccccgtaaaaaaacgggggcccgggtaccggttacggggtaccggttaccccgaacggtacccgttaacgggttttccggacggtttaacggggtaccgtaaggggtttacgggggttaccgtaacggggggtaaacctaaagggtaacccttttacgtaaacgtttcctaccgtaaacccctaaattcccgtaaacgggaccgtaacgggtacccgtagggtaacgtaaccgtacgtaaacgttacttttacggacgtaaacttacgttaacttaacgtacgtactaacgtctaagtccgttacgaacgtaacgtcgaccctaccgtactaacttaaccgtacgttttacgggaccgtaacggggaacctaacggtccgttaggaactacgtaacggaacgtaacggaacgttaggtacggtacgttacggtaccgtaccggtacgttaccggtacgttaccgg

SEQ ID NO: 37842 - DNA, 742 bp, Homo sapiens
  misc_feature: GYAE6OF02HZOOH.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtctttgtctccgaggggagagagccaccctctcctgcagggccagccggagtgttagtaagtacttaggctggtaccaacgagaaacctggccaggcctcccgaggcctcctcatctaatgattgtcctaccaacgtacgggttaccacgtcgggcccgtcccccggcgtacgggtttcaggttcgggacgtaggttgggggtccgtggggaacctagtaccgtttccaacgttcctaccacccgtacaacggccacgtaccctaggacgtccctaggtaagttacgtttttcggtacggttttaactacgttgtacagtcctaggtccgtttcccgccgttcgggtcccgtaccgtttaaccgggtttccgggggaccggggggtaaccgtagggggtacggaagggtaacggggaacggtaaccgggtaacgttggggtcggtaccgtacggacctaccgtacgttccgttcggtttaccctttaccgtaacgtttccccgtttacccccggtacccttagttacccggtaagtaaacccttaggttaccggttagttaccggg

SEQ ID NO: 37843 - DNA, 458 bp, Homo sapiens
  misc_feature: GYAE6OF02FX1D2.24.4.A04.1.454.CMB.1.raw
  modified_base (448)..(458): a, c, t, g, unknown or other
  misc_feature (448)..(458): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtgaggggccgattcaccgtctccccgagacaataccaagaacatggtctatctgcagatggacagcctgcgcactgaggacacagctgtctattactgtgcgcgatcagaagtggcgggaacctggggctactcctttgactcctgggccaggggaccctggtcgccgtctcctccgcctccaccaagggcccatcggtcttccccctggcgccctgctcccagggacgcacctccgagagcacagcggccctgggctgcctggtcaaggactacttccacatagtagtctgagcgggctggcaaggcgcatagnnnnnnnnnnn

SEQ ID NO: 37844 - DNA, 680 bp, Homo sapiens
  misc_feature: GYAE6OF02JV3OF.24.4.A04.1.454.CMB.1.raw
  modified_base (375)..(375): a, c, t, g, unknown or other
  misc_feature (375)..(375): n is a, c, g, or t
  modified_base (402)..(402): a, c, t, g, unknown or other
  misc_feature (402)..(402): n is a, c, g, or t
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccgaggggacacagccatcctctcctgccgagggccagtcagcctctcgtccaacccttagccttggttaccaaacaaacgccgtacggccagccctccacgtactccgtcactctatcgtactaccactaaccggaaacggccgcgtcggccgtcccgagccgacggttccgcgtggctaggtcggtcncgggacagtaccttcgactcacacctntaccagaccgtacgccgtaggaacgtaccgttagtaaacgtttatttacggacttaaagttacggttaacttaaccgtggtaacacggtactacggtcgtaacgaaccgtacgttccggaccttaccgaacgttacctaacgtttacgttcgggaaccggtacggtaacctacggtaacgtacgggtactaagtaccggaaacggtaccgtaaggttccggtacggtcccgttaacgaccctaacccgttagttaccctttacggttcccttaaccgg

SEQ ID NO: 37845 - DNA, 765 bp, Homo sapiens
  misc_feature: GYAE6OF02IQXQI.24.4.A04.1.454.CMB.1.raw
  modified_base (168)..(168): a, c, t, g, unknown or other
  misc_feature (168)..(168): n is a, c, g, or t
  modified_base (353)..(353): a, c, t, g, unknown or other
  misc_feature (353)..(353): n is a, c, g, or t
tcagactactatgtcacgaccggtgctcgatttagagtagtgatcaggggacggaacgtgctcagttaggaccagagggaaccgatggaagcccagctcagcttctcttcctcctgctactctgctccagagaccgcggagagtgtgttgtcgcacgtcccgaggccncccgtgtcgttgtctccgaggggtcacaggccatccgtactcctgcagggtccagtcacgtcctcgtcgtccaacccttagccttcggttaccaacgtaaacgccttcggacccagtccctccgaaccgtacgttacgccgtattccgtaacgtgaacctacgtacgtaaccgaaaagggccccngttaccgccgttaccgagtcccgtacggttcacgtcggtacgaggttcgggtcacgggaccaggtacttcacgttcacgtaccgtactcgactacgtaccgcctagggaccgtaacgttacgtaaacggtttcgttttacgggtccggttttaaccgttacgttacggtacgtaacgtcgttacggttacccggtttccccgtccggttccgggtacccgttaccggtttaaaccgggtttccgggggtaccgggggtaacccggtagggggttaccgggagggtaaccgggtaacggtaaccggtaaacggttcggttaccggtcggtacgaccgtaccgtaagttccggttgtaccgtttcgtacgttacccgtttccgaccgtaccttacgttacggaactttaaccgg

SEQ ID NO: 37846 - DNA, 550 bp, Homo sapiens
  misc_feature: GYAE6OF02FKNFY.24.4.A04.1.454.CMB.1.raw
  modified_base (368)..(368): a, c, t, g, unknown or other
  misc_feature (368)..(368): n is a, c, g, or t
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtccaaccccttagcctggttccaacaaaagcctggccagcctccacgactcgtcatctatgatacataccgaaaagggccgacgtggccgtcccagccaggttcgctggcaggtggtctgggacagtacttcactcncgaccatcagcagccctggacgacgtgaagttattttacgactaattgttaattacgtgtcagcagcgtagactaacgtcgccctccattactacgtactttcgaccgtacgggaccaacgtcgtgacatcgaacgacgaacgttcgacgtcgtacgccgacctagtcgttcgtctttaccg

SEQ ID NO: 37847 - DNA, 526 bp, Homo sapiens
  misc_feature: GYAE6OF02F60HL.24.4.A04.1.454.CMB.1.raw
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (502)..(502): a, c, t, g, unknown or other
  misc_feature (502)..(502): n is a, c, g, or t
  modified_base (505)..(526): a, c, t, g, unknown or other
  misc_feature (505)..(526): n is a, c, g, or t
tcagactactatgtcacgaccggtgctcgatttagagtagtgatcagggggggtccgccagtctccaggcggcggtctgcaatgggtggcagttgtctcttatgatggctttcacacctactatgcaacgccagtgaggggccattcaccgtctcccgagacaataccaagaacatggtctatctgcagatggacagcctgcgcactgagacacagctgtctattactggtgcacgatcagaagtggcgggaaccgtggggactactctttgacgtccgtggggccaggggaccctggtccgccgttctcctccgcctccaccgaaggccccatccggtccttccccgnggccgcccgtgcctccagggcnccgacctcgagacncacgacgcggcccgtgggcctgccgtaggtaccgaaggtaccttaccgttaccacgtacgtagttacggtcgtaggacgtccggggtctcgggacgtaaacgggcgtacagtacggnagnnnnnnnnnnnnnnnnnnnnnn

SEQ ID NO: 37848 - DNA, 466 bp, Homo sapiens
  misc_feature: GYAE6OF02FSZVX.24.4.A04.1.454.CMB.1.raw
  modified_base (455)..(466): a, c, t, g, unknown or other
  misc_feature (455)..(466): n is a, c, g, or t
tcagactactatgtcacgaccggtgctcgatttagagtagtgatcagggggggtccgccagtctccaggcggcggtctgcaatgggtggcagttgtctcttatgatggctttcacacctactatgcaacgccagtgaggggccgattcaccgtctcccgagacaataccaagaacatggtctatctgcagatggacagcctgcgcactgaggacacagctgtctattactgtgcgcgatcagaagtggcgggaacctggggctactcctttgactcctgggccaggggaccctggcgccgtctcctccgcctccaccaagggcccatcggtcttcccccgtggccgccctgctccagggacgcacctccgagacgcacacgcggcccgtgggctcggcctgggtcaaggacctacttccacatagtagtctgcgcgggctggctaaggcgcatgnnnnnnnnnnnn

SEQ ID NO: 37849 - DNA, 822 bp, Homo sapiens
  misc_feature: GYAE6OF02JWCH9.24.4.A04.1.454.CMB.1.raw
  modified_base (159)..(159): a, c, t, g, unknown or other
  misc_feature (159)..(159): n is a, c, g, or t
  modified_base (220)..(220): a, c, t, g, unknown or other
  misc_feature (220)..(220): n is a, c, g, or t
  modified_base (769)..(769): a, c, t, g, unknown or other
  misc_feature (769)..(769): n is a, c, g, or t
  modified_base (778)..(778): a, c, t, g, unknown or other
  misc_feature (778)..(778): n is a, c, g, or t
  modified_base (789)..(789): a, c, t, g, unknown or other
  misc_feature (789)..(789): n is a, c, g, or t
  modified_base (797)..(797): a, c, t, g, unknown or other
  misc_feature (797)..(797): n is a, c, g, or t
  modified_base (802)..(802): a, c, t, g, unknown or other
  misc_feature (802)..(802): n is a, c, g, or t
  modified_base (805)..(805): a, c, t, g, unknown or other
  misc_feature (805)..(805): n is a, c, g, or t
  modified_base (807)..(807): a, c, t, g, unknown or other
  misc_feature (807)..(807): n is a, c, g, or t
  modified_base (812)..(812): a, c, t, g, unknown or other
  misc_feature (812)..(812): n is a, c, g, or t
  modified_base (815)..(816): a, c, t, g, unknown or other
  misc_feature (815)..(816): n is a, c, g, or t
  modified_base (820)..(821): a, c, t, g, unknown or other
  misc_feature (820)..(821): n is a, c, g, or t
tcagactactatgtcacgaccggtgctcgatttagagtagtgatcagggggtccgccagtctccaggcggcggtctgcaatgggtggcagttgtctcttatgatggcttttacacacctactatgcaacgccagtgagggccattcaccgtctcccganaccaataccaagacatggtactatctgcagatggacagcctgaccgcacgtggagaccacnggtcttggtacttaactttcgtggcgaccgtccgaattccgaaggtaacggttcggggaccgggtaaaccgttcgggggtacccttaaccggtttcccgtttttacggtaacccgttccccggttaccgggggaccccggtaaccggggggttaacccccgttcgggtcccggtccccggttcccgttccccggttaccccgtcccgtacccccgtaacccgaaaccgggggtcccctaaccggtttccccggggttaacccctttcccccccggttacggggccccgtccccgttccggtaccccgttaccccggacggggtaacccgtccgtaaaccccgttccgggaacgtacccggacctaacccggaaccgggtcccgggtccccgttacggggccgttccggtaccccggttacgggtaccgtaaaccgggtaacccgtttaccgttaaccccgtacgtaacgttaacggttaccgtcgttaaccggtacgggacccgggtgtttaccggggaccgtaacggtacccgtacgtaacgtaacgngtaaccgtnacgttacgctncggtaccngcgcngcncngtacncgnncgcnnc

SEQ ID NO: 37850 - DNA, 660 bp, Homo sapiens
  misc_feature: GYAE6OF02I3PGE.24.4.A04.1.454.CMB.1.raw
  modified_base (383)..(383): a, c, t, g, unknown or other
  misc_feature (383)..(383): n is a, c, g, or t
  modified_base (489)..(489): a, c, t, g, unknown or other
  misc_feature (489)..(489): n is a, c, g, or t
tcagactactatgtcacgaccggtgctcgatttagagtagtgatcaggggggaggaactgctcagttaggacccagagggaaccatggaagccccagctcagcttctcttcctcctgctactctggctcccagagaccgcctgagaaggtgtgttgtcgcagtccccaggcaccctgtcgttgtctccaggggacacagccatcctctcctgcagggccagtcacgcctctcgtacctaaccccttagcctcggttaccaaacgaaaaacgcctggaccacgccctccaacgtactcgtcatctatgactaacactaccgaaaacgggccgacgtcggaccgtacccgacgacctacggttcgcgtcggctaggtggggtcgngggtaacgaacgtacttcactctacaccactacacgtcacgccgtagggacgtaacgtacgaaagttacgttttcgactaaagtagttacttacgtagtcgaacgntacgggcgtacgaccaacggttcgacccttacctaacttacttaaccgttacgtttacggacccggaagggaaccctaagtaccgtaggaacctacgttacgaacggtaaccgtaacgttacggtgggtaccgttacgaaccctaacccgtaacgttacgttcgtttaccc

SEQ ID NO: 37851 - DNA, 622 bp, Homo sapiens
  misc_feature: GYAE6OF02FUBKL.24.4.A04.1.454.CMB.1.raw
  modified_base (331)..(331): a, c, t, g, unknown or other
  misc_feature (331)..(331): n is a, c, g, or t
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaacccttagcctggttccaacaaaagcctggccagcctccacgactcgtcatctatgatacataccgaaaagggccgctggcgtcccagccaggttcnctggcaggtgggtctgggacaggtacttcactctcacatcagcagcctaggagactagaagtattttgactaaagttcgttaattacgtgtactagtcgagtcggtacgacgtaacctcgggtacccttacccgattactaaccgttaccgtttttacgggaccgtaacggggtaaccctaacggtaccgtacgggacctaacgtccgtaaacggtaacgtaaaccggttaggttacgggtaccttacgacccgtaacccgtacttaccgttaccggtttccttaacccgg

SEQ ID NO: 37852 - DNA, 624 bp, Homo sapiens
  misc_feature: GYAE6OF02IZKFU.24.4.A04.1.454.CMB.1.raw
  modified_base (350)..(350): a, c, t, g, unknown or other
  misc_feature (350)..(350): n is a, c, g, or t
  modified_base (583)..(583): a, c, t, g, unknown or other
  misc_feature (583)..(583): n is a, c, g, or t
  modified_base (592)..(592): a, c, t, g, unknown or other
  misc_feature (592)..(592): n is a, c, g, or t
  modified_base (596)..(596): a, c, t, g, unknown or other
  misc_feature (596)..(596): n is a, c, g, or t
  modified_base (602)..(603): a, c, t, g, unknown or other
  misc_feature (602)..(603): n is a, c, g, or t
  modified_base (605)..(605): a, c, t, g, unknown or other
  misc_feature (605)..(605): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (618)..(618): a, c, t, g, unknown or other
  misc_feature (618)..(618): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
tcagactactatgtcacgaccggtgctcgatttagagtagtgatcaggggggtccgccagtctccaggcggcggtctgcaatgggtggcagttgtctcttatgatggctttcacacctactatgcaacgccagtggaggggccgattcaccgtctcccgagacaataccaagaacatggtctatctgcagatggacagcctgcgcactgaggacacagctgtctattactgtgcgcgatcgaagtaagtgggacgggaacgtgggctactctttgcctcgtgggccgaggggccctggtcgccgtctccctccgcctccaccgacggcccacgttccggtccttccccgnggccgtcccgtcgcctccgacggacgacctacccgtaccggagcggaccacgacggcccgggtcccgtcgggtccgtcggtcccgttcgggtaacgaaacggtaacccttacccgttaccctaacgtaacgttaacggttacgttacggttagggaccgggtaccgggggtacctaccggggaacggtaaaccggggtccgtaaaccggtaaagttacggcctagttaccggngcgcgacgngcgngtacgnngncgcgngcngtagngcgntn

SEQ ID NO: 37853 - DNA, 602 bp, Homo sapiens
  misc_feature: GYAE6OF02F4NP3.24.4.A04.1.454.CMB.1.raw
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
tcagactactatgtcacgaccggtgctcgatttagagtagtgatcaggggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtccaaccccttagcctggttaccaaacaaaagcctcggccagcctccacgactcgtcatctatgatacataccaaaaggccgctggcgtccagccaggtcgctggcagtgggctggacagacttcactcncacatcancagcctggagactagtaagtattttgacgtaatgttaattacgtagtcagtacgagtcgtacgaacaccgtacggacccttaccgaacttaacgtaaccttaccgtttttcggaccgtaaacggggtaccaaacggtcctaagggtaccaacgttacgaaacggaaccgtaaacggttcggttacggaccgttcgacctaacccgtagttaccgttacgttaccctttaacg

SEQ ID NO: 37854 - DNA, 789 bp, Homo sapiens
  misc_feature: GYAE6OF02IDHWZ.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtctaaccctgacctcggttcaacaaacgctcggccagcccgtaccacgtactcgtacatactatgactaccataaccgtaaaagggcccgtcgtcggcccgttccccaaggtcccgtacggtttccggaccgttcgggtaccgtaagggtcgggttcgtaggggaacctacggttaccttaccgtaacccgtttcctaaccgaaccctagttaccgaacggacctaacggcccggtttagggaacgtaccgtaggtaaacggttaattttcgacctaaattacggttaacttacgttgtacgtacgcgtaacgtcggtaccgtaacgtaaacgtcccggtaacccttacccgtaaactttaaccgtaaccgttttaacccggttttacgggtaaccccgaacgggggtaaacccgttaacggtacccggttaaccgggtaccgtaacgttaccgggtaaacccggttaaccggaaaaccggtttcggttaaccgggtacccgttccggaacgtttaccccgtaacgtttccgttaccggtttaacccttttaacccgg

SEQ ID NO: 37855 - DNA, 728 bp, Homo sapiens
  misc_feature: GYAE6OF02GTI1Q.24.4.A04.1.454.CMB.1.raw
tcagactactatgtcacgaccggtgctcgatttagagtagtgatcagggggaggaactgctcagttaggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctccgtccaaccccttagccgttcggttacccaaacaaaacgcctcggccacgccctccacgactcgtcatctatgatacataccgaaacgggccgacgtggccgtcccgacgccgtacgggttccgcgtcggcgtagggtcgggtcgtgggaccaggtaccttcacttctaccacctacgtccacgccacggtccgtagggacgaccgtagtaacgtagtttttaggaacttaagttacgtttacgtttacttacggttaccgaggtacgtacgggttacgtaaccggtaacgtaaccgttaccgggtaccccttaacccgtaacgtttaaccttaaccgtttacccggttttaccgggaaccccgggttaaacgggggtaaacccgtaaacgggtccgtaacgggtacctaacggttaccgaaacggtaaccgttaacggttcggtaccggtcgaccggttaccgaacccgttagttccgtttcgttaccctttacccg

SEQ ID NO: 37856 - DNA, 646 bp, Homo sapiens
  misc_feature: GYAE6OF02IUWGT.24.4.A04.1.454.CMB.1.raw
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (613)..(613): a, c, t, g, unknown or other
  misc_feature (613)..(613): n is a, c, g, or t
  modified_base (617)..(620): a, c, t, g, unknown or other
  misc_feature (617)..(620): n is a, c, g, or t
  modified_base (624)..(624): a, c, t, g, unknown or other
  misc_feature (624)..(624): n is a, c, g, or t
  modified_base (632)..(632): a, c, t, g, unknown or other
  misc_feature (632)..(632): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (640)..(640): a, c, t, g, unknown or other
  misc_feature (640)..(640): n is a, c, g, or t
  modified_base (643)..(643): a, c, t, g, unknown or other
  misc_feature (643)..(643): n is a, c, g, or t
  modified_base (645)..(646): a, c, t, g, unknown or other
  misc_feature (645)..(646): n is a, c, g, or t
tcagactactatgtcacgaccggtgctcgatttagagtagtgatcaggggggtccgccagtctccaggcggcggtctgcaatggggtggcagtttgtctcttatgatggcttttcacacctactatgcaacgccagtggaggggccattcaccgtctcccgagacaactaccaagaacntggtctatctgcagtntgacagtcctgccgctacgtgaggtaccaactacggcttgttaccttagttacctggtcgccgtcgacttcgaaggaaggttcggacggggtaaccgtggggaccttaccgttccgttttacgaccgtttcccggtcgggggacccggacgggggttaccccgttgggtcccggaccgttccttccccgtccgtaccctacccgaacccggaacggcccctagttccccggttccctttacccccggtggaccccgccgttcgacccgtcgacggtacgccctaccgccgagcgacacggaccggtccggaccgtggcctcggtccgtacggtaccgaaacggttcctaaccgttcaaccttatacgtcgtacgtggaccgtcgggtaacgcgttaacgacggttcgagtaatcgacnttcnnnncccnagcagcangncngcanacngnn

SEQ ID NO: 37857 - DNA, 529 bp, Homo sapiens
  misc_feature: GYAE6OF01CQPJS.14.66.F11.1.454.CMB.1.raw
  modified_base (325)..(325): a, c, t, g, unknown or other
  misc_feature (325)..(325): n is a, c, g, or t
  modified_base (354)..(354): a, c, t, g, unknown or other
  misc_feature (354)..(354): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttctctgagctgactcaggaccctgctgtgtctgtggccttgggacagacagtcaggatcacatgccaaggagacggcctacggaagctattatgcaagctggtaccagcagaagccaggacaggcccctgtacttgtcatctataggaaaacntccggcctcaggactcccagaccgattcnctggctccaactcaaggaaacacagtcttcctgaccatcacgtgggctacgaggcggaagatgaggctgacttattactgtaactccggacagcagtcgacctaacccaattatgtcttacggaacgtggaccaggtcaccgtcgtacgtcacgacccgaacgcccaaccctacg

SEQ ID NO: 37858 - DNA, 566 bp, Homo sapiens
  misc_feature: GYAE6OF01D9HSC.14.66.F11.1.454.CMB.1.raw
  modified_base (329)..(329): a, c, t, g, unknown or other
  misc_feature (329)..(329): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggaccccctctctggctcgctctcctcactctttgcataggttctgtggtttcttctgagctgactcaggaccctgctgtgtctgtggccttgggacagacagtcaggatcacatgccaaggagaccggcctggaagctattatgcaagctggtaccagcagaagccaggacacggcccctgtacttgtcatctataggtaaaaacntccggcctcagggactcccagaccgattctctcggctaccaactcaaggaaacacagtccttacctgaccatcacgtcgggctacgagggacggaagagtgaggtctagactattacgtgtaacgtcccgggacagcgagtcgacctaacccaattactcgtacttacggaacgtcgggtaaccaacggtccacccgttacgacggtccacgaccccgaacggcccaaccccgtacg

SEQ ID NO: 37859 - DNA, 547 bp, Homo sapiens
  misc_feature: GYAE6OF01AZU9M.14.66.F11.1.454.CMB.1.raw
  modified_base (325)..(325): a, c, t, g, unknown or other
  misc_feature (325)..(325): n is a, c, g, or t
  modified_base (380)..(380): a, c, t, g, unknown or other
  misc_feature (380)..(380): n is a, c, g, or t
  modified_base (451)..(451): a, c, t, g, unknown or other
  misc_feature (451)..(451): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtactgtcatctataggtaaaacntccggccctcgagggactcccagaccgattctctggcctccaactcaaggaaacncagtcttcctgaccatcacgtgggctcgaggacggaagagtgagctgactatacgtgtaacgtcccggganacgcagtcgacctaaccctaattacgtagtccttacggaacgtcgggacaaggtccaccgtcctacggtcacgacccaacggccccaacccgtacg

SEQ ID NO: 37860 - DNA, 562 bp, Homo sapiens
  misc_feature: GYAE6OF01BNGKU.14.66.F11.1.454.CMB.1.raw
  modified_base (245)..(245): a, c, t, g, unknown or other
  misc_feature (245)..(245): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
tcagcgtctagtaccacgaccggtgctcgatttagtcacgcgagagggagcaccgtggagaagacagtggcccctacagaatgttcataggttcccaactctgaccccacccacggggagcctggacccctctctggctcgctctcctcactctttgcataggttctgtggtttcttctgagctgactcaggaccctgctgtgtctgtggccttgggacagacagtcaggatcacatgccaaggngacggcctcggaagctattatgcaagctggtaccagcagaagccaggacaggccctgtacttgtcatctaataggtaaaaacntccggccctnacggggatcccagaccgattctctggctccaactcaaggaacacagccttcctgaccatcactgggctcgaggcgaagngtgagctgactatacgtgtaacgttcccgganagcagtcgtacctaaccccaattactacgttcgttaccggaacgtaccgggacctaagggtcccaccggtaccgtacggtacccacgacccgaaccggccccaacccctaccg

SEQ ID NO: 37861 - DNA, 547 bp, Homo sapiens
  misc_feature: GYAE6OF01CKAEA.14.66.F11.1.454.CMB.1.raw
  modified_base (328)..(328): a, c, t, g, unknown or other
  misc_feature (328)..(328): n is a, c, g, or t
  modified_base (453)..(453): a, c, t, g, unknown or other
  misc_feature (453)..(453): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctaatggtaaaaaacntaccggccctcagggatcccagacccgattctctggctccaaactcaaggaaacacagcttcctgaccatcactgggctcgaaggcggaagagtgaggctgactattactgtaacttcccggganagcagtgactaaccccaattatcgtacttacggaactgggaaccaaaggtccaacccgtcctaggtccaacgacccaaggcccaaacccctacg

SEQ ID NO: 37862 - DNA, 603 bp, Homo sapiens
  misc_feature: GYAE6OF01CDY9D.14.66.F11.1.454.CMB.1.raw
  modified_base (330)..(330): a, c, t, g, unknown or other
  misc_feature (330)..(330): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctggtggccttgggacagacagtcaggatcacatgccaaggagacggcctacggaagctattatgcaagctggtaccagcagaagccaggacacggccctgtacttgtcatctaataggtaaaaacngtaccggccctcgaggactacccagaccgattcgtactggctaccaactcgaaggtaaacacacgtcttaccgtagacctatcacgtggggctacgaggacggaagagtagaggtctagtaactatttaacgtaggttaacgttcccgggacaggactaggtcgactaaccccaattacgtacgttaccgttaggaaccgtacgggaaccgtaacggtccgaccgttaccgtaacggtccaacggacccgaacggtaccccaaccccgtaccg

SEQ ID NO: 37863 - DNA, 551 bp, Homo sapiens
  misc_feature: GYAE6OF01AC8ZY.14.66.F11.1.454.CMB.1.raw
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (445)..(445): a, c, t, g, unknown or other
  misc_feature (445)..(445): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacntccggccctnagggactcccagaccgattcnctggctccaactcagaacacagcttctgaccatcactggggctcgaggacggaagatgaggctgactattactgtaacttcccggganagacagtcgacctaaccctaattatcgttaccttacgggaacgtcgggaacctaaggtccaacccgtccgtacggtaccacgacccaaacggcccaaacccctacg

SEQ ID NO: 37864 - DNA, 535 bp, Homo sapiens
  misc_feature: GYAE6OF01DJ9EE.14.66.F11.1.454.CMB.1.raw
  modified_base (328)..(328): a, c, t, g, unknown or other
  misc_feature (328)..(328): n is a, c, g, or t
  modified_base (449)..(449): a, c, t, g, unknown or other
  misc_feature (449)..(449): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctggaagctattatgcaagctggtaccagcagaagccaggacaggcccctgtacttgtcatctaataggtaaaaaacntcccggccctcagggactcccagaccgattctctggctaccactcaaggaaacacagcttcctgaccatcacgtgggctcgaggcggaagatgagctgactattactgtaacttcccgganacgcagtcgacctacccattagtcgtacttcggaacgtcgggaaccaggtccaccgtcctagtcacgcccgaacgcccaccctacg

SEQ ID NO: 37865 - DNA, 545 bp, Homo sapiens
  misc_feature: GYAE6OF01DTPJ7.14.66.F11.1.454.CMB.1.raw
  modified_base (476)..(476): a, c, t, g, unknown or other
  misc_feature (476)..(476): n is a, c, g, or t
tcagcgtctagtaccacgaccggtgctcgatttagtcacgcgagagggagcaccgtggagaagacagtggcccctacagaatgttcataggttccccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacatccggccctcaggggactcccagaccgattctctggctccaactacaggaaacacagtcttccttgaccatcacgtgggctcgagggcggaagatggagctgactattactgttaacgtcccgggacagcagtcgacctaacccaattntgtccttacggaacgtgggaacctaggtccacccgtctacggtcacggacccacggcccaacccctacg

SEQ ID NO: 37866 - DNA, 544 bp, Homo sapiens
  misc_feature: GYAE6OF01B7SWC.14.66.F11.1.454.CMB.1.raw
  modified_base (327)..(327): a, c, t, g, unknown or other
  misc_feature (327)..(327): n is a, c, g, or t
  modified_base (453)..(453): a, c, t, g, unknown or other
  misc_feature (453)..(453): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctataggtaaaaacntccggccctcgagggactcccagaccgattctctggctccaactcaaggaaacacagcttcctgaccatcacgtggggctcgaggcggaagagtgaggctgactattactgtaacgttcccggganacgcagtcgacctaacccaattactcgttctacggaacgtcgggaccaaggtccaccgtccgtaggtccacgacccacggcccaccctacg

SEQ ID NO: 37867 - DNA, 519 bp, Homo sapiens
  misc_feature: GYAE6OF01AQ0X2.14.66.F11.1.454.CMB.1.raw
  modified_base (324)..(324): a, c, t, g, unknown or other
  misc_feature (324)..(324): n is a, c, g, or t
  modified_base (373)..(373): a, c, t, g, unknown or other
  misc_feature (373)..(373): n is a, c, g, or t
  modified_base (442)..(442): a, c, t, g, unknown or other
  misc_feature (442)..(442): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctatatgcaagctggtaccagcagaagccaggacaggcccctgtacttgtcatctatggtaaaacntccggcctcagggactcccagaccgattctctggctcaactcaggaacncagcttcctgaccatcacgtgggctcgaggcgaagatgaggctgactattacgtgtaagttcccggganagcagttgacctaacccattactgtcttcggaacgtggaccaaggtcaccgtctaggtcagccacggccaaccctac

SEQ ID NO: 37868 - DNA, 550 bp, Homo sapiens
  misc_feature: GYAE6OF01B41BS.14.66.F11.1.454.CMB.1.raw
  modified_base (328)..(328): a, c, t, g, unknown or other
  misc_feature (328)..(328): n is a, c, g, or t
  modified_base (453)..(453): a, c, t, g, unknown or other
  misc_feature (453)..(453): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctcttgctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacacggcccctgtacttgtcatctataggtaaaaacntccggccctcagggactcccagaccgattctctggctccaactcaaggaaacacagcttcctgaccatcacgtgggctcgaggcggaagatggagctagacttattactgtaacgttcccggganacgtcagtcgacctaacccaattactgtccttacgggaactcgggaccaacggtccaccgtccgtaggtccacgacccgaacggcccaacccgtacg

SEQ ID NO: 37869 - DNA, 564 bp, Homo sapiens
  misc_feature: GYAE6OF01C65TV.14.66.F11.1.454.CMB.1.raw
  modified_base (323)..(323): a, c, t, g, unknown or other
  misc_feature (323)..(323): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttctctgagctgactcaggaccctgctgtgtctgtggccttgggacagacagtcaggatcacatgccaaggagacggcctggaagctattatgcaagctggtaccagcagagccaggacaggccctgtacttgtcatctataggtaaaaacnctccggccctcgacgggactcccgagaccgattcctctcggctccaactcaaggaaacacagtcttcctgaccatcacgtggggctcgaggcggaagagtggaggctagaacttattacgtagtaacgttcccgggacagcacgtcgacctaaccctaattactcgtaccgttacggaacgtcgggaacctaaggtccaccggttcctacggtccacgacccaaacggcccaacccctacg

SEQ ID NO: 37870 - DNA, 552 bp, Homo sapiens
  misc_feature: GYAE6OF01CLWYC.14.66.F11.1.454.CMB.1.raw
  modified_base (327)..(327): a, c, t, g, unknown or other
  misc_feature (327)..(327): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctactgtgtctgtggccttgggacagacagtcaggatcacatgccaaggagacggcctcggaagctattatgcaagctggtaccagcagaagccaggacaggcccctgtacttgtcatctataggtaaaaacntccggcctcgagggactcccagaccgattctctggcctccaactcaaggaaacacagtccttccttcgaacctatcacgtgggggcctcgagggacggaagatgaggctagacttattactagtaacttcccgggacagacagtacgacctaacccattatgtcttacggaactgggacctaaggtccaccgtcctaggcacgacccaagccccaaccctctacg

SEQ ID NO: 37871 - DNA, 568 bp, Homo sapiens
  misc_feature: GYAE6OF01EFB2P.14.66.F11.1.454.CMB.1.raw
  modified_base (329)..(329): a, c, t, g, unknown or other
  misc_feature (329)..(329): n is a, c, g, or t
  modified_base (425)..(425): a, c, t, g, unknown or other
  misc_feature (425)..(425): n is a, c, g, or t
  modified_base (463)..(463): a, c, t, g, unknown or other
  misc_feature (463)..(463): n is a, c, g, or t
tcagcgtctagtaccacgaccggtgctcgatttagtcacgcgagagggagcaccgtggagaagacagtggcccctacagaatgttcataggttcccaactctgaccccacccacggggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacacggcccctgtacttgtcatctataggtaaaaacntccggccctcgagggactcccagaccgtattctctggcctccaactcaaggaaacacacgtcttccttgaccatcacgtgggctcgaggcggaagntggacgtctagacttattacgtgtaacgtcccgggaangctagtcgtacctaaccctaattactgttaccgtacggtacgtacgggaccgaacggtccaccgtccgtaggtccaacgaccccgaacggcccaaccccgtaccg

SEQ ID NO: 37872 - DNA, 759 bp, Homo sapiens
  misc_feature: GYAE6OF01DUJ56.14.66.F11.1.454.CMB.1.raw
  modified_base (77)..(77): a, c, t, g, unknown or other
  misc_feature (77)..(77): n is a, c, g, or t
tcagcgtctagtaccacgaccggtgctcgatttagtcacgcgagagggagcaccgtggagaagacagtggcccctanagaatgttcataggttccccaactctcgaccccacccacggggagcctggacccctctctggctcgctcctcctcactcttgcataggttctgttggtttcttctgagctgactcaggaccctgctgtgtctggtcggccttgggacagacagtcaggatcacatgaccaaggagaccggcctaggaagtctattagtgacgaagtcgtaggtaccagacgaaggaacgaccgaaggaccgaccggtaccccttaggtacctttgtacctacgtaccttaagtaacggtaaaaacctccgtaccccggtaccctacggaacgggtaacctaccccgaacggtacccgtattccgtcgtcggtaccctacccgaacgtacgaacggaaacctaccgtaacgtcctttaccgtaacgtaacccgaacgtaccggtaacgggttcggaccgtacggaacgggtaacgaagtacggaggaccgtacgtaacgttaacgtttaagttaaccgttaccggttaaccgggtacccgaggttaccgacgttaaccgtactaaccccttaactaacgtttacgttccgttaccggtaacggtaaccggtacggtaaacctaccgggtacccttacccgggtacgttacccggacgacccggaaccccaccccgtaaccctacccgtaaccg

SEQ ID NO: 37873 - DNA, 675 bp, Homo sapiens
  misc_feature: GYAE6OF01CPFPY.14.66.F11.1.454.CMB.1.raw
  modified_base (333)..(333): a, c, t, g, unknown or other
  misc_feature (333)..(333): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgaccaagggacgaccggcctacggaagctaattatgacaagctagtaccagcagaagccaggacacgccctgtactgtcatctaataggtaaaaacncgtacccggacctacgacggtactacccgaagacccgtattcctcgtggacctacccaactacgaacggaaaccacgaacgtcctttaccttacgaaccctacgtaccgtacgttacggggcctacggaacgggaccggaaagagtacggaacggtccgtagtaaccgtttagtttacgtacggtttaaacggtacccgggaagacgtcgtaacgttaccgtaaccctaacccgtaagttacgttacgttaccgttacgggtaaccgtcgggaaccgtaacggtcccgtaccggtaccgtacggtaccaaccgtacccgaaccgaccccgtaacccgtaccg

SEQ ID NO: 37874 - DNA, 557 bp, Homo sapiens
  misc_feature: GYAE6OF01C6M73.14.66.F11.1.454.CMB.1.raw
  modified_base (328)..(328): a, c, t, g, unknown or other
  misc_feature (328)..(328): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaagggagacggcctcggaagctattatgcaagctggtaccagcagaagccaggacaggcccctgtacttgtcatctataggtaaaaacntccggccctgacggactcccagaccgattctctggctccaactcaaggaacacagtcttcctagaccatcacgtgggctcgaggcggagagtgacgctagactattacgtgtaacgttcccggacagcagtcgacctaccctaattacgtcgtccgttacggaacgtcgggaacctaacgggtcacccgtacgtacggtccgaacgacccaacggccccaacccgtacg

SEQ ID NO: 37875 - DNA, 539 bp, Homo sapiens
  misc_feature: GYAE6OF01BEHWA.14.66.F11.1.454.CMB.1.raw
  modified_base (327)..(327): a, c, t, g, unknown or other
  misc_feature (327)..(327): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctataggtaaaaacntccggcctcgagggactcccagaccgattctctggctccaactcgaaggaaacacagtcttccttgaccatcacgtcgggctcgaggcgaagatgagctgactattactagtaactacccgggacagcagtgacctaacccattactgtcttacggaacgtcgggacctaaggtcaccgtcgtaggtcacgacccaacgcccaacccgtacg

SEQ ID NO: 37876 - DNA, 687 bp, Homo sapiens
  misc_feature: GYAE6OF01AWI6K.14.66.F11.1.454.CMB.1.raw
  modified_base (327)..(327): a, c, t, g, unknown or other
  misc_feature (327)..(327): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctactgtgtctgtggccttgggacagacagtcaggatcacatgccaaggagacggcctcggaagctattatgcaagctggtaccagcagaagccaggacacggcccctgtacttgtcatctataggtaaaacnctcccggccctacgagggactcccgaacgaccgtattctcgtcggcctaccaactacgaacggaaaccacagtccttaccgtacgacctactccgacgttggtcgcgtacgacgggtacggaacgtagtcgggacggtcgtacgtaacttaacgttaccgttacggttaaccggttaccccgggaactacggtaccgtaacggttaccgtaacccgtttaaaccccgtaagtttaccggttacgtttacccgttaccgggtaaccgttacggggtaaccctaacgggttaccctacccggttaccgtaacgggtacccaaccggaacccccgaaaccggtcccccgaaaccccgttaccg

SEQ ID NO: 37877 - DNA, 669 bp, Homo sapiens
  misc_feature: GYAE6OF01C26VS.14.66.F11.1.454.CMB.1.raw
  modified_base (338)..(338): a, c, t, g, unknown or other
  misc_feature (338)..(338): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatcgaccaaagggacgacggcctacggaagcttattatgacaagtctggtaccagcagaacgcgaggacacggccctgtactgtcatactaatacggtaaaacncgtaccgcctcgacggactacccgacgtaccgtattctcgtcggcctaccactacgaacggaaacacacgtccttaccgtacgacctactacgaacggtcgggtacctacggaaggggtacggaacgtagtacggacggctagtaacttagtttaaccgttacggttaaacggttcccgggaacgtacgtacgtaacgtaccgtaaccctaacccgtaagtttacgttcggttaccgttaccggaacgtaccggggaaccctaacggttcccgtacccggttacctacgggtaccaaccggtacccgaaacccggccctaaaccccgtacg

SEQ ID NO: 37878 - DNA, 724 bp, Homo sapiens
  misc_feature: GYAE6OF01DJ8IU.14.66.F11.1.454.CMB.1.raw
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
tcagcgtctagtaccacgaccggtgctcgatttagtcacgcgagagggagccaccgtggagaagacagtcggcccctacagaatgttcatacggttcccaactctcgaccccacccgacgggagcctcggacccctctctggctcgctcctcctcactctttgcattaggttctgttggtttcttctgagctgactcgacggaccctgctgtgtctggtggccttgggacagacagtcaggatcacatcgaccgaaaggacgaccggccgtaggaagtctaattagtgacaagtcgtacggtaccagacaagaacgaccgaaggaccgacggtcccctagtacttgtcatactaataacggtaaaacncgtccgtacctacgacggacctaccagacctnttctctcggcctaccactacgaagaaaccacgacgtccttcctacgacctactacgtacggtcggggtcctacggaacgggtacggaagtagtagggacgtacttacggtaactttaacgtttaccgttacggttaaaccgttaccccgggaacgtacggtaccgtaacggttacgtaaccccttaaacccctaagtttaccgtcggttaccgtttaaccgggtaaacggttaccgggtaaacccgttaaacggttcccgttaacccggtcgttaacggtaccgtaacccggaccccgaaacccggaccccaaccccgtaaccg

SEQ ID NO: 37879 - DNA, 581 bp, Homo sapiens
  misc_feature: GYAE6OF01BHEWY.14.66.F11.1.454.CMB.1.raw
  modified_base (327)..(327): a, c, t, g, unknown or other
  misc_feature (327)..(327): n is a, c, g, or t
  modified_base (484)..(484): a, c, t, g, unknown or other
  misc_feature (484)..(484): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctggaagctattatgcaagctggtaccagcagaagccaggacacggcccctgtacttgtcatctataggtaaaaacntcccggccctacgagggactcccagaccgtattctcgtggcctaccaactacgaaggaaaccacacgtccttccttacgaccatccgaacgtcggggactcgaagggaccgaagagtgaggtctagaacttattacgttagtaacgttcccgggaanacgtctagtcgacctaaccctaattatcgtcgttacggaacgtcggaacacggtccaccgtaccgtacggtacacgacccaacgcccaacccgtacg

SEQ ID NO: 37880 - DNA, 549 bp, Homo sapiens
  misc_feature: GYAE6OF01BBZ0J.14.66.F11.1.454.CMB.1.raw
  modified_base (329)..(329): a, c, t, g, unknown or other
  misc_feature (329)..(329): n is a, c, g, or t
  modified_base (460)..(460): a, c, t, g, unknown or other
  misc_feature (460)..(460): n is a, c, g, or t
tcagcgtctagtaccacgaccggtgctcgatttagtcacgcgagagggagcaccgtggagaagacagtggcccctacagaatgttcataggttcccaaactctgaccccacccacggggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctataggtaaaaacntccggcctcagggactccccagacccgattcctctggctccaactcaaggaaacacagccttcctgacctatccacgtgggctcgaggcggaagagtgaggctagactattactgtaacgttcccgggacngacagtcgacctaacccaattactcgttctacggaacgtcgggaacaggtccaccgtcctagtccacgacccaacggcccaacccgtac

SEQ ID NO: 37881 - DNA, 727 bp, Homo sapiens
  misc_feature: GYAE6OF01AFJ0E.14.66.F11.1.454.CMB.1.raw
  modified_base (259)..(259): a, c, t, g, unknown or other
  misc_feature (259)..(259): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatcgccaaggagacggcctcggaanctattatgcaagctggtaccagcagaagccaggacacggccctgtacttgtacatctagtaggtaaaaacacgtccgccctacgacggggtactccccgagacccgtattcctcgtcggtcctacccgaactcgaaacggaaaccacacgtcctttccgttacgaccctacgttcacggttacggggcttaccggagggacggaagtagtggacggcttacggaactttagttaaccgttaggttaaccgtttaccccggggaactacggtaccgtaacggttaccgtaacccctttaaacccccgtaaagtttaaccgttggttacccgttaaccggggtaaacccgttacgggggtaaaccccgtaaccgggttcccggtaaacccggttacccggtttaaccgggtacccgttaacccggaaccccggtaaacccgggtaaccccccaaaccccccggttaccgg

SEQ ID NO: 37882 - DNA, 552 bp, Homo sapiens
  misc_feature: GYAE6OF01BTXHZ.14.66.F11.1.454.CMB.1.raw
  modified_base (325)..(325): a, c, t, g, unknown or other
  misc_feature (325)..(325): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctggaagctattatgcaagctggtaccagcagaagccaggacaggcccctgtacttgtcatctatggtaaaaacntccggccctcgagggactcccgagaccgattctctggctaccaactcaaggaaacacagccttccttgacccatcacgtggggcctcgaggccggaagagtgaggctgactattactgtaacgttcccgggacagcgagtcgacctaacccaattactgtccttacggaacgtcgggaccaaggtccaccgtcctaggtccacgacccaacggcccaaccccgtacg

SEQ ID NO: 37883 - DNA, 579 bp, Homo sapiens
  misc_feature: GYAE6OF01AHGLH.14.66.F11.1.454.CMB.1.raw
  modified_base (482)..(482): a, c, t, g, unknown or other
  misc_feature (482)..(482): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccgaggacaggcccctgtacttgtcatctataggtaaaaacatccggccctcgagggactcccgagaccgattctctggcctccaactcgaaggaaaccacgacgtcctttccgttcgaaccctatccgacgttggggcctacgacgggacggaagagtggaggctgacttattactagttaaccgttcccggganagcacgtcgacctaacctattactcgtacgtacggacgtcgggacctaacggtcctaccgtccgtaggtccacgacccaacggcccaaccccgtacg

SEQ ID NO: 37884 - DNA, 532 bp, Homo sapiens
  misc_feature: GYAE6OF01E4096.14.66.F11.1.454.CMB.1.raw
  modified_base (446)..(446): a, c, t, g, unknown or other
  misc_feature (446)..(446): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggccctgtacttgtcatctatggtaaaaacatccggccctcgagggactcccagaccgattctctggctcaactcaggaaacacagcttcctgaccatcacgtgggctcgaggcggaagatgaggctgactattactgtaacgttccggganagcagtcgacctaacccaattatgtcttacggaacgtgggaaccaaggtccaccgtctaggtcacgacccaacggcccaacccgtc

SEQ ID NO: 37885 - DNA, 615 bp, Homo sapiens
  misc_feature: GYAE6OF01BPXTS.14.66.F11.1.454.CMB.1.raw
  modified_base (333)..(333): a, c, t, g, unknown or other
  misc_feature (333)..(333): n is a, c, g, or t
  modified_base (505)..(505): a, c, t, g, unknown or other
  misc_feature (505)..(505): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatcgaccaagggagacggcctacggaagctattatgacaagctaggtaccagcagaacgccaggacacggccctgtactgtcatactataggtaaaacncgtccgcctacgacggactccgacgaccgtacttctcgtcggcctaccaactacgaacggaaacacgtacgtccttaccgttacgaacctactccgtacggtcgggcctacggacgggacggaagagtcggagtctagtacttaagttacgtacgttaacgttcccgggaanacggtactacgtacgtaaccctaaccctaattacgtcgttacgtaaccggacgtcggaacctaggtccaccgtcgtacgtacaccgacccaaccggccctaacccgtacg

SEQ ID NO: 37886 - DNA, 584 bp, Homo sapiens
  misc_feature: GYAE6OF01ESTHF.14.66.F11.1.454.CMB.1.raw
  modified_base (327)..(327): a, c, t, g, unknown or other
  misc_feature (327)..(327): n is a, c, g, or t
  modified_base (478)..(478): a, c, t, g, unknown or other
  misc_feature (478)..(478): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggaccccctctctggctcgctctcctcactctttgcataggttctgtggtttcttctgagctgactcaggaccctgctgtgtctgtggccttgggacagacagtcaggatcacatgccaaggagaccggcctcggaagctattatgcaagctggtaccagcagaagccaggacacggccctgtacttgcatctataggtaaaacncgtccggcctacgagggtactcccgagacccgtattcgtctcggctacccaactcgaaggaaaccacgacgtccttccttacgacctatacgacgtcgggctacgaggacggaagagtgaggctagacttagtactagtaacgtcccgganacgtcagtcacctaaccctaattacgtacgttccgtacggtacgtcggtacgaacggtccaccgtaccgtacgtaccacgaccccgaacggcccctaacccgtacg

SEQ ID NO: 37887 - DNA, 665 bp, Homo sapiens
  misc_feature: GYAE6OF01CSF1Z.14.66.F11.1.454.CMB.1.raw
  modified_base (327)..(327): a, c, t, g, unknown or other
  misc_feature (327)..(327): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctggaagctattatgcaagctggtaccagcagaagccaggacacggcccctgtacttgtcatctataggtaaaaacntcccggccctcgacggggactccccgaagacccgaatttcctcgtcggccttacccaacctacgaacggaaaccaccgacgtcctttacccgttcgaaccctataccgacgtcggggccttcggaagggaccgggaagagtaggacggtctaggtaaccttaactttaccgttaggttaaaccgtttccccggggaacacggtcgtaacggtcgtaaccccttaacccctaagtttacttcggttaccgttaccgggaaaccgtcgggtaaccgtaacggtccgtacccggttaccgtacgggtacaccggaccccaacggccccaaaccccgtaccg

SEQ ID NO: 37888 - DNA, 577 bp, Homo sapiens
  misc_feature: GYAE6OF01C3UCI.14.66.F11.1.454.CMB.1.raw
  modified_base (327)..(327): a, c, t, g, unknown or other
  misc_feature (327)..(327): n is a, c, g, or t
  modified_base (462)..(462): a, c, t, g, unknown or other
  misc_feature (462)..(462): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtactgtcatctaataggtaaaaacntccggccctcgagggactcccgagaccgtattctctggcctccaactcaaggaaacacagtccttccttacgaccatcacgtgggctcgaggcggaagagtgaggctagactattactgttaacgttcccggganacgtcagtacgacctaaccctaattactcgttccgttacggaaacgtcgggaacctaacggtccgaacccgttccgtaacggtccaacggacccaaacggcccaaccccgtaccg

SEQ ID NO: 37889 - DNA, 577 bp, Homo sapiens
  misc_feature: GYAE6OF01DONO0.14.66.F11.1.454.CMB.1.raw
  modified_base (328)..(328): a, c, t, g, unknown or other
  misc_feature (328)..(328): n is a, c, g, or t
  modified_base (433)..(433): a, c, t, g, unknown or other
  misc_feature (433)..(433): n is a, c, g, or t
tcagcgtctagtaccacgaccggtgctcgatttagtcacgcgagagggagcaccgtggagaagacagtggcccctacagaatgttcataggttccccaactctgaccccacccacggggagcctggacccctctctggctcgctctcctcactctttgcataggttctgtggtttcttctgagctgactcaggaccctgctgtgtctggtggccttgggacagacagtcaggatcacatgaccaaggagacggcctcggaagctattatgcaagctggtaccagcagagccaggacaggccctgtactgtcatctataggtaaaaacnctcccggcctcgaggactcccgagaccgtattctctcggcctaccaactcaacggaaacacacgtccttcctagacccatcacgtggggctacgaggacggaagntaggacggctgacttattacgtgttaacgtccgggacagctagtcgacctaaccctaattacgtcgtaccgttacggaacgtcgggaacctacggtccacccgtccgtaacggtccacggacccaacggtcccgaacccctacg

SEQ ID NO: 37890 - DNA, 624 bp, Homo sapiens
  misc_feature: GYAE6OF01CZLEN.14.66.F11.1.454.CMB.1.raw
  modified_base (275)..(275): a, c, t, g, unknown or other
  misc_feature (275)..(275): n is a, c, g, or t
  modified_base (342)..(342): a, c, t, g, unknown or other
  misc_feature (342)..(342): n is a, c, g, or t
  modified_base (497)..(497): a, c, t, g, unknown or other
  misc_feature (497)..(497): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgttggtttcttctgagctgactcacggaccctgctggtgtctggtggccttgggacagacagtcaggatcacatcgaccaagggacgacggcctacggaagtctattangacaagctacggtaccagacagaacgcaggaccacgccctgtactgtacatctaataacggaaaacncgtaccgcctagacggactaccgagtacctacttctcgtcggacctaccgaactcgaacggaacacgactccttactacgactatccgtagtcgggctacgaggacgaacgtgtacggacgctagtacttattacgtacgttaacgtaccggganagtacgacggtactaacccttacgtaattacgttcgtaccgttacggaacgtcgggtaaccgtacggttacccgtacccgtacgtacggtaccccgaacgacccggaaccacccgtaacccgtaccg

SEQ ID NO: 37891 - DNA, 670 bp, Homo sapiens
  misc_feature: GYAE6OF01APL7G.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatcgccaaggagaccggcctcggaagctattatgcaagctggtaccagcagaacgccaggacacggcccctgtacttgtcatctataggtaaaacactccggcctacgagggactcccgagaccgtattctctcggcctaccgaactacaacggaaaccacacgtcctttacctcgacctacgtacacgtcggggctcgaacgggtacggaagtagtcggacggtctacgtaacgttactttaacgttaacggttaaccgttaccccggggacaacggtaccgtacggtaccgtaaccctaacccctaagtttaccgtcgttaccgttaccgggaaccgttacggggaacccgtaacggttccccgtaaccggttacccgttaacgggtacccgaaccggtaccccgaaaccggtaccccctaacccccgtaccgg

SEQ ID NO: 37892 - DNA, 564 bp, Homo sapiens
  misc_feature: GYAE6OF01AHJ9R.14.66.F11.1.454.CMB.1.raw
  modified_base (323)..(323): a, c, t, g, unknown or other
  misc_feature (323)..(323): n is a, c, g, or t
  modified_base (474)..(474): a, c, t, g, unknown or other
  misc_feature (474)..(474): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggaccagcagagccaggacaggccctgtacttgtcatctataggtaaaacngtccggcctcgagggactccccagaccgattctctggcctaccaactcgaaggaaaccacacgtcctttccttacgaccctatccaccgtggggctacgagggacggaagagtggaggctagacttattactaggtaacgttacccggganagtcagtcgacctaacccgaattcgtgtcgtacggacgtcgggaccaaggtccaccgtcctaggtcacgacccgaacgcccgaaccctcg

SEQ ID NO: 37893 - DNA, 555 bp, Homo sapiens
  misc_feature: GYAE6OF01ALKRI.14.66.F11.1.454.CMB.1.raw
  modified_base (327)..(327): a, c, t, g, unknown or other
  misc_feature (327)..(327): n is a, c, g, or t
  modified_base (420)..(420): a, c, t, g, unknown or other
  misc_feature (420)..(420): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctactgtgtctgtggccttggggacagacagtcaggatcacatgccaaggagacggcctcggaagctattatgcaagctggtaccagcagaagccaggacaggcccctgtacttgcatctataggtaaaaacntccggccctcacgggatcccagaccgtattctctggcctaccaactcaggaaaccacagcttcctgaccatcactggtgctcgaggcggaagntggaggctgacttattactagttaaccgttccgggacagacagtcgacctaacccattctagtccttacgggaaccgtcgggaccaacggtccaccgtcgtacggtccacgacccgaacggcccaaccccgtacg

SEQ ID NO: 37894 - DNA, 688 bp, Homo sapiens
  misc_feature: GYAE6OF01DF44Z.14.66.F11.1.454.CMB.1.raw
  modified_base (329)..(329): a, c, t, g, unknown or other
  misc_feature (329)..(329): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctaggaagctaattatgacaagctggtaccagcaagagccaggacaggcccctgtacttgcatctaataggtaaaaacntcccggcctcgaggactcccagaccgattctcgtcggcctacccaactcaacggaaaaccacgagtcctttaccttacgacctactaccgaacgtcggggacctacggaacgggacggaaacgtagtacggaggtacgtacgtaacttaactttacgtacgttaaaccgttaccccgggaactacggtacgtaacgttcgtaaccctaacccccgttaaagtttaacgttacggttaccgttaccgggtaaaccggtacgggaaacccgtaacgggtacccgtaaccccggtttaccgtaacgggttacccaaccggtaccccggaaaacccggtacccccgtaaacccccgtaacccg

SEQ ID NO: 37895 - DNA, 580 bp, Homo sapiens
  misc_feature: GYAE6OF01DT9LU.14.66.F11.1.454.CMB.1.raw
  modified_base (325)..(325): a, c, t, g, unknown or other
  misc_feature (325)..(325): n is a, c, g, or t
  modified_base (428)..(428): a, c, t, g, unknown or other
  misc_feature (428)..(428): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggaccccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcaagacgcaggacaggccctgtacttgcatctataggtaaaacnctccggcctcgaggactcccagaccgattctctcggcctaccaactcaacggaaacacgacgtccttcctacgacccatcacgtgggctacgaggacggaagntggagctagtacttagttacgtagtaacgttccggaacacgtctagtcgtaccctaaccctaattacgtcgtaccgttacggaacgtacgggaccaacggtcccacccggttacgtacggtccaacggaccccaacggccccaacccgtacg

SEQ ID NO: 37896 - DNA, 784 bp, Homo sapiens
  misc_feature: GYAE6OF01DJ56P.14.66.F11.1.454.CMB.1.raw
  modified_base (272)..(272): a, c, t, g, unknown or other
  misc_feature (272)..(272): n is a, c, g, or t
tcagcgtctagtaccacgaccggtgctcgatttagtcacgcgagagggagcaccggtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgaccgaaaggagaccggcctacggaagctaattangacaagtctaggtaccagacaagaacgccgaggaccgacggtccccgtagtacgttgtcacttctaagtaacggtaaaaacacgtaccccggacccgtacgaacgggcctaccgacgaccgtattctcgtcgctacccactacgaaacggaacacacgtcctttaccttacgacctactccgtaacggtcggggaccttaccgggaagggaccgggtaaaggtagtacgggtaacgggtaccgttacgtaaacctttaacgtttaccggtttaacgggtttaaacccgttaccccgggggaacttaccggaccgttacggttaacccgttaaaccccgtttaaaccccgttaaagtttttaaccgttccggtttaacccggtttaccgggaaccgggttaaaccgggtaaccccggtaaggttaacccgtaccccggttacccggtttaaacggtaccccgaacccgggtaccccggaaaacccggtcccccgtaaacccccgttaacccgg

SEQ ID NO: 37897 - DNA, 745 bp, Homo sapiens
  misc_feature: GYAE6OF01EI2AX.14.66.F11.1.454.CMB.1.raw
  modified_base (338)..(338): a, c, t, g, unknown or other
  misc_feature (338)..(338): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctggtggccttgggacagacagtcaggactcacatcgaccaaggacgaccggcctacggaagctattatgcaagctggtaccagcagaacgccaggacgacggccctgtacttgtcatctaagtaggtaaaaacncgttccggccctacgacgggtacctcccgaacggacccgtattccgtacgtcgggacctacccgtaaacctaccgaaacgggtaaaaccaaccgtacggtaccttttacccgttaccgaaaccctacttacccgaacgttcgggggtaccttacggaacggggtaccggaagtagttacggaacgggtcttaacggaactttaacgttttaccgtaaggtttaaccgttaccccggggtaacacggtaccgtaacggtacctacccgtaaaaccccgttaatttaacggtccgtttaccggttaaccggaaccggttacgggtaacccgaacggttacccgacccggttaccctaccgggtactaacccggaaccccgaacgggtacccccaaaccccggtaacccg

SEQ ID NO: 37898 - DNA, 714 bp, Homo sapiens
  misc_feature: GYAE6OF01CU4GK.14.66.F11.1.454.CMB.1.raw
  modified_base (265)..(265): a, c, t, g, unknown or other
  misc_feature (265)..(265): n is a, c, g, or t
  modified_base (349)..(349): a, c, t, g, unknown or other
  misc_feature (349)..(349): n is a, c, g, or t
tcagcgtctagtaccacgaccggtgctcgatttagtcacgcgagagggagcaccgtggagaagacagtggcccctacagaatgttcataggttcccaactctgaccccacccacggggagcctggacccctctctggctcgctctcctcactctttgcataggttctgtggtttcttctgagctgactcaggaccctgctgtgtctggtggccttgggacagacagtcaggatcacatgaccaagggacgacggcctacgggaancttaattatgacaagtcgtacggtaccagacagaagccgaggaccacggccctgtacttgtctagtactaagtaaggtaaaacncgtacccggaccctagacgggactaccccgaacggaacccgtattccgtacgttcggcctacccgaacgtacgaaacggaaaccacgtacgtcctttacccgtacgaacccacgttaccgacgggtacggggtccgtaccggaacggggacggtaaggagtacgggacgtacgttagtaaccttaatttaaccggttacggttaaacggtacccgggacgacgtacgtacggttacgtaaccctaacccgtatttaccgtcgttaccggttaacggaaccggtacgggaacccgtaacggttccccgaaccgttaccgtacggtaccgaacccggaccccgaaacggtcccctaacccccgtacg

SEQ ID NO: 37899 - DNA, 743 bp, Homo sapiens
  misc_feature: GYAE6OF01B72G1.14.66.F11.1.454.CMB.1.raw
tcagcgtctagtaccacgaccggtgctcgatttagtcacgcgagagggagcaccgtggagaagacagtggcccctacagaatgttcataggttcccaactctgacccccacccacgggagcctggacccctctctggctcgctctcctcactctttgcataggttctgtggttttcttctgagctgactcaggaccctgctgtgtctggtggccgttgggacagacagtcaggatacacatcgaccaagggacggaccggccgtacggaagtcttaagttacgtgacaacgtccgtacggtaaccaggacaaggaacgccgaaggaccgaccggtcccctgtacttgtctatacgttaataacggtaaaaactcgtacccggacccgtacgaacgggtacctacccgaacgtaccgtacttctcgtcggaccctacccgaaacgtaccgaaacggtaaaccaccgtacgttccctttaccgttacgaaccctacgtccgtacggtcggggacctacggagggtaacgaaggtagtacgggagtaccgttagtaacttacgttaacgtacggttaaccggttacccggaacgtacgtaccgtacggttaccgaacccttaaccctaagttacgttacgttaccgttaccggtaacggtaccgggtaaccgttaacgggtccctacccggttaccgtacggtacccgaaccggaccccaaccgggaccccctaaaccccgtaccg

SEQ ID NO: 37900 - DNA, 816 bp, Homo sapiens
  misc_feature: GYAE6OF01AENCO.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaagggagccggcctcggaagctattatgcaagctggtaccagcagaagccgaggacacggccctgtacttgtactatcctaagtacggtaaaaaccacgtcccggccctacgaacggggacctcccccgaacggacccgtaactttccgtaccgttcgggcctaccccaaaccttaccgaaacgggaaaacccacctaacgtcccgttttacccttacggaacccctaactaccgaccgggttacggggacccttacgggaacgggacccgggaaaggtacgttacgggaccgggtaccttacgggtaaccttttaagtttaacccggtaaggtttaaacccggtttacccccgggggaactaaccgggtaccgttaacggttcccgggtaaaccccctttaaaccccgtaaagttttacccttacgggtttacccgttaaccgggtaaacccggttacggggaaccccggttaaaaccgggttccccgtaaaccccgggtttaccccggtaaagggtttccccgaaaccggtaccccccgggaaaccggtaccccccgaaaacccccgttacccgg

SEQ ID NO: 37901 - DNA, 524 bp, Homo sapiens
  misc_feature: GYAE6OF01ENHL9.14.66.F11.1.454.CMB.1.raw
  modified_base (446)..(446): a, c, t, g, unknown or other
  misc_feature (446)..(446): n is a, c, g, or t
tcagcgtctagtaccacgaccggtgctcgatttagtcacgcgagagggagcaccgtggagaagacagtggcccctacagaatgttcataggttcccaactctgaccccacccactggagcctggacccctctctggctcgctctcctcactcttttgcataggttctgtggttttcttctgagctgactcaggaccctgctgtgtctgtggccttgggacagacagtcaggatcacatgccaaggagacggcctcggaagctattatgcaagctggtaccagcagaagccaggacaggccctgtacttgtcatctataggtaaaaacatcccgccctcgaggactcccagaccgatctctgctccaactcaagaaacacagccttcctgaccatcacgtgggcctcgaggacgaagatgagctgactattactgtaacgtccgganagcagtcacctaacctaattctcgtcttacggacgtgggaccaggtcaccgtctacgacagcccacggccctaacccg

SEQ ID NO: 37902 - DNA, 884 bp, Homo sapiens
  misc_feature: GYAE6OF01CVDB7.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttctctgagctgactcaggaccctgctgtgtctgtggccttgggacagacagtcaggatcaacatcgaccgaaggagaccggtcctacggaagtcctaattatagcaagctaggtaccagacagaagccaaggacgacggccctgtacttgactagtactaagtaacggtaaaaacacgtacccgggccccttacgaacgggtaaccgttaccccgaacggtaaccccgtaacgtttccgttaaccgttcgggtcctaaccccgtaaacgttaaccgaaacggggtaaaaacctaaccgaacggtaccctttacccgtttaacggaacccctaattaccgtaaccgttacgggggcccttaacggaaacgggaccgggaaaggtaacggtacggtaacgggtaccgttaacggttaaaccgttaagttttaacccgttaacggtttaaaccggtttaccccccggggaaacgtaaccggtaccgtaacgggttaaccgaaccccgtttaaacccccgtaaacgttttaacggttaaaccgggttacccgttttaaaccggggaaaccggttaaccgggggtaaaccccgggtaaaacgggttaccccggtaaacccccgggttacccggttaaccggggtttaaccccaaacccgggtaacccccggttaaaaacccgggaaccccccgtaaaacccccccgttaaaccccgg

SEQ ID NO: 37903 - DNA, 633 bp, Homo sapiens
  misc_feature: GYAE6OF01DL9DA.14.66.F11.1.454.CMB.1.raw
  modified_base (329)..(329): a, c, t, g, unknown or other
  misc_feature (329)..(329): n is a, c, g, or t
tcagcgtctagtaccacgaccggtgctcgatttagtcacgcgagagggagcaccgtggagaagacagtggcccctacagaatgttcataggttcccaactctgaccccacccacgggagcctgacccctctctggctcgctctcctcactctttgcataggttctgttggtttcttctgagctgactcaggaccctgctgtgtctgtggccttgggacagacagtcaggatcacatgaccaaggagacggcctggaagctattatgcaagctggtaccagcagaagccgaggacacggccctgtacttgtcatctaataggtaaaaacnctccggaccctcgacgggactccccgaagaccgtattcctctcggcctaccactacgaaggaaacacacgtcttcctagaccactccgacgtcgggctacggaggacgggaagagtggacggctagtaacttaatttacgtacgttaaccgttacccgggaacacgtcgacggttacaaccttaaccccgtaatttacgtcgttaccgttacggaaccgttacgggaaccctaacgggtacccgtacccgttaccggtaacggtaccgaaccgaccccaaccgggacccctaaaccccgtaccg

SEQ ID NO: 37904 - DNA, 611 bp, Homo sapiens
  misc_feature: GYAE6OF01C7HKJ.14.66.F11.1.454.CMB.1.raw
  modified_base (246)..(246): a, c, t, g, unknown or other
  misc_feature (246)..(246): n is a, c, g, or t
  modified_base (334)..(334): a, c, t, g, unknown or other
  misc_feature (334)..(334): n is a, c, g, or t
tcagcgtctagtaccacgaccggtgctcgatttagtcacgcgagagggagcaccgtggagaagacagtggcccctacagaatgttcataggttcccaactctcgaccccacccacgggagcctggacccctctctggctcgctctcctcactctttgcataggttctgtggtttcttctgagctgactcaggaccctgctgtgtctgtggccttgggacagacagtcaggatcacatgaccaaggngacggcctacggaagctattatgacaagctaggtaccagacagaacgccaggacacggccctgtactgtcatactatacggtaaaacncgtccggccctagacgggacctacccgaacgtacccgtattcgtcgtcggcctaccgaactacgaacggtaaacacacgtccttccgttacgacctatccgacggtcgggctacgagggacggaagagtgaggctagtacttattacgtacgtaacgtccgggacacgacgacgtcgtacctaacctagttacgtcgtaccgttacggaacgtcggaaccgtacggtccaccgtaccgtacggtaccacggacccgaaccggccctaaccccgtacg

SEQ ID NO: 37905 - DNA, 688 bp, Homo sapiens
  misc_feature: GYAE6OF01CSGOJ.14.66.F11.1.454.CMB.1.raw
  modified_base (269)..(269): a, c, t, g, unknown or other
  misc_feature (269)..(269): n is a, c, g, or t
  modified_base (328)..(328): a, c, t, g, unknown or other
  misc_feature (328)..(328): n is a, c, g, or t
tcagcgtctagtaccacgaccggtgctcgatttagtcacgcgagagggagcaccgtggagaagacagtggcccctacagaatgttcataggttcccaactctgaccccacccacggggagcctggacccctctctggctcgctctcctcactctttgcataggttctgtggtttcttctgagctgactcaggaccctgctgtgtctgtggccttgggacagacagtcaggatcacatcgaccaaggacgacggcctcggaagctattangcaagctggtaccagcagagcaggacacggccctgtactgtcatctaataggtaaaacnctccggacctcgacggactcccgagaccgattcgtacgtcggaccttaccaactcgaaacggaaacaccgacgtcctttaccgttacgaaccctaattccgaacggtggggtacctacggaagggaccggaaagtagtaggacggacctaggtaacttaacgttaaccgtacggttaaaccgttccccggggaatacgggtactaacggtacggtaaccctaacccgtaattacgttaccgtaccgtttaaccgggaaccggtcggggtaaacccaacgggttacccgaacccggtttaccgtaacggttacccgaacccggtaaccccgaaacccgggacccctaaaccccgtaacccg

SEQ ID NO: 37906 - DNA, 525 bp, Homo sapiens
  misc_feature: GYAE6OF01E0HW8.14.66.F11.1.454.CMB.1.raw
  modified_base (324)..(324): a, c, t, g, unknown or other
  misc_feature (324)..(324): n is a, c, g, or t
  modified_base (403)..(403): a, c, t, g, unknown or other
  misc_feature (403)..(403): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggccctgtacttgtcatctatggtaaaacntccggcctcaggatcccagaccgattctctggctcaactcagaacacagcttctgaccatcactgggctcaggcgaagntgagctgactattactgtaacgttccgggacagctagtcgactaaccccaattactgtacttacggaacgtcgggacaacggtcaccgtcctacggtcacgacccaaggcccaacccgtacg

SEQ ID NO: 37907 - DNA, 589 bp, Homo sapiens
  misc_feature: GYAE6OF01AL88W.14.66.F11.1.454.CMB.1.raw
  modified_base (327)..(327): a, c, t, g, unknown or other
  misc_feature (327)..(327): n is a, c, g, or t
  modified_base (427)..(427): a, c, t, g, unknown or other
  misc_feature (427)..(427): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctaggtaccagcagaagccaggacaggcccctgtacttgtcatctataggtaaaacnctccggcctcgagggactcccgagaccgattctctggctaccaactcgaacggaaacacagtccttctacgaccatcacgtgggactcgacggcggaagngtggagcgtcgacttatacgtacgttaacgtacccgggacacgtcagtcgacccttaaccctaattacgtagttccgttaaccgggaacgtcgggaacctacgggtcccaacccggttccgttaacggtccgaccgtacccgaacggtcccaacccgtaccg

SEQ ID NO: 37908 - DNA, 702 bp, Homo sapiens
  misc_feature: GYAE6OF01BP8IS.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagcaggacaggccctgtacttgtcatctataggtaaaacagtaccggccctacgagggactcccgagaccgattctcgtggcctccaactacgaaggaaaccacagtccttccgttacgaaccctactaccgtacgtcggggccgttacgaaggggaccgggaaagtacggttagggaacgggtcgtacggtaactttaacgtttaaccgttaacggttaaacccggtttacccggggaacgacggtaccgtaacggttacgaacccgttaaaccccttaaaagtttacgttaccggttaccgtttaaccggggtaacgttacggggtaaccccgtaaacgggttcccgtaaacccggttcccgttacggtacccgaaccggacccccgaaacgggtaccccctaaaccccccgtacg

SEQ ID NO: 37909 - DNA, 677 bp, Homo sapiens
  misc_feature: GYAE6OF01EZVE3.14.66.F11.1.454.CMB.1.raw
  modified_base (339)..(339): a, c, t, g, unknown or other
  misc_feature (339)..(339): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggaccccctctctggctcgctctcctcactctttgcataggttctgtggtttcttctgagctgactcaggaccctgctgtgtctggtggccttgggacagacagtcaggatcacatgccaaggagaccggcctacggaagctattatgacaagcgtggtaccagcaagaagccgaggacgacggtcccctgtacttgtcatactatacggtaaaacnctcccggcctcaggtactcccacgaccgtattctcgtcggctacctaactcgaaggaaacacacgtaccttaccgttcgaacctactccgtacgtcggggacctacggagggtaccgggaagtagtacggacggtcgtacgtacttaacgtttaccgttaggttaacccgtttacccggggaacctaggtaccgtaggtaccgtaacccttaaaccccttaagttacgttacgtttaccgttaccgggaacggttaccgggaacccgtaacgggtcccctacccgttacccgtacggtaccgtaccgaaccccgaaccggaccccctaaccccgtacg

SEQ ID NO: 37910 - DNA, 766 bp, Homo sapiens
  misc_feature: GYAE6OF01E6BOL.14.66.F11.1.454.CMB.1.raw
  modified_base (131)..(131): a, c, t, g, unknown or other
  misc_feature (131)..(131): n is a, c, g, or t
  modified_base (341)..(341): a, c, t, g, unknown or other
  misc_feature (341)..(341): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctntctggctcgctctctcactcttgcataggttctgtggtttcttctgagctgactcaggaccctgctgtgtctgtggccttgggacagacagtcaggatcacatgaccaagggagaccggccttacggaagcttaattatgacaagcgtacggtaccagcagaacgcccgaggacacggtccctgtactgtacatactaagtagtaaaacncgtaccggccctacgacgggtacctacccgacgtacccgtacgtttcctacgtcgggtacccttacccgtaaacgtaccgaaaacgggtaaacccacgttaaccgttccctttacccgttaaccggtaacccttaccgtaccgtaccgggttcggggtaccgttacgggaacggggtaaccggaaaggtacggttacggaagggtacctaacggttaactttaagtttaccgttaaggttaacccgggttaaccgggaaccgtagtaccgtaacggttaccgtaaccccttaaaccccgttaagtttaccggtacggttacccggtaaacgggtaccggtacgggtaacccgaacggtttacccgaccggttacccggtacggtacccgtacgaccccggaaccggaccccctaacccgtaccgg

SEQ ID NO: 37911 - DNA, 671 bp, Homo sapiens
  misc_feature: GYAE6OF01AIOXB.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatcgaccgaaaggacgaccggccgtacggaagctaattagtgacaacgctacggtaccagcaaggaacgccgaaggacacgccctagtactgtacactactaatagtaaaacacgtccggccctacgacggactacccgaacgtaccgtacttccgtcgtcggtcctaacccaacgtaccgaaacggaaaccaccgtacgtacctttaccgtagaaccctagtaccgtacggtacgggtaccttacggacgggaacggtaacgtagtacggaaggtctacgtactttaataccgtagttaaccgtacccggagacgtacgacgtactaaccctaaccctaagttacgtgttacccgtacggtaaacgtccgggtaaactacggtacccaccgttacccggtagtacctacgaaccccacggaccccgaaccctacgg

SEQ ID NO: 37912 - DNA, 712 bp, Homo sapiens
  misc_feature: GYAE6OF01B9ZN1.14.66.F11.1.454.CMB.1.raw
  modified_base (519)..(519): a, c, t, g, unknown or other
  misc_feature (519)..(519): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggttttcttctgagctgactcaggaccctgctgtgtctgtggccttgggacagacagtcaggatcacatgaccaagggagacggcctacggaagctattatgcaagctggtaccagcagaagcaggacgacggccctgtactgtcatctataggtaaaacagtccggaccctcgaggactcccgagtacgacttctcgtcggcctaccaactacgaaggaaaccacgacgtccttcccgttacgaccctatccgtacgtcggggcctacggtaacgggacggaacgagtacggacggacgtacgtaacgttactttaaccgttacggttaaacggttacccccggggtaanaccggtacgtaacggttaccgtaacccgttaaacccctaagtttaacgttacggttaccgttaacccgggtaaccgggttaccgggtaaaccccggttaacggttacccccggaacccggttaccccgttaacgggttacccgacccggtaaccccgaaacccgggtaacccccaaacccccggttaacccgg

SEQ ID NO: 37913 - DNA, 679 bp, Homo sapiens
  misc_feature: GYAE6OF01BJUT3.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctcggacccctctctggctcgctctcctcactcttgcataggttctgttggtttcttctgagctgactcaggaccctgctgtgtctgtggccttgggacagacagtcaggatcacatcgaccaaggacgacggcctaggaacgcttattagtcgacaagcgtacggtaccagcgaagaacgccgaggacaccggtcccctgtacttgtactatactaagtaacggtaaaactcgtcccggaccctacggacggtacctaccgaacggtacccgtacttccgtacgtcggtacctacccaaacgtaccgaaacggaaacctaccgtacgtacctttacccgtacgaacctacgtaccgtacggtcgggactacggacggacggaagtagtaggacgtactagtacgtacttacgtacggttacgtacccggatacgacgtacgtacgtaacctaaccctagttacgtcgttaccgttacggtacggtcggtaacctacggtcctacccggttacgtacggttacccaccggaacccgtaaccggacccctaaccgtaccg

SEQ ID NO: 37914 - DNA, 856 bp, Homo sapiens
  misc_feature: GYAE6OF01DDD23.14.66.F11.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
tcagcgtctagtaccacgaccggtgctcgatttagtcacgcgagagggagcaccgtggaaaagacagtggcccctacagaatgttcataggttcccaactctgacccccacccacgggagcctggacccctctctggctcgctctcctcactctttgcataggttctgtggtttcttctgagctgactcaggaccctgctgtgtctggtggccgttgggacagacngtcaggatcacatcgaccgaaggngaccggcctagggaagtcttagttatgacaagtccgtacggtaaccagaccgaaggaacgcccgaagggaaccgaccggtcccccgttaggttaccgttcggtacctaacgtttaccttaaggttaaaccggttaaaaaaccgacgttaccccggaaccccgttacggaacgggtaaccgtacccccgaaggttaaccccgttaacgtttcccgtaccgtaccgggtaccttaaccccgtaaacgttaccgaaacgggaaaacctacgtaaccgttccgtttacccgttacgaaccctacgttaccgtacggtcgggggtacctacgggaacgggtaaccgggaagtacgtaggaacgggtccttacggtaacctttaacgttaacggttacgttaaccggttaacccgggaataccggtaacgtacgtaccgttaaccccttaaaccgttaacgtttacgttaccggttaccgttaccggggtaaaccgttaccgggtaaacccggtaaacgggttcccgtaaaccccgggttaccgttaacgggtacccgtaaccggaaccccccgtaaccggtaaccccccgtaaccccgttaccggtacccg

SEQ ID NO: 37915 - DNA, 659 bp, Homo sapiens
  misc_feature: GYAE6OF01CISKR.14.66.F11.1.454.CMB.1.raw
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (351)..(351): a, c, t, g, unknown or other
  misc_feature (351)..(351): n is a, c, g, or t
tcagcgtctagtaccacgaccggtgctcgatttagtcacgcgagagggagcaccgtggagaagacagtggcccctacagaatgttcataggttcccaactctgaccccacccacggggagcctggacccctctctggctcgctctcctcactctttgcataggttctgtggtttctctgagctgactcaggaccctgctgtgtctggtggcctagggacngacagtcaggatnacagtgaccgaaggacgacggccaggaagctattatgacaagccgtaggaccaagcgagaacgccgaggacgtacggacccctaggtacttcgactactactaagtaacgtaaaaacncgtccgaccctagtacgggacctaccgaacgtaccgtacttccgtcgtcgccttaccaacctacgaaacggaactacacgtcctttaccgtacgaaccttacacgtaccgggtcgggtacttaccggaagggacgggaacaggtacgaggtctatacgtattacgtacgtaaccgttccgggacagtacacgtacaccctaccctaaagttcgtcgtaccggttaacgaaccgtcgggtaacccgtacggtaccacccggttacgtacggccgaacccgtacccgaaccgtaccccgaacccgtaccg

SEQ ID NO: 37916 - DNA, 825 bp, Homo sapiens
  misc_feature: GYAE6OF01AQZWG.14.66.F11.1.454.CMB.1.raw
  modified_base (121)..(121): a, c, t, g, unknown or other
  misc_feature (121)..(121): n is a, c, g, or t
  modified_base (133)..(133): a, c, t, g, unknown or other
  misc_feature (133)..(133): n is a, c, g, or t
tcagcgtctagtaccacgaccggtgctcgatttagtcacgcgagagggagcaccgtggagaagacagtggcccctacagaatgttcataggttcccaaacttctgaccccacccacgggancctggacccctntctggctcgctctcctcactctttgcataggttctgtggtttctctgagctgactcaggaccctgctgtcgtctggtcgccttgggacagacagtcaggatcgacatcgccgaaggacgtaccggccttacggaagcttagttacgtcgacaaggtccgtacggtaccaggactagaacgtccgaacggaccgaccgggtcccctagttaccgttacggtaccttaacgtaccgttaacgttaacggtaaaaaaccgtccggttaccccggtacccgtacggtaacggggtaaccctaccccggtaacggtaaccggtacgtttaccgtaccgtacggggttacccctacccgtaaaccgtttaccggaaaccgggtaaaacctaccgtaacgttcccgtttacccgttacgggtaacccttacgtaccggtaaccggtcgggtacctacggaaccgggtccggtaaagtacggttacggtaacggtccgttaacggttaaccgtttaacgttaacccggttaacggttaaccggttacccgggaacgtaacgggtaccgtacggttaccgtaaccttaaaccccgtagttacgttacgtaccgttaaccggtacgtaccgggtactaacgggtcgtacccgttacgtaacggtcccgaacggtaccccaacggttacccaaccgtacccgg

SEQ ID NO: 37917 - DNA, 821 bp, Homo sapiens
  misc_feature: GYAE6OF01AHJBS.14.66.F11.1.454.CMB.1.raw
  modified_base (270)..(270): a, c, t, g, unknown or other
  misc_feature (270)..(270): n is a, c, g, or t
  modified_base (333)..(333): a, c, t, g, unknown or other
  misc_feature (333)..(333): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaagggacgacggcctacggaagtctattagngacaagctggtaccagcagagccaggacacggccctgtacttgtacatctatacggtaaaacncgtccggcctacgacgggactcccgaaggacccgtattccgtcgtcggtaccctacccgtaaaccgtaccgaaacgggaaacccaccgtaacggttcccctttaccgttaccgaaccccgttagttaccccggaaccgggtttacgggggacccttaaccgggaacgggggtacgggtaaacggtacggttacgggacgggtaccttaacggtaaaccgtttaacgtttaacccgggttaacggttaaacccggtttacccccggggaaacgtaccgggtaccgtaacgggtacccgtaaaccccgtttaaccccgtaaagttttccgtaccgggtttacccggtttaaccgggtaaacccggttacccgggggtaaacccgttaaccggggttacccccgtaacccggtttacccggtaaccgggtaacccggaaccccggtaacccccggaaacccgggtacccccctaaacccccggttaaccgg

SEQ ID NO: 37918 - DNA, 734 bp, Homo sapiens
  misc_feature: GYAE6OF01BCBEN.14.66.F11.1.454.CMB.1.raw
  modified_base (347)..(347): a, c, t, g, unknown or other
  misc_feature (347)..(347): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctggtcggccgttgggacagacagtcaggatcacatgaccgaaggacgaccggccgtacggaagtctattagtgacaagtctaggtaccagcgaagacgccgaggacacggtcccctagttactgtcatctataaggtaaaacncgtccgcctacgacggactcccgagtaccgtattcctcgtcggtacctaccctaactaccgaaacggaaaccacgtacgtcctttacccgtacgaccctagtaccgaccggttcggggtaccctacgggaacgggtaccgggtaaagtcggttacgggacggtaccgttaacggtaactttaacgtttaaccggttacgggttaaacccgggtttaccccggggaacaaccgggttacccgtaacgggtttacccgtaaccccccgttaaacccgtttaacgttaccggttacggttacccggttaaccgggtaaccgtacgggtaaccgtaacggtcccgtacccgtacgtacggtccaccgacccgacccgccctaaccccgtcg

SEQ ID NO: 37919 - DNA, 760 bp, Homo sapiens
  misc_feature: GYAE6OF01DW94A.14.66.F11.1.454.CMB.1.raw
  modified_base (77)..(77): a, c, t, g, unknown or other
  misc_feature (77)..(77): n is a, c, g, or t
  modified_base (638)..(638): a, c, t, g, unknown or other
  misc_feature (638)..(638): n is a, c, g, or t
tcagcgtctagtaccacgaccggtgctcgatttagtcacgcgagagggagcaccgtggagaagacagtggcccctanagaatgttcataggttcccaatctgaccccacccacgggagcctggacccctctctggctcgctctcctcactctttgcataggttctgttggtttctctgagctgactcgacggacctgctgtgtctgtggaccttgggacagacagtcaggatcacagtcgaccgaagggacgaccggccgttacgggaaatccgttaagttagtagaccaaggtaccgtacggtaaccacgtacgaacggaacgccgaaggaccgaccgtcccgttagtacttacgtctactacgttaacgtaaacggaaaaaccttcgtaccccggaccccgttacgaacgggggtacccttaccccgaacggtaaccccggttactttccgttaccggtaccgggtacccttaaccgaaacccgttaacggaaaaccggtaaaccaccgtacggttaccctttaccgttacggaacccttagttaccgaccgggtacggtccgtaacggaagggacggaagtacgtacggaagtacgtagttaacttacgttacgtacgtaaccggtaccggaacncggtactacggccttaacccgtaacctgttaacgcgttacgtaacggtaccgtaacggaccgtaacggcccgtaccgtccgtaacggcctaccgaaccggaaccgtacccgaccgtaacccg

SEQ ID NO: 37920 - DNA, 855 bp, Homo sapiens
  misc_feature: GYAE6OF01EU6L2.14.66.F11.1.454.CMB.1.raw
tcagcgtctagtaccacgaccggtgctcgatttagtcacgcgagagggagcaccgtggagaagacagtggcccctacagaatgttcataggttcccaactctcgaccccacccacgggagcctggacccctctctggctcgctctcctcactcttgcataggttctgtggtttcttctgagctgactcacggaccctgctgtgtctgtggccttgggacagacagtcaaggtactcaactagtcgaccgaaagggacggaccggtcccgtacgggaaacgtaccttaatttaacgtcggactaaacggtccgttacgggtaaccaaggacgaaggaacggacccgaagggaccgaccggtccccttaggttacgttgtacacttacttaagtaacggtaaaaacctccgtaccccggacccctacggacggggtaccttaccccgaacggtacccgttactttaccgtacgtccggtacccttacccgaaaccgtacgaaaccggtaaaccaccgtacgttccctttacccgtacgaaccctaacgttcccgtacggggtcgggtaccgtacggacgggaaccggtaagtacggtacggacgtactacggttacttaactttaccggtaacggttaaccggttacccgggaatcggtaacgtaaccggttaccgtaaaccccgttaacccgttaagtttaccggtaccgtttacccggttaaacccgggtaacggttaaacccggggtaacccttaaaccgggtaccccgttaaccccggtaccgttaaacccggtacccgtaaccccgggaaccccgttaaacccccggaaccccgttaaacccccgttaccgg

SEQ ID NO: 37921 - DNA, 678 bp, Homo sapiens
  misc_feature: GYAE6OF01CR3DS.14.66.F11.1.454.CMB.1.raw
  modified_base (122)..(122): a, c, t, g, unknown or other
  misc_feature (122)..(122): n is a, c, g, or t
  modified_base (380)..(380): a, c, t, g, unknown or other
  misc_feature (380)..(380): n is a, c, g, or t
tcagcgtctagtaccacgaccggtgctcgatttagtcacgcgagagggaggcaccgtggagaagacagtggcccctacagaatgttcataggttccccaactctgacccccacccacgggancctggaccccctcgtctggctcgctctcctcactctttgcataggttctgtgtttctctgagctgactcacggaccctgcctgtctcgtggtcggccgttagggacagacgtacgtcgaggactcaacagtccgaccgaagggacgaccggtccgtacggaacgtctattacgacgacgacgtacgtacggtacacgtacgagacgaccgaacggaccgacggtcccttagtacctgactatactagtaacgtaaacnccgtccggcctagacggtctaccgacgtacctattcctacgtcgacctaccgacgtacgaacggaacctacgtacgttccttaccgttacgacctacgtaccgacggtcggtactacggaggacgtaagtgacggtacgtctacgttaactagtttaccgtaggttacccgtaccggacacggtctacgtaaccgtaacccttaccgtaattccgtaccgtaccgttacggacggtaccggtacgtaacggtccctaaccggtcgtacgacgaacccgaccgaccgcccctacgtccg

SEQ ID NO: 37922 - DNA, 780 bp, Homo sapiens
  misc_feature: GYAE6OF01BDAGS.14.66.F11.1.454.CMB.1.raw
  modified_base (253)..(253): a, c, t, g, unknown or other
  misc_feature (253)..(253): n is a, c, g, or t
tcagcgtctagtaccacgaccggtgctcgatttagtcacgcgagagggagcaccgtgggagaagacagtggcccctacagaatgttcataggttcccaactctcgacccccacccacggggagcctcggaccccctctctggcctccgctcctcctcacttctttgcataggttctgttggtttcttctgagctgactcgacggacctgctgtgtctggtcggccgttgggacagacagtcgaggatcaactntcgaccgaaggcgaccggccgtaggaactcttattatcggacgtaagtccgtacggtacccagacgaagaaccggaccgagggtaccgaccgggtccccttaggttaccgtttgtacctacttaccgtaagtaaacggtaaaaacctccggtacccccggtaccctacggtaacggggaaccctacccggtaaacggtacccgttaacgttcctaccggtacggtacccttaacccgtaaacctaaccggtaaaaccggaaaacctaccgttaaccgtttacccgtttacccgtaacccggtaaacccgtacgttaccggtacggggttccgggaccttacgggaacgggtaacgtacgtagtcggacgtacgtacgtacttacgtacgtacgtaaccggtccgatacgtacgtacgtacctaccgtaactcgttagtacgttacgtaccgggacgtacggtaaccgtaccgccgttaccggtaccgtacggtacccaccggaaccaccggtcccctaccgtacccg

SEQ ID NO: 37923 - DNA, 698 bp, Homo sapiens
  misc_feature: GYAE6OF01CDTYW.14.66.F11.1.454.CMB.1.raw
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (342)..(342): a, c, t, g, unknown or other
  misc_feature (342)..(342): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcattaggttctgtggtttcttctgagctgactcaggaccctgctgtntctgnggcctgggacagacagtcaggntcacngtcgaccaagggacgaccggccgtacggaagtctaattagtgacaagctaggtaccagcaagacgcaggacacggtccctgtactgtcatctataaggtaaaaaccncgtaccggacctcgaacggactacccgagtaacccgacttctcgtacggtacctaccaaacgtacgaaacggtaaaccacgtaacgtccgtttacccttacgaaccctacgtaccgtaacggttggggacccttacggaacgggaacgggtaagtacttacgggaacgtacgttacgaacctttaacgttacgttaacgggttaaaccgttacccgggaactaacggtctaaccgtacgtaaccctaaaccctaagttaactcggttaccgttacggtaaccgtacgggaacctaacggtccgtaaccccgtacgttacggtacctacggaccccgaaacgccctaacccgtaccg

SEQ ID NO: 37924 - DNA, 787 bp, Homo sapiens
  misc_feature: GYAE6OF01B2XFW.14.66.F11.1.454.CMB.1.raw
  modified_base (371)..(371): a, c, t, g, unknown or other
  misc_feature (371)..(371): n is a, c, g, or t
tcagcgtctagtaccacgaccggtgctcgatttagtcacgcgagagggagcaccgtggagaagacagtggcccctacagaatgttcataggttcccaaactctgacccccacccacggggagcctggaccccctctctggctcgctctcctcactcttgcatggttctgtggtttcttctgagctgactcgacggaccctgctgtgtctggtcggccttgggacagacagtcgaggactcacgatcgaccgaaggagaccggtccgtaggaagcttatagtcgacgaagcgtacggtaccaggacgaagaacgccgaaggaccaccgggtccctagtaccttgtcattacgtaacgtaaacggtaaaaacnccgtccccggtaccctacggaacggggtacctaccccggaacgtaacccgttacgttccgttaccggtcggacccttaaccgaacccgtacggaaaccggaaacctacgtaccggttcccttacccgtacggaaccctacgtaccgacggttcggggacctaacggtacgggaacggtaacgtggtacggaacgggtactacggttaactttaacggttaccgttaacggttaacccggtacccgggtacaacgggtacgtaacgttacccgaacccctttaacgtaacgtttacggtaccggtttaccgtaaaccgggtaacggttaccgggtaaccgtaaccggttcccgtacccggttacgtaccgggtaccgaccggaaccccgaaaccggtaaccccctacccggttaccg

SEQ ID NO: 37925 - DNA, 652 bp, Homo sapiens
  misc_feature: GYAE6OF01CTWK7.14.66.F11.1.454.CMB.1.raw
  modified_base (118)..(118): a, c, t, g, unknown or other
  misc_feature (118)..(118): n is a, c, g, or t
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
tcagcgtctagtaccacgaccggtgctcgatttagtcacgcgagagggagcaccgtggagaagacagtggccctacagaatgttcataggttcccaactctgaccccacccacgggancctggacccctctctggctcgctctcctcactctttgcataggttctgtgtttctctgagctgactcaggccctgctgtntctgtggccttggacagacngtcaggctcacatgccaaggcacggtccaggaagcgtattatgacaacgcgtaggtaccaaggacagacgaccgaggaaccgccgtccctagttacttacgtactactcttaacgtaacggtaaaacctccgtccgccgtacgacggactccgacgtacgactctacgtcggacctacaccgtacaaacggaaccacgacgtcttacccgtacactacgtccgtacggtcggtccgtaacgacgggacgtaacgtacggtcggtacgtactacgtaacctttagttaccgttacgtaaccggtaccggtacgtacgcgtacgttacgaaccccttacgtaacgtttacgcgttaccgtacgtacgtacggtaacgtacggtaccctccggtaacctcggaccacccgaccgtaaccgacccgaacccgttaccg

SEQ ID NO: 37926 - DNA, 730 bp, Homo sapiens
  misc_feature: GYAE6OF01D35F1.14.66.F11.1.454.CMB.1.raw
tcagcgtctagtaccacgaccggtgctcgatttagtcacgcgagagggagcaccgtggagaagacagtggccctacagaatgttcataggttcccaactctcgaccccacccacgggagcctcggacccctctctggctcgctctcctcactctttgcataggttctgtggttttcttctgagctgactcaggaccctgctgtgtctggtcggtccgttgggacaggacagtcgaggactacacagtcgaccgaaggacgaccggccgtacggaacgtacttaagttagtacgacaagtactacggtaccagacgaacgaacggaccgaagggaccgaccggtccccttagttacgttcgtactagtactaagtaaacggtaaaacctcgtaccccggacccgtacggaacggacctacccgacgaccgttacttccgtcgtacggtacctaccgtaaactaccggaaacggaaacaccgtacgttccttaccgttacgacctacgtaccggaggtacgggtcctacgggacggacggaagtacgtacgaggtacctagtaactttacgtttaaccgtaggttaaccggtacccggaatacggacgttacgtaccctaacccttaaaccgttagttccgtacgttaccgtacggtaaccgtacgggtacctaacggtccctaccgtacggtacggtccaaccggaccccgtaacggacccctcccgtacg

SEQ ID NO: 37927 - DNA, 770 bp, Homo sapiens
  misc_feature: GYAE6OF01AR7OB.14.66.F11.1.454.CMB.1.raw
  modified_base (468)..(468): a, c, t, g, unknown or other
  misc_feature (468)..(468): n is a, c, g, or t
tcagcgtctagtaccacgaccggtgctcgatttagtcacgcgagagggagcaccgtggagaagacagtggcccctacagaatgttcataggttcccaactctgaccccacccacgggagcctcggacccctctctggctcgctctcctcactcttgcatggttctgtggtttcttctgagctgactcacggaccctgctgtcgtctggtcggtccgttgggacagacagtcaggtactcaacgagtcggaccgaaagggacggacccggtaccgtacgggaaagtccgttaagtttacgttacgacgaaacggccgttacggtaccgagacgaaggaacgcccgaagggtaccgaccgggccccgttacggttacttcggtactaagtaccgttaagtaaacggtaaaaacctccgtaccccggtacctaacggaacgggtacctaccccgtaacgggtaacccgttnttaccgccgttacggaccctaccgtaacctaccgaaacggtaaaccacgtacgttaccttctacgacctacgtctaccggttcgggactcggaacggggtacgaagggagtggaacggtcgtaacgttaactaccgttagttaacggtaccgtacccgggataccgtactacgttacgtaacccttacccgtaagtttacgtccggttacgttaacgggtacccgtacgggtaaccgtaccggttccaacccgggttctacggacccgacggtaaccccgaccgtacccgtacccgtaaccg

SEQ ID NO: 37928 - DNA, 753 bp, Homo sapiens
  misc_feature: GYAE6OF01AJU7X.14.66.F11.1.454.CMB.1.raw
  modified_base (180)..(180): a, c, t, g, unknown or other
  misc_feature (180)..(180): n is a, c, g, or t
  modified_base (233)..(233): a, c, t, g, unknown or other
  misc_feature (233)..(233): n is a, c, g, or t
tcagcgtctagtaccacgaccggtgctcgatttagtcacgcgagagggagcaccgtggagaagacagtggcccctacagaatgttcataggttcccaatctgaccccacccacgggagcctggacccctctctggctcgctctcctcacttctttgcattaggttctgtgtttctctagngctgactcgaggcctgctagtgtctggtgtaccttgggacagccagtcgaggntacatatgaccgtaaggcggaccgcctaggatctattatcgacaagcctgaccagcagaacgcgagtacgaccggcctgtacgttgctacgtctagtaagtaaaaccgtctcccggactacgacggacttcccgaggtaaccctcgttactcggtcgacctacctaacgtacaggaaaccgtaactcgtctacgaacctagtcctaggtccggtacgtacgtaacggaccggtaagtacggttaacgacggtacgttaaggtaaccgtttacggtaaaccgttacgggttaacccgttaaccgggtaacgtacccggtaaacgttccggttaaccggaaccccgttttaaaaccggtagtttaaacccgtcgggttttaaaaccccgggttaacccgggtaacgggttaaccggtaaccccgggttaaattacccccggggttaacgtttaacccggtaccgtaaaccggttaccccggaaccccggttaacctaaacccccggtaacccggtaacccgg

SEQ ID NO: 37929 - DNA, 883 bp, Homo sapiens
  misc_feature: GYAE6OF01AW19F.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacggggagcctggacccctctctggctcgctctcctcactctttgcataggttctgtggtttcttctgagctgactcacggaccctgctgtgtctggtggccttgggacagacagtcaggatcacatcgaccgaagggacggaccggccgtacggaacgtcctaatttaactcggacaaaggctacgggtaacccaaggaccaaggaaacgcccggaagggaaccgaaccgggtcccccctttaggtttaaccgtttcggttacctaactttaccgttaaacgttaaacggttaaaaaaaaccctcgttacccccgggtaccccttacggtaaccgggggtaacctacccccggaaaccggtaacccgtaacgtttccgtaccggttcggtacccttaacccgtaaaccctacgaaaaccggtaaacccaaccgtacgttaccctttacccgtacgtaaccctactaccgtacggtcggggtacctcgggaacgggaacggaagtacgtagggacggttcgttacgaacgtttacgttaacgttacggttaaacccggtttaccccgggaactaccgggacccgttaaggttacccggaacccctttaaaccccgttaagtttacgttccgtttaccggtttaacccgggtaaaccggtccgggtaaacccgtaacccgggttacccgtaaccccggtttacgtaccgggttaacccgaacccggtaaaccccgtaaccccggtaaacccccgtaacccccttaacccggg

SEQ ID NO: 37930 - DNA, 716 bp, Homo sapiens
  misc_feature: GYAE6OF01BY9ER.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccgaaggacgacggcctacggaagctagttatcgacaagtcctaggtacccagaccgaagaacggaccgaggaccgacggtcccctagttaccgttgtacctacgttactaagtaaggtaaaaacctcgtacccgacccgttacgaggactacccgaacgacccgtacttctccgtacggtacctacccgaactaccgtaaggaaaccaccgaacgtccttaccttcgaaccctataccgtacgtcgggacttacgaacgggacggaagtacgtagggaacgtcgtacgtaacgttacttaacgtacggtaaccgttacccgggactacgtcgtaacggttcaacccctaacccgtaagtttactcggttaccgttaacgggtaaccgtacgggtaaacccgtaacggttaccccgaacccgttcccggttaaggtacccgtacccggaaccccaacggacccccctaacccgtaaccg

SEQ ID NO: 37931 - DNA, 798 bp, Homo sapiens
  misc_feature: GYAE6OF01A6KIE.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggaccccctctctggctcgctctcctcactctttgcataggttctgtggtttctctgagctgactcaggaccctgctgtgtctgtggccttgggacagacagtcaggactacacatcgaccaagggacgaccggtccctacgggaagtccttaattacgtcgacaaggccgtacgggtacccaaggacacggaacgacccgaagggaccgaccggtacccccgtagttaccgttcgtacctaagttacctaagttaaaccgggtaaaaacctaccggtacccccgggacccgtaccggaaccggggtacccttacccccgaacgtaacccggttactttccgtaccggttacggacccgttaccccaaaccgtaaccggaaccgaaacctacgtaccgttacctttacccttaccgaaccctacgttaccgaacgggttcgggacctacggagggtacggaaacggtacgtaggacgtcgtacgtaaccgttaagtttaacgtacgttaaccggtaccccggagtacgtaccgtacgttaccctaaccgtaacccgtaatttaccggtacgttacccggttacgggaccgttaaccgggtaaccgtacgggttaacccacccggttcggtaaccggtcccaccggaccccgaaccgggcccctaaaccccggtacg

SEQ ID NO: 37932 - DNA, 679 bp, Homo sapiens
  misc_feature: GYAE6OF01AM3J7.14.66.F11.1.454.CMB.1.raw
  modified_base (287)..(287): a, c, t, g, unknown or other
  misc_feature (287)..(287): n is a, c, g, or t
  modified_base (535)..(535): a, c, t, g, unknown or other
  misc_feature (535)..(535): n is a, c, g, or t
tcagcgtctagtaccacgaccggtgctcgatttagtcacgcgagagggagcaccgtggagaagacagtggcccctacagaatgttcataggttcccaaactctgaccccacccacgggagcctggacccctctctggctcgctctcctcactctttgcataggttctgtggtttcttctgagctgactcacggaccctgctgtgtctgtggccttgggacagacagtcaggatcacatgccaaggagacggcctcggaagctattatgcaagctggtaccagcaganccaggacagccctgtacttgtcatactataggtaaaacacgtccccggccctacgacgggtacctccccgaacgacccgtattcctcgtcggtacctacccaactacgaaacggaaacacctacgtacctttccgtttaccgaaccctaattccaccggtcggggtacctacgaagggaccgggaagacgtaggtacggcgtacgtaccttaatttaccgttaacgttaaccggtttacccccggganacggacctagtccgacccttaaaccccttagttattacgtttccgttacggaaaccgttccggggaacccgtaacggtacccgtaccccggtacccgttacggtaccacggttaccccgaaccggaaccccgtaaccccctccg

SEQ ID NO: 37933 - DNA, 908 bp, Homo sapiens
  misc_feature: GYAE6OF01EC8J8.14.66.F11.1.454.CMB.1.raw
  modified_base (263)..(263): a, c, t, g, unknown or other
  misc_feature (263)..(263): n is a, c, g, or t
tcagcgtctagtaccacgaccggtgctcgatttagtcacgcgagagggagcaccgtggagaagacagtcggcccctacagaatgttcataggttcccaactctcgaccccacccgacggggagcctcggaccccctctctggctcgctcctcctcacttctttgctattaggttctggttggttttcttactgagtctgactcgacggaccctgctggtcgtcgtggtcggtccgttgggacagacagtcgaaggtatccacngtcgaccgaagggacggaccggaccgtacggaacgtcttaattactcggactaacggtccgtacggaccaagcgaaaggaaccgaccggaaggaccgaccggtcccgttagtaccgttgtacctacttacgtaagttaaacgaaaaccgtccggtacccggcctacggacggacctacccgaacgaccgttactcgtcgtcggacctaaccaacgtaccgaaacgtaaccacggtaccgttccttaccgtacgaaccgtctacccgggtaaccggttaccggggtacctaaccggggtaaaggggaccggttaaactcgggtaaccgggtccgtaccgtttaacgtaaacccggttttaattacccggttaacgggtttaacccgggttaaccccgggaacgtacgggtaaccgttaaccgggttacgtaaaccccccgtttaaaccggttaagtttacggtttaaccccgggttacgttaaacccgggggtaaccccgggtaaccgggttaacccgggttaaacccggttaaccccggggtaaacccccgtttcggggtaaacccccgggttaaacccgaaacccccgggtaaaccccccggtaacccgggtaacccccccctaaacccgggtttaaccccggg

SEQ ID NO: 37934 - DNA, 830 bp, Homo sapiens
  misc_feature: GYAE6OF01CBEJ9.14.66.F11.1.454.CMB.1.raw
  modified_base (77)..(77): a, c, t, g, unknown or other
  misc_feature (77)..(77): n is a, c, g, or t
  modified_base (121)..(121): a, c, t, g, unknown or other
  misc_feature (121)..(121): n is a, c, g, or t
tcagcgtctagtaccacgaccggtgctcgatttagtcacgcgagagggagcaccgtggagaagacagtggcccctanagaatgttcataggttcccaactctgacccccaccccacggganccctggaccccctctctggctcgctctcctcactcttgcattaggttctgttggtttcttctgagctgactcgacggtaccctgtctgttcgtcgtggtcgggtcccgttagggaaccaagacgagtacgaaggactccaacagtacgacccgaaagggacggaccggtacccgttacgggaacgtacgttaaactttaagacggaacgtaaacggtcgtaacggtaacccgagaccgtaagaaaccggaccggacgaaccgaccggtacccttgttaaccttgtactacttaaccgtaacggtaaagtaaaaaaccgtccgtacccggaccctacgacggtacctacccgaacgtactaacttctacgtcggactaaccaacgtaccaaagaaactacacgttcccttacgtacctaacctagtccgacggtacggaccgtacgaacggacggaagaacgttcggaagtacctaggttaaaccgtttaagttaaccgtttaacggtaacccggttaaccgggaaccgtacggtaacgtaaccggttaaccgtaacccgttaacccttaacgttttacgttacggtttaaccggtaacggttaaacccggtaaccgggaaaccggttaaacccgttcccggaacctttaccggtaacggtacccaacccgggtaaccccaaacccggttaccccgaaccccggttaacg

SEQ ID NO: 37935 - DNA, 816 bp, Homo sapiens
  misc_feature: GYAE6OF01BWWKJ.14.66.F11.1.454.CMB.1.raw
  modified_base (582)..(582): a, c, t, g, unknown or other
  misc_feature (582)..(582): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtcggccgttggacagacagtcgaggactcacatcgaccgtaagggacgacggccgtacggaacgtccttaattagcgacaaggtccgttacggtaaccgagacgaaggaacggtacccaaggggtaccaccgggtccccgttacggtttaccgtttacgtacctacttaccgtaaaggttaaacggtaaaaacccgcgttcccccggacccgtacggaaccggggtaccttaccccgaaacggtacccgtacgtttaccgtcgtcggtaccctaccgtaaacccgtaccggaaacggaaacctacgaacgttcctttaccgtacgaaccctacgtacggtaccggtcgggtaccgtacggaacgggaccgggtaanacggttaggacggttcgttaagtaaccgtttaattaccgttacgttaaccggtacccggacgtacgtaccgtagtacccgaacccttaacccgtaagttacgttacggtaccgttaaccgggtaaccggtacccggggtaacgtaaccccgggttccgtaacccggttaccggttaccgtacccgggtacccggaaccccggtaacccggtaaacccccgtacccgttaacccg

SEQ ID NO: 37936 - DNA, 800 bp, Homo sapiens
  misc_feature: GYAE6OF01CLZVG.14.66.F11.1.454.CMB.1.raw
  modified_base (76)..(76): a, c, t, g, unknown or other
  misc_feature (76)..(76): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
tcagcgtctagtaccacgaccggtgctcgatttagtcacgcgagagggagcaccgtggagaagacagtggccctanagaatgttcataggttcccaactctcgacccccacccacggggagcctcggacccctctctggctcgctctcctcacttctttgctattaggttctgttggtttcttctgacgctgactcgacggaccctgctgtgtctggtcgccgtgggacagactagtcaagntcactatcgacgaaggngacgtcggccgtacggaagtcttaattanacgacgaagcgtacgaaccgagcgaaggaccgtccgaacggaccgccggtcccgtagtaccttcgtactacgttactaaaggtaaacggtaaaacctccgtcccggtacccgtacggaacggtccctacccgtaacgaccgttactttcgtccgtaccgtaccctaccgtaaactacggaaaccgtaaacgaccgtacgttaccccttacgtacgaacccgttaacgtcccgggaagggttccggggtacctaacggggaacccggggtacggtaaacggttacggtcgggtaacgttaccgttaaggttaaccttttaaccgttaacgggtttaaccggtaaacccggggttcccggaaatccgtaccggtaacggttaccccttaaccctaaccggttattaccggtggtttaacccggtacgggtaacggtacccgaaccggttacgtaccccgttacggtccgtaaacggtccgtaacccaaccccggtaaacgtcccctaaaccccg

SEQ ID NO: 37937 - DNA, 773 bp, Homo sapiens
  misc_feature: GYAE6OF01C6HLG.14.66.F11.1.454.CMB.1.raw
  modified_base (254)..(254): a, c, t, g, unknown or other
  misc_feature (254)..(254): n is a, c, g, or t
  modified_base (470)..(470): a, c, t, g, unknown or other
  misc_feature (470)..(470): n is a, c, g, or t
tcagcgtctagtaccacgaccggtgctcgatttagtcacgcgagagggagcaccgtggagaagacagtggcccctacagaatgttcataggttccccaactctcgaccccacccacgggagcctcggaccccctctctggctccgctcctcctcactctttgcataggttctggttgtttctactgagtctgactcgacggaccctgctgtcgtctggtcgtcgtagggacagactacgtcaaggactcaaacncgtacggacccgaagggaccgaccggtccgtacgggaaagtccttaagttacgcggaacctaacgggtccgttacggtacccaaggtacgaaacggaaccggtacccgaaggaccggtacggtccccttaggttactccgacttagtagtaacgtaaagtaaaccgcgtccccggtaccaggtaccggtcctacccgtaacgtccgtactttccgngtccggacctacgacgtacgaaacgaaccttacgaccgttcttaaccgtacgaccgttaaccgcggtaacgtcggtacgtacggacgggacggtataggtacggacgtcggtcttaacgtacgtaaccgttacggttaaccgtacccggtacgtagtaccctcgtaaccggtaaccttaaccgttaacgttcttaccgttaaccggtaccgggtaaccggttaaccggacggtaacccggtcccggttaacgtacccgttcccggacgacccgtacccaacccgcccccgtaaccgttaccgg

SEQ ID NO: 37938 - DNA, 774 bp, Homo sapiens
  misc_feature: GYAE6OF01B2GPM.14.66.F11.1.454.CMB.1.raw
  modified_base (237)..(237): a, c, t, g, unknown or other
  misc_feature (237)..(237): n is a, c, g, or t
  modified_base (358)..(358): a, c, t, g, unknown or other
  misc_feature (358)..(358): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactcttgcataggttctgtggtttcttctgagctgactcacggaccctgctgtgtctgtcggccttgggacagacagtcaggatcacancgaccgaagggacgtacggccgtaggaagtctattatgacaagcgtacggtaccagacaggaacgccgaaggaccaccggtccctagtacttcgtactactactaagtaaggtaaaaaccncgtacccggaccctagacggtactcccgaacgaccgtacttcctcgtcggtactaccgtaacacgaacggaaaccactacgtccttaccgtacgtaacctacgtaccgcggttacggggacctacggaacgggacgggtaaactacggtagggtacggtacgttacgtaaactttacgtttaaccgtaacggttaacccgttaacccggggaccgtacggtaccgtaacggttaccccggtaacccttaaaaccccgtaagtttaacgttaccggttaaccggtttaaccgggaaaccgggttccgggtaaaccccgtaacgggtttcccctaaacccgggttacccgttaacgggtaaccccaaacccggtaacccccgggaaaccgtaaaccccccgtaaacccgttaacccgg

SEQ ID NO: 37939 - DNA, 807 bp, Homo sapiens
  misc_feature: GYAE6OF01AP4UY.14.66.F11.1.454.CMB.1.raw
tcagcgtctagtaccacgaccggtgctcgatttagtcacgcgagagggagcaccgtggagaagacagtggcccctacagaatgttcataggttccccaactctcgaccccacccacggggagcctcggacccctctctggctcgctctcctcactcttgcataggttctgtggtttctctgagctgactcgacggaccctgcttgtgtctggtcggtccgttagggacagacagtcgaggactcacacgtcgaccgaagggtacggaccggccgtacggaagtactattatcggaccgtaaggtccgttacggtacgaacgacgaaggaaccgaccgaacggtaccgaccggtccccttagttaccgttcgtaccgtaacttacgttaagtaaacggtaaaaccctaccggtaccccggtacccgtacggaacgggtaccctacccgaaccgtaccgtaacgtttccgtcgttcccgggtaccttacccgtaaccgttaacggaaaccgtaaacccgtacgttaccggtaaccttttacccgtacgtaaccccgtagttacccggtaccggggttaccggaccgtaacgggacgggtaacgggtaagcggtacgggacgtacgtacgtaacgtttattaccggttaaccggttaacgtaccggtaacgcgtcgaacgtacctaacccttaccgtaattccgtacggttaccgtaacgggtacggtaacggtaaccgtaccggtaccgtaccccgtaggtacccgtacccgtaaccggaaccccacccggtaccctacccggtacccg

SEQ ID NO: 37940 - DNA, 815 bp, Homo sapiens
  misc_feature: GYAE6OF01DFMZB.14.66.F11.1.454.CMB.1.raw
  modified_base (77)..(77): a, c, t, g, unknown or other
  misc_feature (77)..(77): n is a, c, g, or t
  modified_base (134)..(134): a, c, t, g, unknown or other
  misc_feature (134)..(134): n is a, c, g, or t
  modified_base (257)..(257): a, c, t, g, unknown or other
  misc_feature (257)..(257): n is a, c, g, or t
tcagcgtctagtaccacgaccggtgctcgatttagtcacgcgagagggagcaccgtggagaagacagtggcccctanagaatgttcataggttcccaactctcgaccccacccgacgggagcctcggacccctntcgtggctcgctctcctcactctttgcattaggttctgttggtttcttctgagctgactcgacggaccctgctgtgtcgtggtcggtaccgttgggaacagacgaggtcgaaggtactcaagngtacgaccgaaggacggaccggccgtaggaacgtcttaagttacgacgacgaacggtcgttacggaccaggacgaaacggaaccgaccgtaacgggaaccgacccgggttccccttaagttaccgttacgtaccttaagtaaccgttaaggtaaaaccggtaaacctccggtaccccggaccctaacgggaaccggacctaccccgtaacggtacccttacttccgtccggtaccggtaccctaacctaaaccggtaacggaaaaccgtaaaccgtccgttacccgtttacccgttacccgttacgaaccctacggtaaccgtccgggggtacggaccgtaaccggggaagggtaacggtaacggaacgttcggggaccgttaaacgttacgtaaccgttttaacgtaccgggttaacggttaacccggacgaacgtcggtaactacgtaccgtaacccttaacgtgttccgtacgtaaccgtacggaaccggtacgtacggtacgtacccttacggacgtcgaacccggacccaacccgccgaaacccctacgttcg

SEQ ID NO: 37941 - DNA, 656 bp, Homo sapiens
  misc_feature: GYAE6OF01B0XVR.14.66.F11.1.454.CMB.1.raw
tcagcgtctagtaccacgaccggtgctcgatttagtcacgcgagagggagcaccgtggagaagacagtggcccctacagaatgttcataggttccccaactctgaccccacccacgggagcctggaccccctctctggctcgctctcctcactctttgcataggttctgtggtttcttctgagctgactcaggaccctgctgtgtctgtggccgttggacagacagtcaggatcacatgccaaggagacggcctacggaacgctattatcgacaagctcggtacagcgagaacgaccaggacacggccctgtacttgtcatctaagtagtaaaacactaccggccctacgacgggactacccgacgacgacttctacgtcgcctaccactacgaacggaaacacacgtcctttacctacgtacctactacctaccgtgggccgtacgacgggtacggaagtagtggacggtacctggtaacttacgtttaccgttaaggttaacccgttaccgggacgtacgtacgtacgtacgtaccctaaacccgtaattcgttacgttaccgttaacgggtacgtacggggtaaccgaaccggttccgaaccccgttcgttacggtacgaccggacccgaacccgacccgaccccgtaacccg

SEQ ID NO: 37942 - DNA, 729 bp, Homo sapiens
  misc_feature: GYAE6OF01D1L6S.14.66.F11.1.454.CMB.1.raw
  modified_base (254)..(254): a, c, t, g, unknown or other
  misc_feature (254)..(254): n is a, c, g, or t
  modified_base (266)..(267): a, c, t, g, unknown or other
  misc_feature (266)..(267): n is a, c, g, or t
  modified_base (280)..(280): a, c, t, g, unknown or other
  misc_feature (280)..(280): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttctctgagctgactcacggacctgctgtcgtctgtcggccttgggacagcagtcaggatcacatcgaccgaaggagcggccncggagtctatannacagctggtaccngacaggacgcgagggacctcggtaccccgttagtaccgttcgactacgtacttaacgttaacggtaaaacctcgtacccggaccctacggaaccgggtaccgtaacccgtaaccggtacctactttacctacggttaccgacccttaaccaacgtacccgtaaacggaaacctaccgtacgttaccctttaccgttacgaacccttacgtacgtacggtacgggtacccttacggacgggaacgggaacgtacgtacgggtacgtaccgttagtaacgttactttaaccgtaggttaacccggttaccgggaactacgggtaaccgttacgtaccctaaccgtaacccgttaattaccgtcttaccgggttaacgtaccggtacggtaacccgttaacggtcccgaccgtaccgtacgaccgacggacccaaccggcccctaacgtccg

SEQ ID NO: 37943 - DNA, 859 bp, Homo sapiens
  misc_feature: GYAE6OF01C3WJH.14.66.F11.1.454.CMB.1.raw
  modified_base (50)..(50): a, c, t, g, unknown or other
  misc_feature (50)..(50): n is a, c, g, or t
  modified_base (469)..(469): a, c, t, g, unknown or other
  misc_feature (469)..(469): n is a, c, g, or t
tcagcgtctagtaccacgaccggtgctcgatttagtcacgcgagagggancaccgtggagaagacagtggcccctacagaatgttcataggttcccaactctcgaccccacccacgggagcctcgacccctctctggctcgctcctccctcacttctttgcagttaggtttctggttggttttcttcgtgagctgacctcgacggtaccctgtctgtgtcgtggtcggtccgtggacagacagtcgaagtactacactagtacgaccgaagggacgccgggtcccgtaaggaacgtactagttagtacgacgaacggtccgtacggacgacgacgaacgaacgaccgaacggaccgaccggtcccgttagttacgttcgtacgtactaacgttaacgtaaacgtaaaaccgtcccgtaccccggaccgtacgaaccggtacctacccgtaacgtacccgtacgtttccnccgttacggaccctaaccgtaaccgacgaaacgaacctacctacgttcccttaaccgttaccgtaacctacgttacccggacgggttcggggtacccgtaagggtaacgggaacggtaacggttagggtacggtacgtacgtttaacgtaacgttttaaccgttaaccgggttaacgggttaaacccggtacccgggtaacgtaccggtaaccgttaaccggttaacccgttaccccgtttaaacccgttaagtttaacccggttaccggttaaccggttaaccgggaaccggttaacccggggtaaccgtacccggtttaaccggcccgtttaaaccgggaccgttaaccccgaaccggacccccgtaaaccgccccctaaccgtaccg

SEQ ID NO: 37944 - DNA, 826 bp, Homo sapiens
  misc_feature: GYAE6OF01B94YU.14.66.F11.1.454.CMB.1.raw
  modified_base (185)..(185): a, c, t, g, unknown or other
  misc_feature (185)..(185): n is a, c, g, or t
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (400)..(400): a, c, t, g, unknown or other
  misc_feature (400)..(400): n is a, c, g, or t
  modified_base (527)..(527): a, c, t, g, unknown or other
  misc_feature (527)..(527): n is a, c, g, or t
tcagcgtctagtaccacgaccggtgctcgatttagtcacgcgagagggagcaccgtggagaagacagtggcccctacagaatgttcataggttccccaactctcgacccccacccgacggggacgccctcggaccccctctcgtggctcgctcctcctcacttcttgcatggttctgtgtttctngagntgactcacggccctntctgtntcgtggtcggccgtgggacagacgagtcgaggctacaacagtcgaccgaaagggacggaccggtccgtaaggaagtcttaagttagcgacaaggtcgtacggtaccaagcgaacggaaccgccgaacggaccggacccggtacccgttaggttaacgtgtacctagtacttaaagtaaacggtaaaaccncggtaccccggccctacggaccggtaccacccgtaacgaccgtacgttccgtaccgtccggaaccttcgaaacctacgaaaccgtaacgaccttacgtccctttaccgacgtaacctacgtacccgnggggttcggaccaacgggtacggacggtaagtaacggtcggaacgggtactacgtttaacgttaacgttacccgttaacgggttacccgtaacccggacgtggttaaccgtaacggttaccccgtaaaccctttaaccgaaagtttttcggtaacccggttaccgggttaacccggggaaccggtttaaccgggacccggttaaacgggttccccctacccggggttaacctaacccgggtacccggaacccccggtaaacccccggaaacccggttaaacccccgcccccgttaacgg

SEQ ID NO: 37945 - DNA, 829 bp, Homo sapiens
  misc_feature: GYAE6OF01ACGH8.14.66.F11.1.454.CMB.1.raw
  modified_base (232)..(232): a, c, t, g, unknown or other
  misc_feature (232)..(232): n is a, c, g, or t
tcagcgtctagtaccacgaccggtgctcgatttagtcacgcgagagggagcaccgtggagaagacagtggcccctacagaatgttcataggttcccaactctcgaccccaccccacggggacgcctggacccctctcgtggctcgctctcctcactctttgcattaggttctgttcggtttcttctgagctgactcacggaccctgctgtgtctggtcgcgttggacagacngtcgagatacacagtcgaccgaaggacgaccggccgtacggaagtcttattagcgacaacggtcgttacggaaccgagacgaacggtaacgaccgaacggtaccgaccggtcccttagttccgttacgtactaacgttacgtaacgtaaaacgtaaaaccgtccgtccccggacccgtacggaacggtaaccctaccggaaccgtaccgttacttccgtaccgtaccggtaaccctaaccctaaacccggtaacggaaaaccgtaaaaccgtaccgttaaccgttacccgtttacccgtacgtaaacccgtaccgttaaccgggacccgggttagggtaacccacggggtaaaacggggtaaccgggtaacgtacgggttaacggaacccgttcgtaaccgtttaaacgtttacgtaaccgggttaacggttaccccggttaaaccgggataccgggttaactacccgggttaacctaaaccccgttaaccttaagtttcgtaccggtacggttacccggaacgttaccgggaaccttaccggtacccgtaccgacggttaccgaccgacgaccccaacggtaccccctcgttaacg

SEQ ID NO: 37946 - DNA, 529 bp, Homo sapiens
  misc_feature: GYAE6OF02GXPSZ.14.66.F11.1.454.CMB.1.raw
  modified_base (326)..(326): a, c, t, g, unknown or other
  misc_feature (326)..(326): n is a, c, g, or t
  modified_base (450)..(450): a, c, t, g, unknown or other
  misc_feature (450)..(450): n is a, c, g, or t
tcagcgtctagtaccacgaccggtgctcgatttagtcacgcgagagggagcaccgtggagaagacagtggcccctacagaatgttcataggttcccaactctgaccccacccactggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacntccggccctcagggatcccagaccgatttctctggctccaactcaaggaaaccacagcttcctgaccatcactggggctcgaggcggaagatggaggctgactattactgtaacttcccggganagcagtcgacctaaacccattactgtcttacggaactgggaccaaggtcaccgtctaggtccagcccaggcccaacccg

SEQ ID NO: 37947 - DNA, 522 bp, Homo sapiens
  misc_feature: GYAE6OF02H7LTA.14.66.F11.1.454.CMB.1.raw
  modified_base (327)..(327): a, c, t, g, unknown or other
  misc_feature (327)..(327): n is a, c, g, or t
  modified_base (378)..(378): a, c, t, g, unknown or other
  misc_feature (378)..(378): n is a, c, g, or t
  modified_base (431)..(431): a, c, t, g, unknown or other
  misc_feature (431)..(431): n is a, c, g, or t
  modified_base (445)..(445): a, c, t, g, unknown or other
  misc_feature (445)..(445): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggaccccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacntccggccctcagggatcccagaccgattctctggctccaactcaggaaacncagcttcctgaccatcactgggctcgaggcggaagatgaggctgactattacngtaattcccggganagcagtgactaaaccccaattatgtcttcggaactgggaccaaggtccaccgtctaggtcagcccaaggccacccac

SEQ ID NO: 37948 - DNA, 517 bp, Homo sapiens
  misc_feature: GYAE6OF02G72JW.14.66.F11.1.454.CMB.1.raw
  modified_base (326)..(326): a, c, t, g, unknown or other
  misc_feature (326)..(326): n is a, c, g, or t
  modified_base (411)..(411): a, c, t, g, unknown or other
  misc_feature (411)..(411): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacntccggccctcagggatcccagaccgattctctggctccaactcaggaacacagcttcctgaccatcactgggctcagggcgaagntggaggctgactatactgtaattcccggganagcagtncctaaacccaattatgtcttcggactgggaccaggtcacgtctaggtcagcccaaggcccaaccctac

SEQ ID NO: 37949 - DNA, 511 bp, Homo sapiens
  misc_feature: GYAE6OF02IW0VD.14.66.F11.1.454.CMB.1.raw
  modified_base (326)..(326): a, c, t, g, unknown or other
  misc_feature (326)..(326): n is a, c, g, or t
  modified_base (377)..(377): a, c, t, g, unknown or other
  misc_feature (377)..(377): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacntccggccctcagggatcccagaccgattctctggctccaactcaggaaacncagcttcctgaccatcactgggctcaggcgaagatgaggctgactattactgtaattcccgggacagcagtgctaacccaattatgtcttcggactgggaccaaggtcacgtctagtcagccaaggccacccac

SEQ ID NO: 37950 - DNA, 545 bp, Homo sapiens
  misc_feature: GYAE6OF02IEBIH.14.66.F11.1.454.CMB.1.raw
  modified_base (344)..(344): a, c, t, g, unknown or other
  misc_feature (344)..(344): n is a, c, g, or t
tcagcgtctagtaccacgaccggtgctcgatttagtcacgcgagaaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgcagcacccagggaaggcctggagtggattggctacatctatcacagtgggagcaccccatacaacccgtccctcaatagtcgacaaaaccatatcagttgacacgtctaagaaccagttctccctgaagctgagctctgtnactgccgcggacacggccgtgtattactgtgcgaggtcgattgtgatggtaacaactgcttcttactcctttgacctagtcggggccgggaaccctggtcaccgtctcttcacgcctccaccaacggcccacgtccgtccttccccctcggcccaccctccctcccaacgacgcaccctcgtcggggctaccgagtcccgg

SEQ ID NO: 37951 - DNA, 510 bp, Homo sapiens
  misc_feature: GYAE6OF02IS2ZC.14.66.F11.1.454.CMB.1.raw
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggaccccctctctggctcgctctcctcactctttgcataggttctgtggtttcttctgagctgactcaggaccctgctgtgtctgtggccttgggacagacagtcaggatcacatgccaaagggagacggcctcggaagctattatgcaagctggtaccagcagaagccaggacaggcccctgtacttgtcatctataggtaaaaacatccggccctcagggactcccagaccgattctctggctccaactcagaaacacagcttcctgaccatcacgtgggctcaggcgaagatgagctgactatactgtaacttcccggganagcagtcnctaaacccaatntgtcttcggactggaccagtcacgtcagtcagccaagccaccac

SEQ ID NO: 37952 - DNA, 512 bp, Homo sapiens
  misc_feature: GYAE6OF02IJ4XN.14.66.F11.1.454.CMB.1.raw
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaacatccggccctcagggatcccagaccgattctctggctccaactcaggaacacagcttccttgaccatcactgggctcgaggcgaagatgagctgactatactgtaattcccgganagcagtnactaacccaattatgtcttcggaactggaccaggtcacgtctaggtcagcccaaggtccacccacg

SEQ ID NO: 37953 - DNA, 519 bp, Homo sapiens
  misc_feature: GYAE6OF02GS3YX.14.66.F11.1.454.CMB.1.raw
  modified_base (442)..(442): a, c, t, g, unknown or other
  misc_feature (442)..(442): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctggaagctattatgcaagctggtaccagcagaagccaggacaggcccctgtacttgtcatctatggtaaaaacatccggccctcagggatcccagaccgattctctggctccaactcaggaaacacagcttccttgaccatcactgggctcaggcgaagatgaggctgactattactgtaattcccggganagcagtcgctaaacccaattactgtcttcggaacgtgggaccaaggtcaccgtcgtagtcagcccaagccaccctac

SEQ ID NO: 37954 - DNA, 521 bp, Homo sapiens
  misc_feature: GYAE6OF02H9MFT.14.66.F11.1.454.CMB.1.raw
  modified_base (324)..(324): a, c, t, g, unknown or other
  misc_feature (324)..(324): n is a, c, g, or t
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
  modified_base (441)..(441): a, c, t, g, unknown or other
  misc_feature (441)..(441): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggccctgtacttgtcatctatggtaaaacntccggcctcagggatcccgagaccgattctctcggctccaactcaggaaacncagcttcctgaccatcacgtgggctcaggcgaagntgagctgactattactgtacttcccggganagcgagtcgctaacccaattagtgtcttacggacgtggaccaggtccacgtcctaggtcacgcccaacggcccacccacg

SEQ ID NO: 37955 - DNA, 561 bp, Homo sapiens
  misc_feature: GYAE6OF02GSALE.14.66.F11.1.454.CMB.1.raw
  modified_base (326)..(326): a, c, t, g, unknown or other
  misc_feature (326)..(326): n is a, c, g, or t
  modified_base (462)..(462): a, c, t, g, unknown or other
  misc_feature (462)..(462): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgcatctataggtaaaaacntcccggccctcgagggactcccgaagaccgattcctctggcctccaactcaaggaaaccacagtccttccttacgacctatcacgtgggctcgagggcgaagagtgaggctgactattactgtaacttcccggganagcagtcgacctaaaccctaattactgttacgttacggaacgtgggaacctagggtccaccggtacctaggtcacggcccaacggccccaacccgtacg

SEQ ID NO: 37956 - DNA, 541 bp, Homo sapiens
  misc_feature: GYAE6OF02GT916.14.66.F11.1.454.CMB.1.raw
  modified_base (327)..(327): a, c, t, g, unknown or other
  misc_feature (327)..(327): n is a, c, g, or t
  modified_base (416)..(416): a, c, t, g, unknown or other
  misc_feature (416)..(416): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctataggtaaaaacntccggcctcagggactacccagaccgattctctggctccaactcaaggaacacagcttcctgaccatcacgtgggctcgaggcggaagntgagctagactattacgtgtaacgtcccggacagcagtgacctaaacccgaattactcgtcttacggaacgtcgggaaccaaggtccaccgtcgtaggtcacgacccaaggccctaacccgtacg

SEQ ID NO: 37957 - DNA, 570 bp, Homo sapiens
  misc_feature: GYAE6OF02GZJ5Q.14.66.F11.1.454.CMB.1.raw
  modified_base (325)..(325): a, c, t, g, unknown or other
  misc_feature (325)..(325): n is a, c, g, or t
  modified_base (417)..(417): a, c, t, g, unknown or other
  misc_feature (417)..(417): n is a, c, g, or t
  modified_base (454)..(454): a, c, t, g, unknown or other
  misc_feature (454)..(454): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgcatctatggtaaaaacntcccggccctcagggactcccagaccgattctctggctccaactcaggaaacacagcttctcgaccatcacgtgggctacgaggacggaagngtagaggctgacttattacgtgtaacgttcccggganacgcagtcgacctaaaccctaattactcgttacgttcggtaacgtcgggaacctaacgggtccaacccgttcgtaacggtcctacggaccccgaaacggaccccaaccccgtaccg

SEQ ID NO: 37958 - DNA, 553 bp, Homo sapiens
  misc_feature: GYAE6OF02I27US.14.66.F11.1.454.CMB.1.raw
  modified_base (326)..(326): a, c, t, g, unknown or other
  misc_feature (326)..(326): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
  modified_base (417)..(417): a, c, t, g, unknown or other
  misc_feature (417)..(417): n is a, c, g, or t
  modified_base (451)..(451): a, c, t, g, unknown or other
  misc_feature (451)..(451): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggaccctctctggctcgctctcctcactctttgcataggttctgtggtttcttctgagctgactcaggaccctgctgtgtctgtggccttgggacagacagtcaggatcacatgccaaagggagaccggtcctcggaagctattatgcaagctggtaccagcagaagccaggacaggcccctgtactgtcatctatgtaaaacntccggacctcagggactcccagaccgattctcnggctaccaactcaaggaaacncacgcttactacgaccatcactgggctgaggcggaanatggagctagacttatacgtgtaacgttccgganagcagttcgaacctaacccaattatcgtcgttacggaactcgggaacctacggtacacccggtactacggtctacgaccccgtaaaggccccaaaccctacg

SEQ ID NO: 37959 - DNA, 606 bp, Homo sapiens
  misc_feature: GYAE6OF02H2TFG.14.66.F11.1.454.CMB.1.raw
  modified_base (247)..(247): a, c, t, g, unknown or other
  misc_feature (247)..(247): n is a, c, g, or t
  modified_base (329)..(329): a, c, t, g, unknown or other
  misc_feature (329)..(329): n is a, c, g, or t
tcagcgtctagtaccacgaccggtgctcgatttagtcacgcgagagggagcaccgtggagaagacagtggcccctacagaatgttcataggttcccaactctcgaccccacccacggggagcctcggacccctctctggctcgctctcctcactctttgcataggttctgtggtttcttctgagctgactcaggaccctgctgtgtctgtggccttgggacagacagtcaggatcacatgccaaggngacggctcggaagctattatgcaagctggtaccagcagaacgccaggacacggcccctgtacttgtcatctataggaaaacnctccggccctgaggctcccagaccgattctctggcctaccaactcaaggaaacacacgtctttcctacgaccatcacgtggggctcgagggcggaaagagtggacggctagaacttattacgttagttaaaccgttcccgggacacgtacacgttcgaccctaaaccccgtaattacgttacgttccgttaccgggaacgtcggggaacctaacgggtcccaacccggttccgtaacggttaccaacgaccccgaaacggtcccccaaccccgtacg

SEQ ID NO: 37960 - DNA, 549 bp, Homo sapiens
  misc_feature: GYAE6OF02JZWI3.14.66.F11.1.454.CMB.1.raw
  modified_base (284)..(284): a, c, t, g, unknown or other
  misc_feature (284)..(284): n is a, c, g, or t
  modified_base (324)..(324): a, c, t, g, unknown or other
  misc_feature (324)..(324): n is a, c, g, or t
  modified_base (413)..(413): a, c, t, g, unknown or other
  misc_feature (413)..(413): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggccctgctgtgtctgtggccttgggacagacagtcaggatcacatgccaagggagacgcctcggagctattatgcaagctggtaccagcagaanccaggacacggccctgtacttcgcatctataggtaaaacntccggcctcgaaggctcccgagaccgattcgtactggctccactcaggaacacagcttctgaccatcgacgtgggctcgtaggcgaagntggagctagattactacgtagtaagttcccggactagcgtagtcgaacctaacccaagttatcgtacttacggacgtcggaactaaggtaccctaccgtcgtaacggctaaccgccgacggtaccccacccgtacg

SEQ ID NO: 37961 - DNA, 547 bp, Homo sapiens
  misc_feature: GYAE6OF02JJR2X.14.66.F11.1.454.CMB.1.raw
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (475)..(475): a, c, t, g, unknown or other
  misc_feature (475)..(475): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttctctgagctgactcaggaccctgctgtgtctgtggccttgggacagacagtcaggatcacatgccaaggagacggcctcggaagctattatgacaagctggtaccagcagaagccaggacaggcccctgtactgtcatctataggtaaaacntccggccctnaggactcccagaccgattctctcggcctaccaactcgaaggaaaccacacgtccttaccttgaccatacacgtggctcaggcgagatagagctgactatactgtaacgttccggacagcagtcgacctaacccagttacngttacgtcgaacgtcggaactacggtccaccgttcctacggtccacgtacccgaaggcccctaacccgtacg

SEQ ID NO: 37962 - DNA, 561 bp, Homo sapiens
  misc_feature: GYAE6OF02GWF94.14.66.F11.1.454.CMB.1.raw
  modified_base (328)..(328): a, c, t, g, unknown or other
  misc_feature (328)..(328): n is a, c, g, or t
  modified_base (457)..(457): a, c, t, g, unknown or other
  misc_feature (457)..(457): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaagggagacggcctcggaagctattatgcaagctggtaccagcagaagccaggacaggcccctgtacttgtcatctataggtaaaaacntccggccctcagggactcccagaccgattctctggctccaactcaaggaaacacagcttccttcgaccatcacgtggggctcgagggcggaagagtgaggctgactattactgttaacgttcccggganacgcagtcgacctaacccaattactgtcgttacggaacgtcgggaacctaaggtcctaccgttccgtacggtcaccggaccccgaacggccccaaccccgtacg

SEQ ID NO: 37963 - DNA, 559 bp, Homo sapiens
  misc_feature: GYAE6OF02IGFKJ.14.66.F11.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (383)..(383): a, c, t, g, unknown or other
  misc_feature (383)..(383): n is a, c, g, or t
  modified_base (418)..(418): a, c, t, g, unknown or other
  misc_feature (418)..(418): n is a, c, g, or t
  modified_base (451)..(451): a, c, t, g, unknown or other
  misc_feature (451)..(451): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggntcacatgccaaggngacggcctcggaagctattatgcaagctggtaccagcagaagccaggacaggcccctgtacttgtcatctatacgtaaaacactccggccctcacggactcccagaccgattctctcgctccaactcgaacgaacacancttcctgaccatcacgtgggcctcgaggcggaagngtagaggctgactatactgtaacgtcccggganacgcacggtcacctaaacccgattacgtgttaccttacggaacgtcgggaacctaacggtcctaaccgtcgtacggtacgaccgacccgaacggcccaacccgtaccg

SEQ ID NO: 37964 - DNA, 524 bp, Homo sapiens
  misc_feature: GYAE6OF02F25TM.14.66.F11.1.454.CMB.1.raw
  modified_base (325)..(325): a, c, t, g, unknown or other
  misc_feature (325)..(325): n is a, c, g, or t
  modified_base (357)..(357): a, c, t, g, unknown or other
  misc_feature (357)..(357): n is a, c, g, or t
  modified_base (451)..(451): a, c, t, g, unknown or other
  misc_feature (451)..(451): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctggaagctattatgcaagctggtaccagcagaagccaggacaggcccctgtacttgtcatctatggtaaaaacntccggcctcgaggactcccagaccgattctcnggctcaactcaggaacacagcttctgaccatcacgtgggctcgaggcgaagatgagctgactattacgtagtaacgtacccgggacagctagtnacctaaccctaattactgttctcggaactgggaacctaggtcaccgtctaggcacgcccacggccaaccctcg

SEQ ID NO: 37965 - DNA, 571 bp, Homo sapiens
  misc_feature: GYAE6OF02GBUYL.14.66.F11.1.454.CMB.1.raw
  modified_base (325)..(325): a, c, t, g, unknown or other
  misc_feature (325)..(325): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgcatctataggtaaaacntccggccctcgagggactccagaccgtattctcgtcggctaccaactcaacggaaacacagtcttcctagaccatcacgtgggctcgagggacggaagatggacgctgtactattactagtaacgtccggacagcagtcgacctaaaccctaagttacgtcgttacgttacggaacgtacgggaacctaacgggtccgtaaccgttccgtacggtaccaccgacccgaacggacccaacccgtacg

SEQ ID NO: 37966 - DNA, 672 bp, Homo sapiens
  misc_feature: GYAE6OF02I9V9K.14.66.F11.1.454.CMB.1.raw
  modified_base (327)..(327): a, c, t, g, unknown or other
  misc_feature (327)..(327): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgaccaaggagacggcctacggaagctattatgcaagctggtaccagcagaagccaggacacggccctgtactgtcatctatacgtaaaacnctccggacctacgacggactacccgaagaccgtattctcgtcggccttaccaactcaacggaaaccactacgtcctttaccttacgaccctacttcgaaccgttcggggcctacggagggaccggaaagtagttagggacggcgtagtaaccttaattaccgtaggttaaccgttaccccggggaactacggaccgtaacggttaccgtaacccttaaacccgttaaatttacgttaccgttaccgttaccggaaccggttaccgggaaccttaacggtacccgtaccggttacccgtaaggtaccgaacccggtacccgaaccggtaccccaaccccgtaaccg

SEQ ID NO: 37967 - DNA, 770 bp, Homo sapiens
  misc_feature: GYAE6OF02H8319.14.66.F11.1.454.CMB.1.raw
  modified_base (265)..(265): a, c, t, g, unknown or other
  misc_feature (265)..(265): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctacggagctattangcaagctggtaccagcagaagcaggacacggcccctgacttgtcatctatacggtaaaaacacgttccggacccgtacgaacggggactacccccgaaggtaaccccggtaatttccgttacgttcgggtaccctaccccgtaaaaccttccgaaaacggggtaaaacccaacgtaaccgtaccgttttacccgttacgggtaaacccctaacgtttacccgaaccggttaccggggggtaccttaccggaacgggggtacccgggaaaagtaacggttacgggaacggggtacttacgggtaaaccttaaagtttaaccgttaacggttaaaaccggtttccccggggaactaacggtaccgtaacggttacgtaaccccgtaaaaccctaaacgttttagtaccggttaccgttaccgggtaacggtccgggaaaccgtacggtaccgtaacccgtccgttaggtaccgaaccgtaccccggaaacggtccccaacccgtacg

SEQ ID NO: 37968 - DNA, 641 bp, Homo sapiens
  misc_feature: GYAE6OF02JX8AW.14.66.F11.1.454.CMB.1.raw
  modified_base (332)..(332): a, c, t, g, unknown or other
  misc_feature (332)..(332): n is a, c, g, or t
tcagcgtctagtaccacgaccggtgctcgatttagtcacgcgagagggagcaccgtggagaagacagtggccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagtacggcctggaagcgtaattatgacaagctggtaccagctagaacgccaggacacggccctagtacttgcagtctaataggtaaaacnctccggacctcgagggactcccgagtaccacttctcgtgacgtaccaactcaacggaaacacagtccttacgtcaccgtactcgaacgtcgggactcgaaggaccggtaagattaggacggtctagtactaagttacttaacggtaacgttcccgggaacgtacgtacgtacggttacgtaacctaaaccccggaaatttacgttacggttacgttcggaaacccggttgggaaacctagggtcccgttaaccggtcccgttaacgggtacgaccgtaccccgaacgggtaccctaacccccgtaacgg

SEQ ID NO: 37969 - DNA, 549 bp, Homo sapiens
  misc_feature: GYAE6OF02GPT9S.14.66.F11.1.454.CMB.1.raw
  modified_base (451)..(451): a, c, t, g, unknown or other
  misc_feature (451)..(451): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgcatctataggtaaaaacatccggccctcaggggactcccagaccgattctctggctccaactcaaggaaacacagcttcctgaccatcacgtgggctcgagggccggaagatgaggctgactattactgtaacttcccggganagcagtcgacctaaacccaattactgtacttacggaacgtgggaacctaagggtcctaccgtcctaggtccacgaccccgaaggccccaacccctacg

SEQ ID NO: 37970 - DNA, 620 bp, Homo sapiens
  misc_feature: GYAE6OF02IMMRH.14.66.F11.1.454.CMB.1.raw
  modified_base (245)..(245): a, c, t, g, unknown or other
  misc_feature (245)..(245): n is a, c, g, or t
  modified_base (328)..(328): a, c, t, g, unknown or other
  misc_feature (328)..(328): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttctctgagtctgactcaggaccctgctgtgtctgtggccttgggacagcagtcaggatcacatgaccaagggnacggtcctaggaagctatatgcaagctggtaccagcagaacgccaggacacggccctgtactgtacatctaataggtaaaacngtcccggcctacgaggactcccgagaccgatttccgcgtcgacctccaactacgaacgaaacacagtccttactcgtaccactcaagtcgggactacgacggacggaagtatcggacggtctacgtaacttagttaaccgttaggtaaccgtttacccgggaacagtaccgtacgttacggacccttaaacccgtaatttacgtagttaccgtacggtaacgtcgggtaaccgtaggtaccctaccggtaccgttacggactaccgacccgtaacgtaccccgaaccctacg

SEQ ID NO: 37971 - DNA, 674 bp, Homo sapiens
  misc_feature: GYAE6OF02IO5GW.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgaccaaggagacggcctacggaagctattatgcaagctggtaccagcagaacgccaggacacggccctgtacttgtcatctataggtaaaacatccggccctcgagggactacccgaagaccgtacttactcgtcggtcctaccaactcgaacggaaaccacgaacgtcctttacccttacgaaccctaatccgaacgtcggggccttacgaacgggaccggaaagtagtacggaacggtcctacggtaaccttaagtttaaccgtacggtttaaacgttaccccggggataaccgtaccgtacgtacgtaccctaaaccccgtaaagttacgtacgttccgttacggtaaccggtacgggaaccgtaacggttaccctacccggttaccgttaacggtccgtaccgtacccgaaaccggtaccccaaccccgtaacg

SEQ ID NO: 37972 - DNA, 738 bp, Homo sapiens
  misc_feature: GYAE6OF02H1AKB.14.66.F11.1.454.CMB.1.raw
  modified_base (179)..(179): a, c, t, g, unknown or other
  misc_feature (179)..(179): n is a, c, g, or t
  modified_base (221)..(221): a, c, t, g, unknown or other
  misc_feature (221)..(221): n is a, c, g, or t
  modified_base (267)..(267): a, c, t, g, unknown or other
  misc_feature (267)..(267): n is a, c, g, or t
  modified_base (342)..(342): a, c, t, g, unknown or other
  misc_feature (342)..(342): n is a, c, g, or t
tcagcgtctagtaccacgaccggtgctcgatttagtcacgcgagagggagcaccgtggagaagacagtggccctacagaatgttcataggttcccaactctgaccccacccacgggagcctggacccctctctggctcgctctcctcactcctttgcataggttctgtggttcttctgngctgactcaggaccctgctgtgtctgtgccttgggacagacngtcaggatcacatgccaaagggataccggcgtacggaagctattangacaagctggtaccagcaggaaacgcctaagggacacggcccctgtaacttgtacatctaagtacggaaaaaacncttcccggaccttacgaaggggacctacccgaacggaacccgatttccgcgttacggcccttacaaaccttcgaaagggaaaaccaccgtaaggtccctttttaccgtaccgtaaccaaccgtttaacacccgttagggggaaccttcggaaacgggacgggtaaacgacgttagggaacggtcgtagtaaacgtaattaaccggttagtaaaccgttaccccggggacagtcccgaaggttaccgaacccgtaaaccctaaaagtttacgtaggttccctttaacgggtaacccgtggggtaaaccctaacgggttacccttaaaccccgttccgggttaacggtacccgaaccggtaaccccgaaccgggtaccccctaaccccgttaacccgg

SEQ ID NO: 37973 - DNA, 521 bp, Homo sapiens
  misc_feature: GYAE6OF02IB1UT.14.66.F11.1.454.CMB.1.raw
  modified_base (467)..(467): a, c, t, g, unknown or other
  misc_feature (467)..(467): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtactgtcatctatggtaaaaacatccggccctcagggatcccagaccgattctctggctccaactcaggaaacacagcttcctgaccatcactggggctcgaggcggaagatgaggctgactatactgtaacttcccgggacagcagtgcctaaacccaattacngtcttcggacgtggaccaggtccaccgtccgtgtcagcccaggcccaccctacg

SEQ ID NO: 37974 - DNA, 601 bp, Homo sapiens
  misc_feature: GYAE6OF02H6QDD.14.66.F11.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
  modified_base (502)..(502): a, c, t, g, unknown or other
  misc_feature (502)..(502): n is a, c, g, or t
tcagcgtctagtaccacgaccggtgctcgatttagtcacgcgagagggagcaccgtggagaagacagtggcccctacagaatgttcataggttcccaactctgacccacccacgggagcctggaccctctctggctcgctctcctcactcttgcataggttctgtggttcttctgagctgactcaggaccctgctgngtctgtggccttgggacagacagtcaggatcanatgccaagganacggcctaggaagctatatgcaagctggtaccagcagaagccaggacaggccctgtactgtcatcataggtaaaaacntccggcctcgagggactccaagaccgattctactggcctaccaaactcgaaaggaactacagtctaccgttagaccatacacgtcgggctcgagggacgaagtatcggaaggctacggatacgttacgtagtaaaccgttccccgggaatacgccgtaagtcgaaccttaaacccaaagtttnaacggttccttaacgggtaacgtacgggtaaccaagggtcccaacccggtctttaacgggacccaaggtaccccggaaaggacccctaacccctaaccg

SEQ ID NO: 37975 - DNA, 660 bp, Homo sapiens
  misc_feature: GYAE6OF02GJIBT.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacggggagcctggacccctctctggctcgctctcctcactctttgcataggttctgtggtttcttctgagctgactcaggaccctgctgtgtctggtggccttgggacagacagtcaggatcacatgaccaaggagacggcctacggaagctattatgacaagctaggtaccagcagaacgccgaggacacggcccctgtacttgtacatctataacggtaaaacacgtcccggccctcgacggggtactaccccgagtaccgtattaccgtctcggcctacccaactacgaacggaaccacacgtccttaccgtacgaccatccgacgtcgggctacggacggacggaagtgtaggaggtctagtactatttaaccgttagtaaccgtttacccgggactacgtaccgtacgttaccgaaccttaaaccccgtaattactccgttacgttaacgaaccgggtaccgggaaccgttaacgggtacccgtaacccgttaccgttacggtacccgaccgaccccgaaccggtaccccaccccgttaaccg

SEQ ID NO: 37976 - DNA, 613 bp, Homo sapiens
  misc_feature: GYAE6OF02HMHAZ.14.66.F11.1.454.CMB.1.raw
  modified_base (329)..(329): a, c, t, g, unknown or other
  misc_feature (329)..(329): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtgccttgggacagacagtcaggatcaacatgccaaggagacggcctggaagcgtattatgacaagctggtaccagacagaagccaggacacggccctgtacttgtcatctataggtaaaaacngtccgcctcgaggactcccgagaccgtattcgtctcggctaccaactcgaaggtaaaccacagtccttaccgtacgaaccctatacacgtcgggtctacgacgggacggaagagtggagtctagacttatacgtagtaacgttccggactagcgtaagtcgtaacctaaaccctaagttactacggttacgttacggtaaaccggttgggaaccctaacggtaccgaacccgttaccgtacggttaccgacggtaaccccgaacggacccctaacccctaccgg

SEQ ID NO: 37977 - DNA, 678 bp, Homo sapiens
  misc_feature: GYAE6OF02HYE0G.14.66.F11.1.454.CMB.1.raw
  modified_base (244)..(244): a, c, t, g, unknown or other
  misc_feature (244)..(244): n is a, c, g, or t
  modified_base (322)..(322): a, c, t, g, unknown or other
  misc_feature (322)..(322): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggnacggctacggagctattatgcagctgtacagcagagccaggacacggcccctgtacttgtcagtctataggtaaaacncgtccgcctcgaggtactcccgacgaccgtattcctacgtcggcctacaactacgaaggaaacacgtacgtacctttaccgttcgaacctactaccgacgtcggggtaccttacggaacgggtacgggaaaggacttacgggaacggtccgttaggtaaccttagtttaaccttaggttaaccgtttacccgggaactacgtacgtaacgtaccgaaccttaaacccgtaagtttacgtcgttaccgtttaacggaaccgttacggggaacccgtaacgggttacccgtaacccggttccgttaacggttacccgaaccggtaccccgaacgggtaccccctaaccccgtaacccg

SEQ ID NO: 37978 - DNA, 560 bp, Homo sapiens
  misc_feature: GYAE6OF02IZBBP.14.66.F11.1.454.CMB.1.raw
  modified_base (325)..(325): a, c, t, g, unknown or other
  misc_feature (325)..(325): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (466)..(466): a, c, t, g, unknown or other
  misc_feature (466)..(466): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgaccaaaggagacggcctggaagctatatgcaagctggtaccagcagaagccaggacacggccctgtacttgcatctataggtaaaacntcccggccctcgagggactcccagtaccgattctctcggctaccaacgtcaggaaacncagcttcctnacccatcacgttgggctcgaggacggaagagtgacggcttagaaccttattaccgtagtaacgttcccggaanacgcgagtcgacctaaacccattactcgtcgttacggaacgtcggaacccgaggtccaccgtaccgtaggtcacgaccacggacccaccctacg

SEQ ID NO: 37979 - DNA, 564 bp, Homo sapiens
  misc_feature: GYAE6OF02GGNPG.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctataggtaaaaacatccggccctcgagggactcccagaccgattctctggctaccaactcaaggaaacacagcttcctcgaccactcacgtgggctcgagggcggaagagtgaggctagactatactgtaacttccgggacacgcagtcgacctaaaccccgaattactgtccgttacggtaacggtcgggaaccaacgggtccacccggtacctacggtcaccgacccgaacggacccaaccccgtaccg

SEQ ID NO: 37980 - DNA, 702 bp, Homo sapiens
  misc_feature: GYAE6OF02FYE7L.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtgtttcttctgagctgactcaggaccctgctgtgtctgtggccttgggacagacagtcaggatcacagtgaccaaggacgacggcctcggaagctattatgacaagtctggtaccagcgaagaacgccgaggacgacggcccctgtacttgtacatctaagtaggtaaaactgtacccggccctacgacgggtactacccgacgaaccgtacttccgtacgtcggacctacccaacgtacgtaaacggaaacctacgaacgtacctttacccttacgaaccctaactaccgtaccgtaggggtcctacggaacgggaaccggtaaagtagttacggacggtcgttacgaaccgtttagttaaccgttacggttaaccggtttaacccgggacaacggtacgtacggttacgaacccgttaaacccgtaattaaccgttacgtttaccgtacggtaaaccgttcgggtaacccttaaggtcccttaaccgtacgtacggttaccgaccgtacccgaaccgtacccaacccgtaccg

SEQ ID NO: 37981 - DNA, 956 bp, Homo sapiens
  misc_feature: GYAE6OF02G9050.14.66.F11.1.454.CMB.1.raw
tcagcgtctagtaccacgaccggtgctcgatttagtcacgcgagagggagcaccgtggagaagacagtggcccctacagaatcgttcaataggttcccaactctgaccccaccccacgggagcctggacccctctctaggctcgactctcctcactctttgcataggttctgtggtttcttctgagctgactcaggaccctgctgtgtctgtggccttgggacagacagtccaggatcacatgaccaaggacgacggccgtacgggaagccttaagttaatcgtaccgaacggtccgtacgggttaaccccgaggaccgaaaggaaaaccggtaccccgaaacgggggtaaccgtaaccgggggtacccccccgtttagggtttaacccgttttacgggttacctaacgtttacccggttaaacggttaaccggggtttaaaaaaaaacccgtaccggttaccccccgggggtaacccccgtttaaccgggaacggggggtaacccttacccccggtaaaccgggtaaaccccgggtaacttttacccgtacccggttacgggtacccgtttaaccccgtaaaaccgttacccggaaaacgggtaaaaaccctaaccggtaacggttacccttttaacccggtttaccgaaaccccttacgttaacccggtaaccgggttacgggggtacccttaccgggaacggggaccgggaaaaggtaacggtacgggaacgggtaccgttaaggtaaaccgttaacgtttaaccggttacggttaaaccggttaccccggggaacgtaccggtacgtacgttaccgtaacccgttaaaccccttaagtttacgtacgtttaccgttacgggtaaccgtaccgggtaacccgtaacggtacccgtaacccggttccgtaacggtccgaaccggacccgtaaccggtaccccaacccgtaccgg

SEQ ID NO: 37982 - DNA, 701 bp, Homo sapiens
  misc_feature: GYAE6OF02IN1GT.14.66.F11.1.454.CMB.1.raw
  modified_base (178)..(178): a, c, t, g, unknown or other
  misc_feature (178)..(178): n is a, c, g, or t
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (265)..(265): a, c, t, g, unknown or other
  misc_feature (265)..(265): n is a, c, g, or t
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactcttgcataggttctgtggttcttctgngctgactcaggccctgctgtgtctgnggtccttgggacagacagtcaggatcacntgaccaagggagaccggctcggaagctattangcaagctggtaccagcaagaagcctaggacacggtcccctggtacttcgtcatctaataggaaaaacntcccggcctcgagggactccgagccgattcncgtgactccaactcgaacgtaaaccacacgtacgtaccttacgaacccatacgtaaccggttcgggaccgttaaccgacgggtaaccgggaaagtaccggtaggacgggtaccgttacgtaacgttaacttacgttacggtaaccgtttacccgggaacgtacgtacgaacggttaccggaacccttaaaccccaaagtttaccgtaccggttaccgttaaccgggtaaccgttaacggggaaccccgtaaacgggttaacccgaccccggtttaccggtaacggtacccgtaaaccgtacccccgggaaagtacccccgtaaaccccgtaacccgg

SEQ ID NO: 37983 - DNA, 748 bp, Homo sapiens
  misc_feature: GYAE6OF02JIRSA.14.66.F11.1.454.CMB.1.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (348)..(348): a, c, t, g, unknown or other
  misc_feature (348)..(348): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgcttgtgtctggtgccttgggacngacagtcaggatcanatgccgaaagggagtaccggcctcggaacgcgtaattactgaccaaagctaggtacctagcagaagccaggacacggaccccgtagtacttcgtcgatcctatacggtaaaanacgtaccgaccctacgacgggtactaccgacgtaccgacttacctgtcggacgtacctaacgtcaaacgggaacaaccgagtacccgtttactcgtaacctacaccgtaacgtggggtacctacgtacgggaccggtaaggaacgttcgggaacgtcgttacgaacgtttacgtaacgtttacggttaaacgggtttacccccgggaacgtaacggtaccgtacgggtttaaccgtaacccgtaaaccccgttaaactttaacggtacgttaccggtttaacgggaacccttaaggggggaaccctaacgggttacccgaacccggtttacccgttaaacggggttcccgttaaaccggaccccgggtaaccggtaacccccgtaccccttaaacccggg

SEQ ID NO: 37984 - DNA, 710 bp, Homo sapiens
  misc_feature: GYAE6OF02HF0KX.14.66.F11.1.454.CMB.1.raw
  modified_base (330)..(330): a, c, t, g, unknown or other
  misc_feature (330)..(330): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctgtaccagcagaagaccaggacacggcccctgtaccttgtcatctaataggtaaaaacnctaccggtacctcgaggactcccgagaccgattctactggctcaactcaacggaacacacgtacttaccttacgacctagtcacggtcggggtctcgtacgggaccggaagacgttaggacggacgttacgtaaccttaacgtttacgttacggttaaaccggttaccccggggaacctaacgggaccgttaacgggttacccgtaacccgttaaaccccgtaaagttttaaccggttacgtttaccccggtttaccgggtaaaccggttccgggggtaacccgtaaacccggggttacccgtaacccgggtttccccggttaaccgggtacccgtaaccggacccccgtaaaccgggaccccctaaccccggtaaccgg

SEQ ID NO: 37985 - DNA, 630 bp, Homo sapiens
  misc_feature: GYAE6OF02HTFR4.14.66.F11.1.454.CMB.1.raw
  modified_base (332)..(332): a, c, t, g, unknown or other
  misc_feature (332)..(332): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggaccccctctctggctcgctctcctcactctttgcataggttctgtggtttcttctgagctgactcaggaccctgctgtgtctgtggccttgggacagacagtcaggatcacatgaccaagggacgaccggcctacggaagctattatgcaagctaggtaccagcagaagcaggacacggccctgtacttgtcatctatacgtaaaacnctccggcctcgaggactcccgagaccgattctcgtcgctccaactcgaacgaacactacgtccttactacgacactacgaccgtcgggctacgagggacggaagtagtagacgcgtagtacttaatttaccgtggttaaaccgttacccgggaacacgtacgtacggtaccgtaaccctaaacccgaatttacgtcggttaccgtttaccggaacgttcgggaacccgtaacgggtcccgtacccggttaccgtacggtaccgaaccggccccgaacggtaccccctaccctaaccgg

SEQ ID NO: 37986 - DNA, 740 bp, Homo sapiens
  misc_feature: GYAE6OF02JC5U8.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgaccaaggagacggcctcggaagctattatgcaagctggtaccagcagaagccaggacacggcccctgtacttgtcatctataggtaaaacacgtcccggtccctacgacgggactacccgacgaccgattcctctcggctaccaactcaacggaaactacagtccttacctacgaccctatccacgtcggggacctacggaacgggtaccggaaagacgttacgggaggtacctacgtaacgttaacgtttaaccgttacggttaaaccgtttaccccgggggaactaacgggtaccgtaacggttaccgtaaccccttaaaacccccgtaaagttttaacgttaccggtttaccgggtttaaccgggtaaaccgggttaaccgggggtaaacccgttaaaccggggttaccccgtaacccgggtttaacccggttaaccgggttacccgaaaccgggtaacccccgaaaccccggggtaccccaaaccccccgttaacccgg

SEQ ID NO: 37987 - DNA, 621 bp, Homo sapiens
  misc_feature: GYAE6OF02GM9S5.14.66.F11.1.454.CMB.1.raw
  modified_base (255)..(255): a, c, t, g, unknown or other
  misc_feature (255)..(255): n is a, c, g, or t
  modified_base (308)..(308): a, c, t, g, unknown or other
  misc_feature (308)..(308): n is a, c, g, or t
  modified_base (380)..(380): a, c, t, g, unknown or other
  misc_feature (380)..(380): n is a, c, g, or t
tcagcgtctagtaccacgaccggtgctcgatttagtcacgcgagaaaagggaaagggtctgtgaaggcttcaccagtcctgtcccaggtgcagctgcaggagtcgggcccaggactggtgaagccttcacagaccctgtccctcacctgcactgtctctggtgctccatcatcagtggtgttactatggagctggatccgccagccaccagggaacggcctggagtggattggctacatctatcacaggtggganccacccactaaccaaccccgtcctacaaatgtcgaacaaaccatatacagttnaaccacgttacaaaggaacctagttcctccctagaacgctgacgtcctgtgtgacctggccggtcggaaccnccgggccgttagttacttacgtggtcgacgtagggtccgtagttggtgagttagtaacacgtgtcttacgttacttccgtttagaccgtgggtcggggacccgggtacctcggacctaccgtcttcctaccgcgtaccctcccgaaccgacggtacccacgtccgttccctccccgtacggcccgtacccttcccgaccgtaagaccgcctacggtccggcggggaccacggacgtcccgg

SEQ ID NO: 37988 - DNA, 860 bp, Homo sapiens
  misc_feature: GYAE6OF02IWSZU.14.66.F11.1.454.CMB.1.raw
  modified_base (228)..(228): a, c, t, g, unknown or other
  misc_feature (228)..(228): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactcttgcataggttctgtggtttctctgagctgactcaggccctgctgtgtctgtggccgttgggacagacagtcaggntcacagtcgaccgaaaggacgaccggtcccgagggaatccttaattagtcgacgaaacggtccgttacgggtaaccaacggacgaacggaaacgacccgaacgggtaaccgaaccgggtcccccttaggttaaccgtttcggtacctaacttaccgtttaaaagttaaacgggttaaaaaaacctccggttacccccgggtaccccgttacggaacggggtaccttaccccgaacggtaacccggttaactttccgttccgtacgggtacccttaaccgtaaccgttacgaaaaccggaaacctaccgtaacgttccctttaccgtaaccgtaacctaccgtaaccgtacggtaccggggtacgtaccgaacgggtaaccgggtaaacgtacgtacggtacggtaccgttacggtaaacctttaacggtttacgttaaccgggttaaaccggttacccgggaacgtaacggaccggttaacggttacccgttaacccctaaacccgttaatttaaccgttccggttaccgttaaccggtaacggtaaccgggaacttaaaccgggtccctaacccggttaccgtacggtccgtaaaccgacccggaaaccgttacccccgaacccgttaccg

SEQ ID NO: 37989 - DNA, 630 bp, Homo sapiens
  misc_feature: GYAE6OF02JIOYE.14.66.F11.1.454.CMB.1.raw
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
tcagcgtctagtaccacgaccggtgctcgatttagtcacgcgagagggagcaccgtggagaagacagtggcccctacagaatgttcataggttcccaaactctgaccccacccacgggagcctcggacccctctcctggctcgctactcctcactctttcgcataggttctgtggtttctctgagctgactcaggaccctgctgtgtactgtggccttagggacagcagtcaggatcaacntgccaaggngcgcctgagntatangcanctgtaccagcagagccgagacgacgccctagtactgtcatctanagtaaaacnctccggtacctacgaggactcccaggactacttctctcggctacccaactccgaaggaaccacactccgttacctcgaccataccacgtgggtccacggacggtacggaactgttacgagtccgtacgtaacttagtacgtacgttaccggtacccggacgaagtcccgaagtccgtaacccgtaaccctaaagtttaccaaggtttccctttaaccgggacgttaaccggggtaacctaaggttcccgaccgttaacccgtaagtccgaaccgaccccgtaaacccgggtcccaacccccgttacgg

SEQ ID NO: 37990 - DNA, 700 bp, Homo sapiens
  misc_feature: GYAE6OF02GF9ND.14.66.F11.1.454.CMB.1.raw
  modified_base (248)..(248): a, c, t, g, unknown or other
  misc_feature (248)..(248): n is a, c, g, or t
  modified_base (328)..(328): a, c, t, g, unknown or other
  misc_feature (328)..(328): n is a, c, g, or t
tcagcgtctagtaccacgaccggtgctcgatttagtcacgcgagagggagcaccgtggagaagacagtggcccctacagaatgttcataggttccccaactctgaccccacccacggggagccctggacccctctctggctcgctctcctcactctttgcataggttctgtggtttcttctgagctgactcaggaccctgctgtgtctgtggccttgggacagacagtcaggatcacatgccaagggnacggcctcggagctattatgcaagctggtaccagcagaagccaggacacggcccctgtacttgcatctatagtaaaaacnctccgccctgacggctaccagaccgattcctctcggctaccaactacgaacggaaacacgacgtaccttccgttacgacctatcccgtacggtcggggccgtacgaacggggacggaaaggtacgtacgggaggacgttacgaactttaacgtttaaccgttacggtttaaaccggttccccggggaactaacgggtaccgtaacggtaccgtaacccgttaaaaccccgtaagtttaaacgttcgttaccgttaccggggtaaaccgttaccgggaaacccgttaaacgggtaccccgtaacccggttacccggtaaggttacccggtaaccggtaaccccgaaaccgggtacccccaaccccgttaaccg

SEQ ID NO: 37991 - DNA, 701 bp, Homo sapiens
  misc_feature: GYAE6OF02JBDBE.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaagggacgacggcctacggaagcttattatgtacaagctggtaccagcgagaacgccgaggacgacggccctgtacgttgtacactctaataggtaaaactcgtcccggaccctagacggactacccgacgaccgtacttcctcgtcggtctacctaaccgtacgaacggaaccaacgtacgtcctttaccgtaccgaacctactaccgtacggtcgggtctacggacgggtaccgggtaagtacggtacggacggtacgtacgtacttaacttacggtacgttaaccggttacccgggtaacacggtacgtaacgttaccgaacccttaaaccccgtaatttacgtaccgttaccgttaccgggtaacggtaaccgggaaccgtaacgggttacccctaaccggttaccggttaccggtaccgaaccgacccggaacccggtaccccaacccggtacccgg

SEQ ID NO: 37992 - DNA, 624 bp, Homo sapiens
  misc_feature: GYAE6OF02I1JV1.14.66.F11.1.454.CMB.1.raw
  modified_base (328)..(328): a, c, t, g, unknown or other
  misc_feature (328)..(328): n is a, c, g, or t
  modified_base (499)..(499): a, c, t, g, unknown or other
  misc_feature (499)..(499): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggcctgggacagacagtcaggatcacatgccaaggagtacggcctacggaagctatatgacaagctggtaccagcagaagccaggacacggccctgtacttgtcatctaatacgtaaaacncgtccgcctcgacggactcccgaacgtaccgattcgtcgtcgtctaccaacgtcaacggaaacacgtaacgtccttccgttagaccctatccgaacgtggggtacctcggaacgggaccggaaagacgttggaacggtcacgtaacttacgtaaccgtacgttacccgganacgtacctagtacgtaacctaaccctaattacgacgttacgttacgtaacggtacggaacgtaacggtaccgtaccgtaccgtaggtacgaccgtacccgaacggacccctaccgaccttaccgg

SEQ ID NO: 37993 - DNA, 874 bp, Homo sapiens
  misc_feature: GYAE6OF02HNMO3.14.66.F11.1.454.CMB.1.raw
  modified_base (343)..(343): a, c, t, g, unknown or other
  misc_feature (343)..(343): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggttttcttctgagctgactcaggaccctgctgtgtctgtggccttgggacagacagtcaggatcacatgaccaaggagacggcctaggaagctattatgacaagctaggtaccgagcaagaagccgaaggacgacggacccctggtaccttgtacatactataaggtaaaaacnctccggacctcgaggactcccgagaccgattctcgtcgacctaccgtaactacgaaagaaaccaacgtacgtaccgtttacccgttacggtaaccctaacgttaccgtaaccgggttacggggggtacccttaccggggaaacggggtaaaccgggggtaaaacgtaacgggttaacgggtaacgggtaacccggtttaacggttaaacctttaaccgttttaaaccggtttaccggttaaaacccgggttttaacccccggggaacggtaaacgggtacccgttaacgggttaccccgttaaaaccctttaaacccccgttaaagtttaaccgttttacccggttaacccgggttttaacccggggttaaacccggttaacccgggggtaaacccggttaaacccgggttaaccccgttaaacccccgggtttacccgggtttaaaccgggtaccccggtaaaccccgggtaaaccccccggggtaaaccccgggtaaccccccgttaaaacccccccgggttaacccgg

SEQ ID NO: 37994 - DNA, 652 bp, Homo sapiens
  misc_feature: GYAE6OF02IAC6P.14.66.F11.1.454.CMB.1.raw
  modified_base (231)..(231): a, c, t, g, unknown or other
  misc_feature (231)..(231): n is a, c, g, or t
  modified_base (333)..(333): a, c, t, g, unknown or other
  misc_feature (333)..(333): n is a, c, g, or t
  modified_base (365)..(365): a, c, t, g, unknown or other
  misc_feature (365)..(365): n is a, c, g, or t
tcagcgtctagtaccacgaccggtgctcgatttagtcacgcgagagggagcaccgtggagaagacagtggcccctacagaatgttcataggttccccaactctgaccccacccacgggagcctggaccccctctctggctcgctctcctcactctttgcataggttctgtggtttctctgagctgactcaggaccctgctgtgtctgtggccttgggacagacagtcaggntcacatcgccaagggagacggcctacggaagcctattatgcaagctggtacagcagaacgcaggacacggcccctgtacttgtcatctatacgtaaaaactntcccgacctcgaggactcccagaccgtattcncgtcgactccaactacgacggtaaacacacgtcttaccgttagacccatcctaacggtcggggtacctaccgaagggacggaaacggagtacggaacggtctagtaacttacttaacgttacgttaaaccggttacccgggaacacggtaacgtacgttacgacccttaaacccctaatttacgttacgttaccgttaacgggaaccttacggggaaacccttaggtacccgtaccgttaccgtacggacgaccgtaccccgaacggacccccctaccgttaacccg

SEQ ID NO: 37995 - DNA, 847 bp, Homo sapiens
  misc_feature: GYAE6OF02JH2UZ.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggtccttgggacagacagtcaggatcaacatcgacctaaagggacgaccggtccctacgggaaacgtccgttaatttagtcgacgaaacgtcgttacgggttaacccacgacgaacggaaacgtcccgaagggtaaccgaccgggtacccccgttagttaaccgtttcggtacctacgtttacgttaacgttaaacgggttaaaaaacctaccgttaccccgggtaaccccttaccggaaacggggtaccttaaccccgaacggtaaccccgtactttaccgttacgttacggtacccttaccctaaaccgttaccgaaaccgggtaaaacctaccgtaacggttcccgttttaacccgttacgaacccttaacgtaaccgtaaccgggttcgggtaccgttccggaacgggtaaccggaaggtacgtacgggacggtacgtacgtaacgtttaacttaaccgttaggttaaacccggtttccggaacgtacgtaccgtaggtaaccgtacccgttaaaccctaagtttacgttaccgttacgtttaacggaaccggtttaccgggaaccttaacggtacccgtacccggttaccgtacggtacgacccgtaacccgaaccggtacccctaacccgtacg

SEQ ID NO: 37996 - DNA, 617 bp, Homo sapiens
  misc_feature: GYAE6OF02IP65M.14.66.F11.1.454.CMB.1.raw
  modified_base (342)..(342): a, c, t, g, unknown or other
  misc_feature (342)..(342): n is a, c, g, or t
  modified_base (438)..(438): a, c, t, g, unknown or other
  misc_feature (438)..(438): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggcttgggacagacagtcaggatcacatcgccaaggcgaccggcctcggaagctattatgcaagcgtggtaccagcagaacgccgaaggaccacggcccctgtacgttgtacactactaagtaacggtaaaaacncgtaccggcccttacgagggtactacccgaacgaccgtacttctccgtcggcctaccaactacgaagaaaccacagtccttccgttacgaactacncgtacgtcgggcctacgacggacggaagtagtggagtctagtaacttacttaacgttgtaacgtacccgggtacacgcgacgtctaaccgtaacctaagttcgtacgttcgtacggacgtacgggaaccgtaggtccgtaccgttacgtacggtacaccgaccacggacccacccgtcg

SEQ ID NO: 37997 - DNA, 717 bp, Homo sapiens
  misc_feature: GYAE6OF02J1CDI.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctccgctctcctcactctttgcataggttctgtggtttcttctgagctgactcaggtccctgctgtgtctgtggccttgggactgacagtcagggatcgacatcgcctaaggacgaccggccgtcggaagctattatgcaagcgtgtaccagccagacgccaaggcacggtcccctagttaacgttcgtacacgtctagtaacggtaaaacctgtaccccggtcctacgtaacggtactacccacgtacccgtattccgacgtacggtacctacccgaactccgaaacggaaaccacgtacgttaccgttaccgttagaccctaattccgaaccggtcggtctacgacgggtacggaagacggttagcggtactacgtaacttagttaccgtacgttaaccggttccggtaacctacggtacctacggttaccgaacccttaaacccgtaactttcgttaccgttaccgtaaccggttaaccggtaacgggtacccgtaacggttaagtaacccccggtttaccgaacggtttacccggaaccgttaacccccgaacgggttacccccaaccccgttacgg

SEQ ID NO: 37998 - DNA, 714 bp, Homo sapiens
  misc_feature: GYAE6OF02JUJJO.14.66.F11.1.454.CMB.1.raw
  modified_base (77)..(77): a, c, t, g, unknown or other
  misc_feature (77)..(77): n is a, c, g, or t
  modified_base (179)..(179): a, c, t, g, unknown or other
  misc_feature (179)..(179): n is a, c, g, or t
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
  modified_base (678)..(678): a, c, t, g, unknown or other
  misc_feature (678)..(678): n is a, c, g, or t
tcagcgtctagtaccacgaccggtgctcgatttagtcacgcgagagggagcaccgtggagaagacagtggcccctanagaatgttcataggttcccaactctgaccccacccacgggagcctggacccctctctggctcgctctcctcactcttgcataggttctgtggtttctctgancgtgactcgacggaccctgctgtcgtctagtcggaccttgggacaggaccaggtcaaggctcgacntcgccaaggtacgccgccgtaggaagtcttattagngacaagtccgtaggtaccagacgacgaacgccgaggaccgacggtcccctagtcttcgcactcgttaagtaacgtaaactcgtacccggctacgaggactccgaacgtacgtcttccacgtcggtaccctaacgtaacctaccggaaaacgtaacccgtaccgtaacgttccgtttaacccgttacggaaaccctcgtttacccgggaccggttaccggggtactaccgggtaacggggttaccggaaaggtccgttacggtaacgcgtttaccgaaacgttttagtaccgttaacggtaaccggtcccggaaacgcgttacgtacgtacccgtaacttaaccgtaagttacgtcgtacggttacgtaacgacgggtacacgtaacccgtcgttacncggtacccgaccgtacccgaccgtacccaccgtacg

SEQ ID NO: 37999 - DNA, 586 bp, Homo sapiens
  misc_feature: GYAE6OF02GEMPN.14.66.F11.1.454.CMB.1.raw
  modified_base (461)..(461): a, c, t, g, unknown or other
  misc_feature (461)..(461): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccgaggacacggccctgtacttgtcatctataggtaaaacactccggcctcgacgggactcccagaccgtattctctggctaccaactcgaaggaaacacacgtcttctcgaccatcacgtgggctcgacggacggaagagtgaggctgtactatacttagtaacgtaccggganacgctagtacgacctaaaccctaattacgtacgttcgttacggaacgttcgggaaccgtaacgggtcctacccggttaccgtacggtccaaccggtacccgaaccggtaccccaaccccgtaccg

SEQ ID NO: 38000 - DNA, 781 bp, Homo sapiens
  misc_feature: GYAE6OF02JVPZ1.14.66.F11.1.454.CMB.1.raw
  modified_base (143)..(143): a, c, t, g, unknown or other
  misc_feature (143)..(143): n is a, c, g, or t
  modified_base (153)..(153): a, c, t, g, unknown or other
  misc_feature (153)..(153): n is a, c, g, or t
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
tcagcgtctagtaccacgaccggtgctcgatttagtcacgcgagagggagcaccgtggagaagacagtggccctacagaatgttcataggttcccaatctgacccaccacgggagcctggaccctctctggctcgactctccncactcttgcntaggtctgtggttctacgtgagtctgactnaggtccctgcgtgtntctagtcgaccttgggaccngacggttcacggatcacatggacctaaggagccggtcctaggaacgcttaagtactcgacgtaaacgccgtacggttaaccacgacacgtaacggtaccgaggtacggaacgtccccgtagttaacttcgttacgattaccggttacgttaacggtaaaaacgtacctccggtacccgtacggtaacggacgttaccccgaggaaacccggttctttaccggttacggtaccgggttaaccttacccgtaaaccgggtttaccaaacgggtaaaacccgtccgtaaacggttacccgtttacccgttaacggtaaccctaccgtttaaccggaaccggtttacggggggtacctaaccgggtacggggtaacccggtaaacggtacggttacgggaacggtactaccgggtacttaactaccggttaacgtacgtccggttaacgcgtacggtattccgacgttaaccctaagttacttcggtttagaccggtacgtacggtaaccgtcgaacgtaccgttcaacggttcgaacccgttacgaacgggacccctaggtacccg

SEQ ID NO: 38001 - DNA, 693 bp, Homo sapiens
  misc_feature: GYAE6OF02GBKCI.14.66.F11.1.454.CMB.1.raw
  modified_base (343)..(343): a, c, t, g, unknown or other
  misc_feature (343)..(343): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcaacatcgaccaagggacgacggcctacggaagctaacgttaatgacaagctcggtaccagcaagacgccaggacgacggcccctgtacttgtcatctaataggtaaaaacnctccggcctagagggactcccagaccgattcctgtacggtcctaccaactcgaaggaaaccaccgtagtcctttacccgttagaaccctagttccgaacggttcggggtacctcgaacgggcgggtaaacgtgtacggtcggacgttagtacctttaaactttacggttaacgtttaaacgttccccgggggaacaacgaccgtaacggttacgaaacccttaaaccccggtaaatttaggtaccctttacgtaacccgggtaaccgttcggggaaccgtaaccgggttccctaaccggttccgttaacggtcgtaacccggaccctaacggaccccaacccctaaccgg

SEQ ID NO: 38002 - DNA, 658 bp, Homo sapiens
  misc_feature: GYAE6OF02ITK6V.14.66.F11.1.454.CMB.1.raw
  modified_base (231)..(231): a, c, t, g, unknown or other
  misc_feature (231)..(231): n is a, c, g, or t
  modified_base (271)..(271): a, c, t, g, unknown or other
  misc_feature (271)..(271): n is a, c, g, or t
  modified_base (337)..(337): a, c, t, g, unknown or other
  misc_feature (337)..(337): n is a, c, g, or t
tcagcgtctagtaccacgaccggtgctcgattttagtcacgcgagagggagcaccgtggagaagacagtggcccctacagaatgttcataggttcccaactctgaccccacccacggggagcctggacccctctctggctcgctctcctcactcttgcataggttctgtggtttcttctgagctgactcaggaccctgctgtgtctgtggccttgggacagacagtcaggntcacatgaccgaaggcgaccggcctacggaagctaattangacaagcgtaggtaccagcagagcaggacacggccctgtacttgcattctaagtaacggtaaaacncgtacccggcctacgacggactacccgaagacccgtattcctcgtacgccgtaccaactacgaacggaaactacgtacgtcctttaccgtacgaaccctagttaccgtaacgggtcgggtactacggaacgggtacggaaacgtacggtacggacggtcgtaacgtaactaacgtttacgtacggttaaccgttcccggaacgacgtacgtacgtacctaccgtaaaccctattacgtacgtaccgttacggtaacggtacggaaccgtacggtaccgtaccgtcgttacgactaccgacccgaacgacccgtaccctacg

SEQ ID NO: 38003 - DNA, 901 bp, Homo sapiens
  misc_feature: GYAE6OF02G8Y7U.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccaccccacgggagcctggaccccctctctggctcgctctctcactcttgcataggttctgtggtttcttctgagctgactcaggaccctgctgtgtctgtggccttgggacagactagtcaggactcacagtcgaccgaaagggacgacgggtcctagggaagtctattagtcggactaagtcgtaggtaacccgagtaccgaaaggaacgaccgaacgggaccgtaccgggtacccccgttacggttaaccgtttcgtacctaacgttacgttaaacgtaaaagggttaaaaaaccctacggttaccccccggggtaacccctacgggtaaacggggtaaccttaccccgaacggtaaaccccgttacgtttaccttaccggtaccggtacccttaaacccctaaaccgtaaccggaaaaccgggaaaaccctaccgtaaaccgttccccgtttaaccctacccgtaaacccgtaaccttaccggtaccgggttcggggtaccgtaacgggacgggtaaacgggtaacggtacgtagggtacgttccggtaaccgttaacgtttaaacctttacggtttaacggttaaacccggttacccgggtaaaccgacgggtaaccgttacgttaacccgtaaacccttaaaccccgttaatttacgtaccggtttaaccggtaaccggtaaacgggtacccgggtaaccgttaaccgggtacccttaaccccggttacggttaccggtaccggtacccggaaccccgggtaaacccgtaccccgtaacccccgtaccg

SEQ ID NO: 38004 - DNA, 653 bp, Homo sapiens
  misc_feature: GYAE6OF02I04RC.14.66.F11.1.454.CMB.1.raw
  modified_base (336)..(336): a, c, t, g, unknown or other
  misc_feature (336)..(336): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggcttgggacagacagtcaggatcacatgaccaaaggtagaccggcctacggaagcctattatgcaagctggtaccagcagaacgccaggacacggccctggtactgtctatctaagtacgtaaaaacncgtcccggcctacgaggactcccagacctacttctctcgtctaccacgtacaacggaacacgagtccttacctgaaccatacgcgtcgggactacgagggaccgaagtagtacggacgcgttacgaactttacgtaacgttacgtaaaccggttacccgggaacgtacgtccggtaagttaccggtaacccttaaacccgaatttacgtaccgttcgttaccggtaacggttaaccgggtaacctaacgggtacctacccggttacccgtacgggtacccacccgtacccgaacccggtacccctaccctaacccgg

SEQ ID NO: 38005 - DNA, 547 bp, Homo sapiens
  misc_feature: GYAE6OF02H2MUV.14.66.F11.1.454.CMB.1.raw
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (481)..(481): a, c, t, g, unknown or other
  misc_feature (481)..(481): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactcttgcataggttctgtgtttctctgagtctgactcgaggacctgctgtctntgngcttggacnacngnagntnanatgacaaggntcgctgagctattagagcaanctgacagcagacgcagacgtacggcctagtactntcatactanacggtaaaaactcnccggtaccagaacggctacccgataccgattctgcgactacaacgtcaaagaactcagtcttacgtcgtaccatcacgtgggtcacgaggacggaagtacgtgagctagtacctaattacgtactaacggtaccggacgtagcgaatacgactaaaccgtaatagtnttacgtaccgagtacggaacgtacgtacgaccgtacgtagaccggacaccggacacgaacccctag

SEQ ID NO: 38006 - DNA, 748 bp, Homo sapiens
  misc_feature: GYAE6OF02GPF2J.14.66.F11.1.454.CMB.1.raw
  modified_base (183)..(183): a, c, t, g, unknown or other
  misc_feature (183)..(183): n is a, c, g, or t
tcagcgtctagtaccacgaccggtgctcgatttagtcacgcgagagggagcaccgtggagaagacagtggcccctacagaatgttcataggttcccaactctgaccccacccacggggagcctcggacccctctctggctcgctctcctcacttctttgcataggttctgtggtttcttctgngctgactcaggaccctgctgtgtctgtggccgttgggacagaccgagtcaaggactcacagtcgaccgaaagggacgacggtacccgtaggaacgcgttaattaacgtgacgtaacgtcgtacggtaaccgacgacgagaacggaccgacggacgtacggcccctagttacttcgtatactcgtaagtaacggtaaaaacctcgtaccccggtacctacggtaacggtacctacccgaacgtaccgtacttccgtacgtacgtacctaaccgtaaccgtacgaaaccggaaactaccgtacgttcccttaccgtacaacctactaccgtacggttcgggtacgtaacggaccgggtaacggtaaacggtacgtacgacggtcgtaaccgtacgtttaactaacgtaaccgttaccggtacccggtaccgtagacccgtagtacccgtaacctaaacccgtagttacgtcgtacccgtaggaaccgggtacggacctaaccggtaccgtaccgtttacggtaccgtccggaaaccggtcccgaaccggttaccccaaccgttacgg

SEQ ID NO: 38007 - DNA, 635 bp, Homo sapiens
  misc_feature: GYAE6OF02ISD9A.14.66.F11.1.454.CMB.1.raw
  modified_base (355)..(355): a, c, t, g, unknown or other
  misc_feature (355)..(355): n is a, c, g, or t
  modified_base (491)..(491): a, c, t, g, unknown or other
  misc_feature (491)..(491): n is a, c, g, or t
  modified_base (526)..(526): a, c, t, g, unknown or other
  misc_feature (526)..(526): n is a, c, g, or t
  modified_base (571)..(571): a, c, t, g, unknown or other
  misc_feature (571)..(571): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggaccccctctctggctcgctctcctcactctttgcataggttctgtggtttctctgagctgactcaggaccctgctgtgtctgtggtccttagggacagacagtcaggatcacatcgaccgaaggacgaccggccgtacggaagtcctaattactgccaaagtcgtaggtaacccagcaagaagccaggacgacggtcccctagtacttgtacatctagtaaggtaaaaacncgtaccggccctacgaggaactcccgaacgacctattcctcgtcgtacctaccaactacgaacggaaaccaacacgtcttaccctacgacctactacgacgtcgggacctcggaggacggaagtagtcgaggtacncgtaacttattaccgtaaggtaccttacccggaangtagactcgtaacctaaacctaatcgttcgtacgtacggtaacgnggtaccgtaaagtaccctccgtacgtaccgtacacccgtacccgaaccgaccctaaccgtaccg

SEQ ID NO: 38008 - DNA, 691 bp, Homo sapiens
  misc_feature: GYAE6OF02ISPJ7.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacggggagcctggacccctctctggctcgctctcctcactctttgcataggttctgtggtttcttctgagctgactcaggaccctgctgtgtctgtcggccttgggacagacagtcagatcacatgaccaaggagacggcctacggagctattatgcaagctcggtaccagcagacgccaggacacggcccctgtacttgtctatctaagtacgtaaaactcgtacccggcctcgaggacctcccgaacgaccgtacttcctcgtcggacctaccgaactccgaacggaaccactacgtacctttcccgttacgaaccctagtaccctacgggtcgggtcctaacggacggggacggtaacggagtaggacggtaccgtacggtaacctttacttaccgtttaggttaaccgttacccgggactacggtacgtacgttacggaacccttaaacctaagtttaacgtcgttaccgttaccggtaacggttccgggaaccgttaacgggtacccgtaaccggtacccggttacggtaccggtaaccgaaccccggtaacccggacccctaacccgtaccgg

SEQ ID NO: 38009 - DNA, 692 bp, Homo sapiens
  misc_feature: GYAE6OF02IZG3O.14.66.F11.1.454.CMB.1.raw
  modified_base (251)..(251): a, c, t, g, unknown or other
  misc_feature (251)..(251): n is a, c, g, or t
  modified_base (351)..(351): a, c, t, g, unknown or other
  misc_feature (351)..(351): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgcttgtgtctgtggccgttgggacagacagtcaggatacgacatcgccgaaaggngaccggcctacggaagctattatgacaacgctacggtaccagacgagaacgccgaggaccacggtcccctgtacttgtacactctaagtaacggtaaacncgtccggacctacgaggactaccgacgaccgtacttctcgtacggtctaccgaactccgaacggaaaccacgtacgtcctttaccgtacgaccctataccgacggtccgggtactacggaacggggacggtaaaggagttacggtcggaccgtacgtaacgttacgttaacgtacgttaaccggtacccgggatacgtacggtaccgtacgtaaccctaaaccctagtttacgttccgtaccgttacggtaacccgggttaggaacccgtaaccggttaccgtacccgttacggacggtaccgtaccggaacccctaaccgggacccctaacccggtaccg

SEQ ID NO: 38010 - DNA, 721 bp, Homo sapiens
  misc_feature: GYAE6OF02JSPXQ.14.66.F11.1.454.CMB.1.raw
  modified_base (164)..(164): a, c, t, g, unknown or other
  misc_feature (164)..(164): n is a, c, g, or t
  modified_base (177)..(177): a, c, t, g, unknown or other
  misc_feature (177)..(177): n is a, c, g, or t
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (354)..(354): a, c, t, g, unknown or other
  misc_feature (354)..(354): n is a, c, g, or t
  modified_base (548)..(548): a, c, t, g, unknown or other
  misc_feature (548)..(548): n is a, c, g, or t
tcagcgtctagtaccacgaccggtgctcgatttagtcacgcgagagggagcaccgtggagaagacagtggccctacagaatgttcataggttccaattctgacccacccacgggagcctggacccctctctggctcgctctcctcactctttgcatacggttcngtggtttcttcanagctgactcaggacctgctgtnttcngttggccttagggacagacagtccgaaggntcaactatcggacccaaggtacggccgcgttacgganacgtattanagacaaggcgtacggtaccagacgtaggaagacccaagggaacgccggccccgttgttaaccgttcggtactaanacgtttaagaacggttaaaaaccgtgttccccggaacccttcgaaacggggtactaccccggaacggacgttaaccttacgttcccgggtatccgtaaccccgaactacggtaaccgggtaaacctacgaccggttacttaccttacggtaacctaactcgtaacccgtgggttccaaccgacgggtacggaanacggttcgaacgtcgtacggacttactacgtagttacccgttaccggactcgtacgacgttacgaccttaaaccctagtttacgagttctacgggtaacgtaccgggtaacttacggacgtacccgttacgtacgttacgaccggtaacccaaccgggaccctaacccgtacg

SEQ ID NO: 38011 - DNA, 776 bp, Homo sapiens
  misc_feature: GYAE6OF02I6Z0G.14.66.F11.1.454.CMB.1.raw
  modified_base (237)..(237): a, c, t, g, unknown or other
  misc_feature (237)..(237): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactcttgcataggttctgtggtttcttctgagctgactcaggaccctgctgtgtctgtcggccttagggacagacagtcaggatcaacntcgaccgaaggaggaccggcctacgggaagtcttaagttatgacgaagcgtacggtaccagacgaaggacgccgaggacgacggcccctgtacgttcgtactacgtactaagtaacggtaaaactcgtccccggacccttacggaacggtacctaccccgaacggtaacccgtactttaccgtacgttacgggtacccttaacccgaaacctaccgaaacggtaaacccaacgtaccggttaccctttacccgtacgtaacctaacgtacccgtacgggtcgggtacctacggtacggggaacggaagtacggtacgggtacgtacgttagtaacgtttacgtttacggttaacggttaaccggttaccccgggacgtaacgtaccgttaacgtaccggttaacccctaaaccgttacttaggttccgttaccggttaaccggttaacggtccgggtaacccgtaacgggtcccttaaccggttaccgtaacgggtaccctaacccggacccgttaacccgaccccgtaccgtaacccg

SEQ ID NO: 38012 - DNA, 749 bp, Homo sapiens
  misc_feature: GYAE6OF02IGX9E.14.66.F11.1.454.CMB.1.raw
  modified_base (129)..(129): a, c, t, g, unknown or other
  misc_feature (129)..(129): n is a, c, g, or t
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
tcagcgtctagtaccacgaccggtgctcgatttagtcacgcgagagggagcaccgtggagaagacagtggccctacagaatgttcataggttcccaactctgaccccacccagggagcctggacccctntctggctcgctctcctcacttctttgctaattaggttctggttcggttttcttcgtgagtctgactcaggcctgctgtntctgtgcttggacagacngtcaggatcgaacntcgaccgaaggngtccggacgttaacggaacgtaccttaagttagtacggtacgtaacgtcgtacggtaaccgaggtaacaaggaacgtaccgagggaacctacggtcccgttagtaacttcgtacagttaacgtaagtaaacggtaaaactcggtaccgtacgtacgaggacctaccgaagtccgtattcgtactcggtacctaaccgaacgttacgaaacgtaaccgtaacgtaccttaccgttcgtacgtaaacctacgtaaccggtaacggttcgggaaaccctaggtacgggaccggtaaagtgggtaacggttacgcgttaaaccgttaattaccgtttaagttaccggtaaaccggttcgaaaacgtcgtaacggtacgttaacctaaccgtaaccttaagttcgtacgttcgtaacggtaccggtagggtaaccctaacggggttcccaacggttcgttaccggacgtaccccgtaacggacccgttaccgacccttaacg

SEQ ID NO: 38013 - DNA, 991 bp, Homo sapiens
  misc_feature: GYAE6OF02ISPED.14.66.F11.1.454.CMB.1.raw
  modified_base (304)..(304): a, c, t, g, unknown or other
  misc_feature (304)..(304): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcgacggaccctgctgtgtcgtggtcgtccgttagggacagacagtcaaggactaccaacagtacgacccgaaaaggggacgacccggaccgtacgggaacggtaccttaatttaacngaccgaaacgtccgtacggtaccagacgaacgaacggtccgaacggaaccgaccgggtacccccgttaggttaaccgtttcggtacctaacgtttacgttaaacgttaaacggggtaaaaaaacctcccggttaccccccgggtaccccgttaacgggtaaccggggtaaccctaacccccggtaaccggtaaccccggttaccgtttaccgtttacccggttaccgggtacccttaaacccctaaacccgtaacccggtaaaaacccgggtaaacctaacccggttaaccggtttaccccgttttaccccgttaaccgggtaaccccttaaaccgttacccgtaccggggttaccgggggtaaccgttaccgggtaaccgggggtaaccggtaaaacggttaccgggttaacgggtaacgggttacccgttaaacggttaaacccgttttaaacggtttaaccggtttaaccggggttaaacccggtttaacccccggggtaacgtaccgggtaaccgtacggtttaacccggtaaccccttaaaaccccggttaagttttaaccgtccggttttacccgtaaccgggttaaccggtacgggtaacccgtacgggttaacccgacccgtttaccggtacggaacccgtacccgaaccccgtaaccggtacccccaacccgtaccgg

SEQ ID NO: 38014 - DNA, 784 bp, Homo sapiens
  misc_feature: GYAE6OF02HQ250.14.66.F11.1.454.CMB.1.raw
  modified_base (119)..(119): a, c, t, g, unknown or other
  misc_feature (119)..(119): n is a, c, g, or t
  modified_base (238)..(238): a, c, t, g, unknown or other
  misc_feature (238)..(238): n is a, c, g, or t
tcagcgtctagtaccacgaccggtgctcgatttagtcacgcgagagggagcaccgtggagaagacagtggcccctacagaatgttcataggttcccaactctgaccccacccacgggancctggacccctctctggctcgctctcctcactcttgctataggttctgttggtttcttctgagctgactcgacggaccctgctgtcgtcgtgtggccgtggacagacagtcaggatcanatcgaccaaggacgtaccgcctaggaagtacttaagttagtacgacaacgtccgtacggtacgacgacgaaacggtaacgccgtaacggaccgtacggtcccctagttaccgttcgtactaacgtacttaaacggtaacgtaaaaaccgcgttaccccggacccgtacggaacggtaaccacccgtacggtaccgtacgttcgtacccgtcggtaccaaccgtactaaccgtaacgaaaccgacgtaccgtcgttaccctaacgaccacgttacgacggttcgggtcgtaccggtacgggacggtaaagtacggtacgtacggaccgtacgtaaccgttacgttaacggttaacgttaaccggtaccggaaccgaacgttacgacgtaaccgtaaacccgtaaacctacctttaagttacccttaccggttaccggtaaaccggtccgggttaaaacccgtaaccgggttacccgtaaccggttccgttaacccgggtaccgtaaccccggtaacccggaaccccggtaccccaaacccgttaccg

SEQ ID NO: 38015 - DNA, 717 bp, Homo sapiens
  misc_feature: GYAE6OF02GX17I.14.66.F11.1.454.CMB.1.raw
  modified_base (225)..(225): a, c, t, g, unknown or other
  misc_feature (225)..(225): n is a, c, g, or t
tcagcgtctagtaccacgaccggtgctcgatttagtcacgcgagagggagcgaccgtggagaagacagtgcccctacagaatgttcataggttcccaactctgaccccacccacgggagcctgacccctctctggctcgctctcctcactcttgcataggttctgtggtttctctagagttgctcgaggaccctgctgtgtctgtgccttggacagcagtcgagntacacgtatcgaccgaaggagaccggtccgtacgggaacgtccttaagttacaggactaacgcgtacggtaaccagaccgaagaacgcccgagggacctacggtacccctgttaaccgttcgtactatactaacgttaaacggtaaaaaccacgttccccggaacccgtacgaacgggtacctacccgaagtaccgtacttaccgaccgttgcccttaacaacctacgaaacggtaaacacgtacgttcctttaccgtacgtaacctacgtacgtacgtcgggtacacggtagggaccgtaacgacggtaggtacgtcgacgtacctattaccgttggtaaaccgtttccggaacctacggtacgtacggtacgtaaccttaaacccgtaattaaccgtacggttaccttacggtaacgtaccggaaccgtacgtacccgtacgtaccgttacgtcgaacgcccgtaacggaccctaacccgtacgttaccg

SEQ ID NO: 38016 - DNA, 794 bp, Homo sapiens
  misc_feature: GYAE6OF02JNGF9.14.66.F11.1.454.CMB.1.raw
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgttggtttcttctgagctgactcgaggaccctgctggtcttcgtgtcggccgttgggacagacaggtcaggactcaactacgtcgaccgaaaggtacggaccggccgtacggaagtccgttaattacgtggacgaacgtcgtacggtacccgaggacgaacggaacggacccgacggaccgtaccggtccccgttacggttacgtttcgtacctacgttacgtaacgttaaacggtaaaaacgtcccggtaccccggtacccgtacggtaacgggtaaccgtaccccgtaaccggaccgtacgtttacccgtcgtaccggtacctaacccgtaaaccgtaccggaaaacggtaaacccgtaccgtacgttacccgtttaaccgttaccgacctacttaaccgtaccggttcgggaacccgtcgggtaacggccggtaacgtagtacggtaccgtacggttaactactttaaccggtacgttaccggtaccggttacccggacgtcgtaacgtacgtaccgtaacccgttaactacgttcgttagttacccgttacggtacggtaccgggaacctacggtacccgtaccgtacgtcgtaccgaccgtaacgacccgaccctaccgtacg

SEQ ID NO: 38017 - DNA, 607 bp, Homo sapiens
  misc_feature: GYAE6OF02GY83A.14.66.F11.1.454.CMB.1.raw
  modified_base (327)..(327): a, c, t, g, unknown or other
  misc_feature (327)..(327): n is a, c, g, or t
  modified_base (365)..(365): a, c, t, g, unknown or other
  misc_feature (365)..(365): n is a, c, g, or t
tcagcgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacacggcccctgtacttgtcatctataggtaaaacngtcccggccctcgagggactacccgaagaccgtattcnctcggctaccaactacaaggaaaccacagccttcctacgaccatcacgtcgggctacgagggtccggaagacgttggacggtctagtaacttatttacttaggttaaccgttacccgggactacggcgtacgtacgacccttaaaccctaattagttacgttcgttacggtaacgtcgggaacctaaggtccctaaccgttcgtacggtaccgacgacccgaacggtacccaacccctacgg

SEQ ID NO: 38018 - DNA, 704 bp, Homo sapiens
  misc_feature: GYAE6OF02G3N0Z.14.66.F11.1.454.CMB.1.raw
  modified_base (545)..(545): a, c, t, g, unknown or other
  misc_feature (545)..(545): n is a, c, g, or t
  modified_base (554)..(554): a, c, t, g, unknown or other
  misc_feature (554)..(554): n is a, c, g, or t
tcagcgtctagtaccacgaccggtgctcgatttagtcacgcgagagggagcaccgtggagaagacagtggcccctacagaatgttcataggttcccaactctcgaccccacccacgggacgcctggacccctctctggctcgctcctcctcactctttgcattaggttctgttggttttcttctgagctgactcgacggaccctgcttgtgttcgtgtcggcgttagggacagacagtcgaggactcacgagtcgaccgaaagggacgacggtccgtacggaacgctaagttactcgacgaacgtcggtacggtaccagaccgaagaacgccgaaggaccgaccggtcccctagttacgttcgtacctacgtacgtaacgttaacggaaaaaccgtccgttacccggccgttacgacggtacctaccgacgtaacgtcttacgtcgtcggtaccttaccgaaccgtacgaaacgtaaccgactacgttcttaccgtaacgtacctaactcgtaccggtcgggtcctaggtacgggacgaggtacnggtaccgtnacgtatacgttactagtaccgttacggacacgtacgtcgtacgacccgtaaactagttcgtcgttacggtcgtaacggtaaccgaccggttaacgtacgtacccgtaggtaccgttacgaccggaccccgtaacggaccctaaccgtacg

SEQ ID NO: 38019 - DNA, 901 bp, Homo sapiens
  misc_feature: GYAE6OF02FY4ZL.14.66.F11.1.454.CMB.1.raw
  modified_base (132)..(132): a, c, t, g, unknown or other
  misc_feature (132)..(132): n is a, c, g, or t
tcagcgtctagtaccacgaccggtgctcgatttagtcacgcgagagggagcaccgtggagaagacagtggcccctacagaatgttcataggttcccaaactctgaccccacccacgggagcctggacccctntctggctcgctcctcctacacttcttttgcagttaggttctggtgtttctctgtagctgactcgacggaccctgctgtgtctgtggccttgggacagacagtccaggactcactaagtgaccgaaaggacgtaccgggccttacggaacgaccttaagttaacgtcgacgaaacggtacgttacggtaccgacgcgtaacggaaacggacccgaaggaaccggaacggtaccccggttcgttaaccgtttacggtaccgtaactttaccgtaaggttaaaacggttaaaaaacccggtaccgttaaccccggtacccgttaaccggtaaacgggttaacccgttaaccccgaagggtaaaccccccccccgttaagtttacccgttaccggttccggtaccgttaaccccgtaaacgttaacccggaaacgggtaaaaccgtaactaaccggttacctttacccgttaacgggtaacctaaactacccggtaaccggtcggggtaaccgtccggtaagggtaacccggtaaacggtaacgtaaggtaccgggtacgtaaccgttaaccgttaacgtttaaccggttaacggtttaaaccgtacccgggtaaccgacgttaacgtaacggttaccgtaacccttaaaacccgtaacgtttaacgtacgttacgttaacgtaacggtaccggtaaccggtaacggtacccgtaccggttaccgttacgaccggtaaccgacccggtaacgccccgtaaacccgttacccgg

SEQ ID NO: 38020 - DNA, 736 bp, Homo sapiens
  misc_feature: GYAE6OF02HVMAJ.14.66.F11.1.454.CMB.1.raw
  modified_base (131)..(131): a, c, t, g, unknown or other
  misc_feature (131)..(131): n is a, c, g, or t
  modified_base (175)..(175): a, c, t, g, unknown or other
  misc_feature (175)..(175): n is a, c, g, or t
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (609)..(609): a, c, t, g, unknown or other
  misc_feature (609)..(609): n is a, c, g, or t
tcagcgtctagtaccacgaccggtgctcgatttagtcacgcgagagggagcgaccgtggagaagacagtggccctacagaatgtcataggttcccaactctgaccccacccacgggagcctggaccccctntctggctcgctctcctcactctttgcataggttctgtgtttctntgagctgactcacggaccctgctgtntcgtggtggccttggacagacagtcaggctcanagtcgaccgaagggcgaccggacctaggaacgtaccttaagttacgtcggactaaggtcgttacggtaacccaggactaaggaaccgaccgaacggaaccgacgggtacccccttaggttacttcgtctaagtaccttaagttaacggtaaaaacctccggtaccccggtcccgtaacggacggtaactcccgaagtaccgtactttccgtcgtacggcctaaccgaacctcggtaaaacgaacctaacgtaccgttacctttaccgttaccgaaccctacgtcgtaaccgggttcgggacgtaacggacgggtaaccggaagtacgtacggtacgtactacggtaataccgtacgttacgtaccgttccggganacggtacacgtactaaccgtaacctagttactcggttacgtacggacgtcggtaaccgtacggtacccttacggtacccgttagacccgttaaccggacccggtaacccgtaccccgtaaccctcgg

SEQ ID NO: 38021 - DNA, 341 bp, Homo sapiens
  misc_feature: GYAE6OF01CBL85.36.12.B01.1.454.CMB.1.raw
  modified_base (336)..(341): a, c, t, g, unknown or other
  misc_feature (336)..(341): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccagacagcgtactgagcggctggcaaggcgcatagnnnnnn

SEQ ID NO: 38022 - DNA, 339 bp, Homo sapiens
  misc_feature: GYAE6OF01D7L5T.36.12.B01.1.454.CMB.1.raw
  modified_base (337)..(339): a, c, t, g, unknown or other
  misc_feature (337)..(339): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnn

SEQ ID NO: 38023 - DNA, 342 bp, Homo sapiens
  misc_feature: GYAE6OF01DGR05.36.12.B01.1.454.CMB.1.raw
  modified_base (337)..(342): a, c, t, g, unknown or other
  misc_feature (337)..(342): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtctggggcaaagggaccacggtcaccgtctcctcagcctccaccaagggcccatcggtcttccccctggccaccctcctccaagagcacctctgggggcacagcggccctgggctgcctggtcaaggactacttccagacagcgtactgagcggctggcaaggcgcatagnnnnnn

SEQ ID NO: 38024 - DNA, 340 bp, Homo sapiens
  misc_feature: GYAE6OF01DIJO1.36.12.B01.1.454.CMB.1.raw
  modified_base (336)..(340): a, c, t, g, unknown or other
  misc_feature (336)..(340): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccagacagcgtactgagcggctggcaaggcgcatagnnnnn

SEQ ID NO: 38025 - DNA, 342 bp, Homo sapiens
  misc_feature: GYAE6OF01CVDFM.36.12.B01.1.454.CMB.1.raw
  modified_base (337)..(342): a, c, t, g, unknown or other
  misc_feature (337)..(342): n is a, c, g, or t
tcagtacgctgtctcacgaccggtgctcgatttagtagtgtagattccgcggggtcgtttggtgtcctcatctatgaggacaccaaacgacccccgggacccctgagagaatttctggctccagctcagggacaatggccaccttgactatcagtggggcccaggtggaagatgaagctgactactattgttactccacagacaccactggtgatcatagggtcttcggcggagggaccaagctgaccgtcctaggtcagcccaaggctgccccctcggtcactctgttcccaccctcctcagacagcgtactgagcgggctggcaaggcgcatagnnnnnn

SEQ ID NO: 38026 - DNA, 343 bp, Homo sapiens
  misc_feature: GYAE6OF01EF6B5.36.12.B01.1.454.CMB.1.raw
  modified_base (339)..(343): a, c, t, g, unknown or other
  misc_feature (339)..(343): n is a, c, g, or t
tcagtacgctgtctcacgaccggtgctcgatttagtagtgtagattccgcggggtcgtttggtgtcctcatctatgaggacaccaaacgaccccccgggacccctgagagaatttctggctccagctcagggacaatggccaccttgactatcagtggggcccaggtggaagatgaagctgactactattgttactccacagacaccactggtgatcatagggtcttcggcggagggaccaagctgaccgtcctaggtcagcccaaggctgccccctggtcactctgttccccacctcctcagacagcgtactggagcggggctggcaaggcgcatagnnnnn

SEQ ID NO: 38027 - DNA, 294 bp, Homo sapiens
  misc_feature: GYAE6OF01EUGQW.36.12.B01.1.454.CMB.1.raw
  modified_base (290)..(294): a, c, t, g, unknown or other
  misc_feature (290)..(294): n is a, c, g, or t
tcagtacgctgtctcacgaccggtgctcgatttagtagtgtagattccgcgggacccctgagagaatttctggctccagctcagggacaatggccaccttgactatcagtggggcccaggtggaagatgaagctgactactattgttactccacagacaccactggtgatcatagggtcttcggcggagggaccaagctgaccgtcctaggtcagcccaaggctgccccctggtcactctgttcccgcctcctcagacagcgtactgagcgggctggcaaggcgcatagnnnnn

SEQ ID NO: 38028 - DNA, 339 bp, Homo sapiens; identical to SEQ ID NO: 38022
  misc_feature: GYAE6OF01BCJFV.36.12.B01.1.454.CMB.1.raw
  modified_base (337)..(339): a, c, t, g, unknown or other
  misc_feature (337)..(339): n is a, c, g, or t

SEQ ID NO: 38029 - DNA, 382 bp, Homo sapiens
  misc_feature: GYAE6OF01EXQ7Z.36.12.B01.1.454.CMB.1.raw
  modified_base (374)..(382): a, c, t, g, unknown or other
  misc_feature (374)..(382): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtcgtggggacaaagggaccacggtcaccgtctcctcacgcctccaaccgaacgggcccagtccggtccctttccccccgtcggccaccccttccctaccaagacgccaccgtcggtcggggggccacgaggccggcccgtgggctcgccctggtcaaggacttaccttccagacagcgtactggaggcgggctggcaaggcgcatagnnnnnnnnn

SEQ ID NO: 38030 - DNA, 346 bp, Homo sapiens
  misc_feature: GYAE6OF01DK69M.36.12.B01.1.454.CMB.1.raw
  modified_base (340)..(346): a, c, t, g, unknown or other
  misc_feature (340)..(346): n is a, c, g, or t
tcagtacgctgtctcacgaccggtgctcgatttagtagtgtagattccgcggggtcgtttggtgtcctcatctatgaggacaccaaaccgaccccccgggacccctgagagaatttctggctccagctcagggacaatggccaccttgactatcagtggggcccaggtggaagatgaagctgactactattgttactccacagacaccactggtgatcatagggtcttcggcggagggaccaagctgaccgtcctaggtcagccaaggctgccccctcggtcactctcgttccccgccctcctcagacagcgtactgagcgggctggcaaggcgcatagnnnnnnn

SEQ ID NO: 38031 - DNA, 347 bp, Homo sapiens
  misc_feature: GYAE6OF01EK9XA.36.12.B01.1.454.CMB.1.raw
  modified_base (344)..(347): a, c, t, g, unknown or other
  misc_feature (344)..(347): n is a, c, g, or t
tcagtacgctgtctcacgaccggtgctcgatttagtagtgtagattccgcggggtcgtttggtgtcctcatctatgaggacaccaaacgaccccccgggacccctgagagaatttctggctccagctcagggacaatggccaccttgactatcagtggggcccaggtggaagatgaagctgactactattgttactccacagacaccactggtgatcatagggtcttcgggcggagggaccaagctgaccgtcctaggtcagccccaaggcctcgccccctggtccactctcgttcccgccctcctcagacagcgtactggagcgggctggacaaggcgcatgnnnn

SEQ ID NO: 38032 - DNA, 365 bp, Homo sapiens
  misc_feature: GYAE6OF01EUCLE.36.12.B01.1.454.CMB.1.raw
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
  modified_base (343)..(365): a, c, t, g, unknown or other
  misc_feature (343)..(365): n is a, c, g, or t
tcagtacgctgtctcacgaccggtgctcgattttagtagtgtagattccgcgggtcgaaatctacgagcacagcctacagtggacctgaccagtctgagatctgaggactcggccgtgtattactgtgcgagggatccgtatgcttcgggcccgacctacgtacatggacgttctgggggcaaagggaccacggtcaccgtctcctcagcctccacaggcccatcggtcttcccctggcaccctcctccaagcncacctcgtgggggcacgagcggccctgggctgcctggtcaggctactccagaccngcgtactgaggcgggctggccaaggcncagtagnnnnnnnnnnnnnnnnnnnnnnn

SEQ ID NO: 38033 - DNA, 369 bp, Homo sapiens
  misc_feature: GYAE6OF01BB4UR.36.12.B01.1.454.CMB.1.raw
  modified_base (338)..(338): a, c, t, g, unknown or other
  misc_feature (338)..(338): n is a, c, g, or t
  modified_base (344)..(369): a, c, t, g, unknown or other
  misc_feature (344)..(369): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtctggggcaaaagggaccacggtcaccgtctcctcagcctccaccaagggcccatcggtcttccccctggcaaccctcctaccaagacgcacctcgtgggggcacagccggccctgggctgcctggtcaaaggctaacttcagacagcgtactgagcgggctggcaaagggncatagnnnnnnnnnnnnnnnnnnnnnnnnnn

SEQ ID NO: 38034 - DNA, 359 bp, Homo sapiens
  misc_feature: GYAE6OF01D9U37.36.12.B01.1.454.CMB.1.raw
  modified_base (345)..(347): a, c, t, g, unknown or other
  misc_feature (345)..(347): n is a, c, g, or t
  modified_base (350)..(359): a, c, t, g, unknown or other
  misc_feature (350)..(359): n is a, c, g, or t
tcagtacgctgtctcacgaccggtgctcgatttagtagtgtagattccgcggggtcgtttggtgtcctcatctatgaggacaccaaaccgaccccccgggacccctgagagaatttctggctccagctcagggacaatggccaccttgactatcagtggggcccagggtggaagatgaagctgactacttattgttactccaacagacacccactggtgatcagtagggtcttcggcggagggaccaagctgaccgtctaggtcagccaagctcgccccctcggtcactctcgttcccacctcctcagacagcgtactggacgcgggctggcaaggcgcatagannntgnnnnnnnnnn

SEQ ID NO: 38035 - DNA, 425 bp, Homo sapiens
  misc_feature: GYAE6OF01APGKH.36.12.B01.1.454.CMB.1.raw
  modified_base (369)..(369): a, c, t, g, unknown or other
  misc_feature (369)..(369): n is a, c, g, or t
  modified_base (404)..(405): a, c, t, g, unknown or other
  misc_feature (404)..(405): n is a, c, g, or t
  modified_base (408)..(409): a, c, t, g, unknown or other
  misc_feature (408)..(409): n is a, c, g, or t
  modified_base (411)..(425): a, c, t, g, unknown or other
  misc_feature (411)..(425): n is a, c, g, or t
tcagtacgctgtctcacgaccggtgctcgatttagtagtgtagattccgcgggcaaatctacgagcacagcctacatggacctgaccagtctgagatctgaaggctcggccgtgtattactgtgcgaggggatcctatgccgttcgggcccacctactacagtggacgtcgtggggacgaaagggaccacggtccaccgtctcctcacgcctccaccgaacgggcccagtccggtcccttcccccgtggcccacccctcctacccaacgacgcctaccgttcggcgggggcaccgcggtccggccccgtgggctcgtccgtaggtaccgaacggtaccttaccttccgaagaccgacggccggttaacnggacgcgggcgtacggcgaagggcgtaccagtagnngcnngnnnnnnnnnnnnnnn

SEQ ID NO: 38036 - DNA, 440 bp, Homo sapiens
  misc_feature: GYAE6OF01C7MDJ.36.12.B01.1.454.CMB.1.raw
  modified_base (345)..(345): a, c, t, g, unknown or other
  misc_feature (345)..(345): n is a, c, g, or t
  modified_base (396)..(440): a, c, t, g, unknown or other
  misc_feature (396)..(440): n is a, c, g, or t
tcagtacgctgtctcacgaccggtgctcgatttagtagtgtagattccgcgggacccctgagagaatttctggctccagctcagggacaatcggccaccttgactatcaggtcgggggccccagggtggaagatgaagctagactactattgttacctccacagacaccactggtgatcagtacgggttcgttcgggcgggaacgggaccaagccgtcgaccgtccgtaggtccacggacccgaaggccgtcccgtcccccgttcggtacctacccgttcccgttcccggtttccccccgtccccttcccgtaccgaaccggaaccgaacggtccggttaaccgngggaaccggggccgggtccgtacgggaccgaaacgggccgactaagtagcnnnnnnnnnnnnnnnnnnnnnnnnnnnnnnnnnnnnnnnnnnnnn

SEQ ID NO: 38037 - DNA, 351 bp, Homo sapiens
  misc_feature: GYAE6OF01B9KR3.36.12.B01.1.454.CMB.1.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (340)..(351): a, c, t, g, unknown or other
  misc_feature (340)..(351): n is a, c, g, or t
tcagtacgctgtctcacgaccggtgctcgatttagtagtgtagattccgcggggtcgtttggtgtcctcatctatgaggacaccaaacgaccccccgggacccctgagagaatttctggctccagctcagggacaatggccaccttgactatcagtggggcccaggtgaagatgaagctgactactattgttacnccacagacaccacnggtgatcaatagggtcttcgggcggagggaccaagctgaccgtcctaggtcagcccaaggctcgccccctcggtcactctcgttcccgccctcctcagacagcgtactgagcgggctgcaaggcgcatagnnnnnnnnnnnn

SEQ ID NO: 38038 - DNA, 401 bp, Homo sapiens
  misc_feature: GYAE6OF01A8BGX.36.12.B01.1.454.CMB.1.raw
  modified_base (360)..(360): a, c, t, g, unknown or other
  misc_feature (360)..(360): n is a, c, g, or t
  modified_base (362)..(401): a, c, t, g, unknown or other
  misc_feature (362)..(401): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtcgtggggcgaaagggaccacggtcaccgtctcctcagcctccaccaacgggcccatccggtccttccccctcggccacccctccctaccgaagacgccacctcgtgggggcacgacgcggccctgggctgcctggtcaaggactacttccagacagccgtacgtggacgcgggcgtggcgaaggcgcatacgncnnnnnnnnnnnnnnnnnnnnnnnnnnnnnnnnnnnnnnnn

SEQ ID NO: 38039 - DNA, 292 bp, Homo sapiens
  misc_feature: GYAE6OF02GDF7O.36.12.B01.1.454.CMB.1.raw
  modified_base (290)..(292): a, c, t, g, unknown or other
  misc_feature (290)..(292): n is a, c, g, or t
tcagtacgctgtctcacgaccggtgctcgatttagtagtgtagattccgcgggaccctgagagaatttctggctccagctcagggacaatggccaccttgactatcagtgggcccaggtggaagatgaagctgactactattgttactccacagacaccactggtgatcatagggtcttcggcggagggaccaagctgaccgtcctaggtcagcccaaggctgccccctcggtcactctgttcccgccctcctcagacagcgtactgagcgggctggcaaggcgcatagnnn

SEQ ID NO: 38040 - DNA, 343 bp, Homo sapiens
  misc_feature: GYAE6OF02H7N6C.36.12.B01.1.454.CMB.1.raw
  modified_base (339)..(343): a, c, t, g, unknown or other
  misc_feature (339)..(343): n is a, c, g, or t
tcagtacgctgtctcacgaccggtgctcgatttagtagtgtagattccgcgggacaaatctacgagcacagcctacatggacctgaccagtctgagatctgaggactcggccgtgtattactgtgcggaggggatcctatgcttcgggcccgacctactacatggacgtctggggcaaagggaccacggtcaccgtctcctcagcctccaccaagggcccatcggtcttcccctggcaccctcctccaagagcacctcgtgggggcacagccggccctgggctgcctggtcaaggactacttccagacagcgtactgagcggctggcaaggcgcatagnnnnn

SEQ ID NO: 38041 - DNA, 340 bp, Homo sapiens
  misc_feature: GYAE6OF02INJSV.36.12.B01.1.454.CMB.1.raw
  modified_base (338)..(340): a, c, t, g, unknown or other
  misc_feature (338)..(340): n is a, c, g, or t
tcagtacgctgtctcacgaccggtgctcgatttagtagtgtagattccgcggggtcgtttggtgtcctcatctatgaggacaccaaacgaccccccgggacccctgagagaatttctggctccagctcagggacaatggccaccttgactatcagtggggcccaggtggaagatgaagctgactactattgttactccacagacaccactggtgatcatagggtcttcggcggagggaccaagctgaccgtcctaggtcagcccaaggctgccccctcggtcactctgttcccgccctcctcagacagcgtactgagcgggctggcaaggcgcatagnnn

SEQ ID NO: 38042 - DNA, 350 bp, Homo sapiens
  misc_feature: GYAE6OF02F7WNK.36.12.B01.1.454.CMB.1.raw
  modified_base (336)..(350): a, c, t, g, unknown or other
  misc_feature (336)..(350): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtctggggcaaagggaccacggtcaccgtctcctcagcctccaccaagggcccatcggtcttcccctggcaccctcctccaagagcacctctgggggcacagcggccctgggctgcctggtcaaggactacttccagacagcgtactgagcgggctggcaaggcgcatagnnnnnnnnnnnnnnn

SEQ ID NO: 38043 - DNA, 359 bp, Homo sapiens
  misc_feature: GYAE6OF02IVUHG.36.12.B01.1.454.CMB.1.raw
  modified_base (264)..(264): a, c, t, g, unknown or other
  misc_feature (264)..(264): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (350)..(359): a, c, t, g, unknown or other
  misc_feature (350)..(359): n is a, c, g, or t
tcagtacgctgtctcacgaccggtgctcgatttagtagtgtagattccgcgggcaatctacgagcacagcctacatggacctgaccagtctgagatctgaggactcggccgtgtattactgtgcgagggatcctatgcttcgggcccgacctactacatggacgtctggggcaaagggaccacggtcaccgtctcctacagcctaccaccaagggccctatccggtcttaccccctggcaacccctcctccaagagctaccctntgggggtacagccgtcccgtgggctgccttgggacaaaggctacttccaagcacgcgtactgagcgggntggacaggcncaattgnnnnnnnnnn

SEQ ID NO: 38044 - DNA, 343 bp, Homo sapiens
  misc_feature: GYAE6OF02IM7OD.36.12.B01.1.454.CMB.1.raw
  modified_base (332)..(332): a, c, t, g, unknown or other
  misc_feature (332)..(332): n is a, c, g, or t
  modified_base (338)..(343): a, c, t, g, unknown or other
  misc_feature (338)..(343): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtctggggcaaagggaccacggtcaccgtctcctcagcctccaccaagggcccatcggtcttccccctggccaccctcctccaagagcacctctgggggcacagcggccctgggctgcctggtcaaggactacttccagacagcgtactgagcgggctggcaaggcncatagnnnnnn

SEQ ID NO: 38045 - DNA, 894 bp, Homo sapiens
  misc_feature: GYAE6OF02IDICV.36.12.B01.1.454.CMB.1.raw
tcagtacgctgtctcacgaccggtgctcgatttagtagtgtagattcggtcggggacgctctgacgagaggagcccacgccctgggattttcaggtgttttcatttggtgatcgaggactgaacagagagatcgtcaccatggaatttgggctgagcctggtcttttcttgtggtcttattttaaaggtgtccgagtgtagagtgctagttggttggattcgtgggggaggtcgtttgggtacgtagggtcccgggggggtccctcggtacggtacgttccgttacccgttggttcggtaccgacgtaccttttccgtaacgggtatttaccgaaggttccgtttttaacggccgtaacggtcccttaaccggaccccgtaagttccggtaacggtccgttccgggggttaccccggcccgggtacgggtcccgtaccgggtaacggggaacgggtaaccgtcggggtaacggttccgggttaccgtaccggtagggttacgttcgggtcggtacgtaggtgggtaggacgtaccgacgtaacgtaccgtacgtacgtaaccgtaccgttaccgggtcgggtaaccggggtccgttaccgtaaccgtcgttcccgtaaccgaaggtacgtaaaccgtaaccgtttacccgaaaccgtaacccgtacccgttacgttaccttaccgttacgttaactaaaccggttaacgtaaacccgtaaccggtcggtaacggtacccgggtaaccggtaaccgggtacccgtaaccggtaccctttaagtaaccgttacgttaaccgggtaaccgtaaacggtccggttacccgtaacggtaacttacggttacgaaccgtttacgttaccgggttacgggttaccgtacggtttaacccgg

SEQ ID NO: 38046 - DNA, 361 bp, Homo sapiens
  misc_feature: GYAE6OF02I1S46.36.12.B01.1.454.CMB.1.raw
  modified_base (190)..(190): a, c, t, g, unknown or other
  misc_feature (190)..(190): n is a, c, g, or t
  modified_base (295)..(295): a, c, t, g, unknown or other
  misc_feature (295)..(295): n is a, c, g, or t
  modified_base (311)..(361): a, c, t, g, unknown or other
  misc_feature (311)..(361): n is a, c, g, or t
tcagtacgctgtctcacgaccggtgctcgatttagtagtgtagattccgcggggaccccctggagagaatttctggctccagctcagggacaatggccaccttgactatcagtggggcccaggtggaagatgaaggctgactactattgttacctccacagacaccactggtgatcatagggtcttcggnggaggggaccaaagctgaccgtcctaggtcagcccaaggctgcccccttcggcactctagttcccaccctctcagaccaggctaactgaagccggggctcggganacggcgactatagctnnnnnnnnnnnnnnnnnnnnnnnnnnnnnnnnnnnnnnnnnnnnnnnnnnn

SEQ ID NO: 38047 - DNA, 407 bp, Homo sapiens
  misc_feature: GYAE6OF02HO0FF.36.12.B01.1.454.CMB.1.raw
  modified_base (355)..(355): a, c, t, g, unknown or other
  misc_feature (355)..(355): n is a, c, g, or t
  modified_base (361)..(362): a, c, t, g, unknown or other
  misc_feature (361)..(362): n is a, c, g, or t
  modified_base (364)..(368): a, c, t, g, unknown or other
  misc_feature (364)..(368): n is a, c, g, or t
  modified_base (371)..(407): a, c, t, g, unknown or other
  misc_feature (371)..(407): n is a, c, g, or t
tcagtacgctgtctcacgaccggtgctcgattttagtagtgtagattccgcggggtcgaaatctacgagcacagcctacatggacctgaccagtctgagatctgaggactcgggccgtgtattactgtgcggaggggatcctatgcttcgggcccgacctactacatggacgtctggggcaaagggaccacggtcaccgtctcctcagcctccaccaagggcccagtccggtcttcccccgtggccacccctcctaccaagacgccaccgtcgtcgggggcacgagccggcccgtgggctgtcctggtacaaggactacttcgaagacagcgtactggagcgggctggcaaggcncatagnngnnnnnagnnnnnnnnnnnnnnnnnnnnnnnnnnnnnnnnnnnnn

SEQ ID NO: 38048 - DNA, 357 bp, Homo sapiens
  misc_feature: GYAE6OF02ICPEQ.36.12.B01.1.454.CMB.1.raw
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (349)..(357): a, c, t, g, unknown or other
  misc_feature (349)..(357): n is a, c, g, or t
tcagtacgctgtctcacgaccggtgctcgatttagtagtgtagattccgcggggtcgtttggtgtcctcatctatgaggacaccaaacgaccccccgggacccctgagagaatttctggctccagctcagggacaatggccaccttgactatcagtgggccaggtggaagatgaagctgactactattgtactccacagacacactggtgatcatagggtcttcggcggagggaccaagcctgaccgtcctaggtcagccccaaggctcgcccccctggtccactcgtcgttccccgccctcctacagacagtcgtaactgagccggtctaggcaagngtcatagcngnnnnnnnnn

SEQ ID NO: 38049 - DNA, 364 bp, Homo sapiens
  misc_feature: GYAE6OF02I0YVQ.36.12.B01.1.454.CMB.1.raw
  modified_base (246)..(246): a, c, t, g, unknown or other
  misc_feature (246)..(246): n is a, c, g, or t
  modified_base (342)..(342): a, c, t, g, unknown or other
  misc_feature (342)..(342): n is a, c, g, or t
  modified_base (348)..(364): a, c, t, g, unknown or other
  misc_feature (348)..(364): n is a, c, g, or t
tcagtacgctgtctcacgaccggtgctcgatttagtagtgtagattccgcgggcaaatctacgagcacagcctacatggacctgaccagtctgagatctgaggactcggccgtgtattattgtgcggaggggggggtattgtggtggcactaccagctgctaccgaaactggttcgacccctggggccagggaaccctggtcaccgtctcctcagcctccaccaagggcccatcggtcttcccccnggcaccctctccaagagcactctggggcacagcggcctgggctgcctggtcaaggactacttccagacagcgtactgagtcgggctggacaaggcncatagnnnnnnnnnnnnnnnnn

SEQ ID NO: 38050 - DNA, 359 bp, Homo sapiens
  misc_feature: GYAE6OF02HAHW5.36.12.B01.1.454.CMB.1.raw
  modified_base (331)..(331): a, c, t, g, unknown or other
  misc_feature (331)..(331): n is a, c, g, or t
  modified_base (347)..(359): a, c, t, g, unknown or other
  misc_feature (347)..(359): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtctggggcaaagggaccacggtcaccgtctcctcagcctcaccaagggcccatcggtccttccccctggccacccctcctccaacgagccacctcgtgggggcacgagccggccctgggctgcctggtcaaggacctacttccagacagccgtactgagccgggntggcaaggcgcatagnnnnnnnnnnnnn

SEQ ID NO: 38051 - DNA, 404 bp, Homo sapiens
  misc_feature: GYAE6OF02G72YB.36.12.B01.1.454.CMB.1.raw
  modified_base (313)..(313): a, c, t, g, unknown or other
  misc_feature (313)..(313): n is a, c, g, or t
  modified_base (349)..(349): a, c, t, g, unknown or other
  misc_feature (349)..(349): n is a, c, g, or t
  modified_base (351)..(353): a, c, t, g, unknown or other
  misc_feature (351)..(353): n is a, c, g, or t
  modified_base (355)..(356): a, c, t, g, unknown or other
  misc_feature (355)..(356): n is a, c, g, or t
  modified_base (358)..(404): a, c, t, g, unknown or other
  misc_feature (358)..(404): n is a, c, g, or t
tcagtacgctgtctcacgaccggtgctcgatttagtagtgtagattccgcggggcgaaatctacgagcacagcctacatggacctgacccagtctgagatctgaggactcggccgtgtattactgtgcgagggggatcctatgcttagggcccgacctactacatggacgtctggggcaaagggccacggtcacgtctcctcagcctccaccaagggcccatcgggtcttccccctgggcaccctcctccaagagccacctctgggggcacagcggccctggggctgcctggtcaaggactacttccagaccngcgtactgagcgggctggccaagggcgcgacgtagncnnngnngnnnnnnnnnnnnnnnnnnnnnnnnnnnnnnnnnnnnnnnnnnnnnnn

SEQ ID NO: 38052 - DNA, 348 bp, Homo sapiens
  misc_feature: GYAE6OF02GVGWQ.36.12.B01.1.454.CMB.1.raw
  modified_base (338)..(348): a, c, t, g, unknown or other
  misc_feature (338)..(348): n is a, c, g, or t
tcagtacgctgtctcacgaccggtgctcgatttagtagtgtagattccgcgggcaaatctacgagcacagcctacatggacctgaccagtctgagatctgaggactcggccgtgtattactgtgcgaggggatcctatgcttcgggcccgacctactacatggacgtctggggcaaagggaccacggtcaccgtctcctcagcctccaccaagggcccatcggtcttccccctggccacccctcctaccaacgagccacctcgtggggcacagcggccctggctgcctggtcaaggactcttccagacagcgtactgagcggctggcaggcgcatagnnnnnnnnnnn

SEQ ID NO: 38053 - DNA, 441 bp, Homo sapiens
  misc_feature: GYAE6OF02JR6ZE.36.12.B01.1.454.CMB.1.raw
  modified_base (228)..(228): a, c, t, g, unknown or other
  misc_feature (228)..(228): n is a, c, g, or t
  modified_base (347)..(347): a, c, t, g, unknown or other
  misc_feature (347)..(347): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (403)..(407): a, c, t, g, unknown or other
  misc_feature (403)..(407): n is a, c, g, or t
  modified_base (410)..(441): a, c, t, g, unknown or other
  misc_feature (410)..(441): n is a, c, g, or t
tcagtacgctgtctcacgaccggtgctcgatttagtagtgtagattccgcggggtcgtttggtgtcctcatctatgaggacaaccaaacgaccccccgggaccccctcgagagaatttctggctccagcctcagggacaatggccaccttgactatcaggtcggggacccaggtagggaagatgaagctgacctatattgttactccaagcgaacacctacgtgggtntactacaacgtagggttcgttaccgggagggaacgggaccaagccgtacgaccgttccgtaggtccaacggacccctaggcctcgaccccctcggtcactctcggtccccctcctccanaccgacagtccgtagtcgagtccgggctcgggcaacggggcnccgtanaggnacgnnnnnagnnnnnnnnnnnnnnnnnnnnnnnnnnnnnnnn

SEQ ID NO: 38054 - DNA, 398 bp, Homo sapiens
  misc_feature: GYAE6OF02F6L21.36.12.B01.1.454.CMB.1.raw
  modified_base (217)..(217): a, c, t, g, unknown or other
  misc_feature (217)..(217): n is a, c, g, or t
  modified_base (377)..(398): a, c, t, g, unknown or other
  misc_feature (377)..(398): n is a, c, g, or t
tcagtacgctgtctcacgaccggtgctcgatttagtagtgtagattccgcggggtcgtttggtgtcctcatctatgaggacaccaaaccgacccccccgggacccctgagagaatttctggctccagctcagggacaatggccaccttgactatcagtggggcccaggtggaagatgaagctgactacttattgttactccacagaccaccactggnatcagtagggtcgttcggaggacggaccgaagctcgacgtcctaggcacgacccaggctccgcccctcggtccaccttcctacgttcccccacccccttccctaccagacgacgtcgtacgtcggaggtcgggccgtaggacgaacggcgaccagtacgnnnnnnnnnnnnnnnnnnnnnn

SEQ ID NO: 38055 - DNA, 372 bp, Homo sapiens
  misc_feature: GYAE6OF02JZMHK.36.12.B01.1.454.CMB.1.raw
  modified_base (344)..(372): a, c, t, g, unknown or other
  misc_feature (344)..(372): n is a, c, g, or t
tcagtacgctgtctcacgaccggtgctcgatttagtagtgtagattccgcgggacccctgagagaatttctggctccagctcagggacaatggccaccttgactatcagtggggcccaggtggaagatgaagctagactactattgttactccacagaccaccactggtgatcagtagggtcttacgggcggaacgggaccaaggctacgaccgtcgtaggtcacgacccaaggctccgtccccctcggtactacgttccgttccgttccccgccccttcccgtacacgactacggccgttaactcggacggcgggcttagggaccgacggcgactaagtacgnnnnnnnnnnnnnnnnnnnnnnnnnnnnn

SEQ ID NO: 38056 - DNA, 533 bp, Homo sapiens
  misc_feature: GYAE6OF01D7L1C.43.29.C07.1.454.CMB.1.raw
  modified_base (502)..(502): a, c, t, g, unknown or other
  misc_feature (502)..(502): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagtcccagggaaggggctggagtggattggggaagtcaatcacaggggaagtaccaactacaacccgtccctcaagagtcgagtcaacatagcagtagacacgtccaagaaccagttctccctgaagttgagttctgtgaccgtcgcggacacggctgtgtattattgtgcgagcagtggctggtaccgtggctacgtggggccagggaaccctggtcaccgtctcctcngcttccaccaggcccatcgtcttcccctcgg

SEQ ID NO: 38057 - DNA, 541 bp, Homo sapiens
  misc_feature: GYAE6OF01DPXUC.43.29.C07.1.454.CMB.1.raw
  modified_base (502)..(502): a, c, t, g, unknown or other
  misc_feature (502)..(502): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagtccccagggaagggctggagtggattggggaagtcaatcacaggggaagtaccaactacaacccgtcctcaagagtcgagtcaacatagcagtagacacgtccaagaaccagttctccctgaagttgagttctgtgaccgtcgcggacacggctgtgtattattgtgcgagcagtggctgggtaccgtggctacgtggggccagggaaccctggtcaccgtctcctcncgcttccacctaacgggcccatccggtcttccccgtcgg

SEQ ID NO: 38058 - DNA, 556 bp, Homo sapiens
  misc_feature: GYAE6OF01C0MHB.43.29.C07.1.454.CMB.1.raw
  modified_base (476)..(476): a, c, t, g, unknown or other
  misc_feature (476)..(476): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagtcccagggaagggctggagtggagttggggaagtcaatcacgaggggaagtaccaactacaacccgtcctacaagagtcgagtcaacatagcagtagacacgtaccaaagaaccagttcctccctagaagttgagttctgtcgaccgtcgcggacacggctgtgtattattgtgcgagcagtggctgggtaccgtggctacgngggccagggtaccctggtccaccggtctcctcgcgtccttacccaccgacgggcccagtcccggtccttcccccgtcggg

SEQ ID NO: 38059 - DNA, 547 bp, Homo sapiens
  misc_feature: GYAE6OF01CPF3F.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagtcccagggaaggggctggagtggattggggaagtcaatcacaggggaagtaccgaactacaacccgtcctcaagagtcgagtcaaacatagcagtagacacgtccaaagaaccagttctccctgtaagttgagttctgtgaccgtcgcggacacggctgtgtattattgtgcgagcagtggctggtaccgtggctacgtgggccagggaaccctggtcaccgtctcctcgcgccttccacctaacgggccccagtccggtccttcccccgtcgg

SEQ ID NO: 38060 - DNA, 569 bp, Homo sapiens
  misc_feature: GYAE6OF01D087P.43.29.C07.1.454.CMB.1.raw
  modified_base (182)..(182): a, c, t, g, unknown or other
  misc_feature (182)..(182): n is a, c, g, or t
  modified_base (243)..(243): a, c, t, g, unknown or other
  misc_feature (243)..(243): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgcgctgtctatggtggtccttnagtgttacactggagctggatccgccagtccccagggagggctggagtggattgggggaagtcaagtcacgaggggaagtaccaactaccaacccgtcctacaagacgtacgagtcaacatagcagtagacacgtaccaaagaaccagttcctccctagtaagttgagttcgtgtgaccgtcgcggacacggctgtgtattattgtgcgagcagtgcgtggtaccgtggcttacgcgggccagggaccctgggtcctaccggtcctcctcacgtccttacccaccgtaacgggcccctaagttcccgggtccttcccccgtccggg

SEQ ID NO: 38061 - DNA, 543 bp, Homo sapiens
  misc_feature: GYAE6OF01EDTFK.43.29.C07.1.454.CMB.1.raw
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagtcccagggaaggggctggagtggattgggggaagtcaatcacaggggaagtaccaactacaacccgtccctacaagagtcgagtcaacatagcagtagacacgtccaaagaaccagttcctccctagaagttgagttctgtgaccgtcgcggacacggctgtgtattattgtgcgagcagtggctggtaccgtggctacgtggggccagggaccctggtcaccgtctccncngccttccaccgacggcccatccggtcctccccgtcgg

SEQ ID NO: 38062 - DNA, 725 bp, Homo sapiens
  misc_feature: GYAE6OF01B1QQE.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggactccgcacgtcccgaggggacgggcgtggagtggtaggttaggggaactcaagtcacggaaggggtaactaaccaactaaccgaaccccgtccctacgaaagtacgtacgacgtaccaaactagtacgacgtaagtaacgaacctaccgtaccaaaacgtaaccgtacgtttccctacccgtaagtaagttgtacgtttcgtggtacgtacccggtcggaccggaaccgacggtcgttggttagttaatttagttggtacgtcggacgtacgtaagggttcggtcgttacgggtaccggtggtacccgttacgggtcggggacccgaaccggggtaacccgttcgggtacccgtacccggttccttacccgtcgtaccgttcccgttaccccgaaacccggtaacccgggcccccttaacgggtttccccgggttccccctttccccccggtcccgggg

SEQ ID NO: 38063 - DNA, 568 bp, Homo sapiens
  misc_feature: GYAE6OF01CWS9T.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtgttcttcctctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagtccccgagggaaggggctgggagtgggagttggggaagtcaatcaacgaggggaagtaccaaactacaacccgtccctacaagagtcgagtcaaacatagcagtagacacgtaccaaagaaccagttctaccctgaagttgagttctgtcgaccgtcgcggacacggctgtgtattattgtgcgagctagtggcgtgggtaccgtggctacgtgggaccgagggaaccctggtcctaccggtcctcctcacgccttacccgaccgtaacgggcccagtccggtccttcccccgtcgg

SEQ ID NO: 38064 - DNA, 552 bp, Homo sapiens
  misc_feature: GYAE6OF01CMAON.43.29.C07.1.454.CMB.1.raw
  modified_base (511)..(511): a, c, t, g, unknown or other
  misc_feature (511)..(511): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcgagtggttactactggagctggatccgccagtcccagggaaggggctgggagtggagtttgggggaagttcaaagtcacgaggggaaagtaccaactacaacccgtccctcaagacgtcgagtcaaacatagcagtagacacgtcaaagaaccagttctccctgaagttgagtttctgtgaccgtcgcggacacggctgtgtattattgtgcgagcagtggcgtggtaccgtggctacgtgggccagggaccctggcacgtctcctcncgcttaccaccgaacgggcccagtccgtccttccccgtcgg

SEQ ID NO: 38065 - DNA, 610 bp, Homo sapiens
  misc_feature: GYAE6OF01BY3F3.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagtccccagggaaggggcgtggagtggagttggggaagtcaatcaacgaggggaagtaccaactaccaacccgtccctacaagacgtcgagtcaacatagcagtagacacgtaccaagaaccagttcctaccctagaagttgagttctgtgaccgtcgcgacacggctgtgtattattgtgcgagtcaggtggcgtgggtaccgtggtccgtacgtcggggaccgacgggacccgtgggtaccgtaccggtccgttccctaccgacggtcccgtttacccgaacccgtaaccggggtccccctaagttccccgggttcccgtttccccccgtaccggg

SEQ ID NO: 38066 - DNA, 622 bp, Homo sapiens
  misc_feature: GYAE6OF01B1UQS.43.29.C07.1.454.CMB.1.raw
  modified_base (409)..(409): a, c, t, g, unknown or other
  misc_feature (409)..(409): n is a, c, g, or t
  modified_base (450)..(450): a, c, t, g, unknown or other
  misc_feature (450)..(450): n is a, c, g, or t
  modified_base (465)..(465): a, c, t, g, unknown or other
  misc_feature (465)..(465): n is a, c, g, or t
tcagtgtgagtagtcacgaccggtgctcgatttagagtgctacgaagggaaaggggatgggaagtgctttctgagagtcatggacctcctgcacaagaacatgaaacacctgtgttcttcctcctcctggtggcagctcccagatgggtcctgtcccaggtgcagctacagcagtggggcgcaggactgttgaagtccttcggagaccctgtccctcacctgcgctgtctagtggtggtccttcgagtggttactacgtggacgcgtggactccgccacggtcccgaggggaacggggtctgggaggtggagttggggaagtcaagtcagagggaataccaactaccaacccgtcctagaagacgtcgagtacaacatagcagtacgacacgtacaaacgacacgttcncctagtaagttgattcgtgtcgacccgtgacggacacggtntagtgtattatgtgngagctagtcggctagggtaccgtggacgttacggcgggtccgaacgggtaccctgggtacccacccgggttcctaccccagtacgtcccgtttaccccgaacccgtaaccggggtcccctaacggttccccggttccccgtttcccccggtaccggg

SEQ ID NO: 38067 - DNA, 551 bp, Homo sapiens
  misc_feature: GYAE6OF01E0HUZ.43.29.C07.1.454.CMB.1.raw
  modified_base (501)..(501): a, c, t, g, unknown or other
  misc_feature (501)..(501): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagtcccagggaaggggctggagtggattggggaatcaatcacgaggggaagtaccaactacaacccgtcctcaagagtcgagtcaacatagcagtagacacgtccaagaaccagttctccctgaagtgagttctgtgaccgtcgcggacacggctgtgtattattgtgcgagcagtggctgggtaccgtggctacgtcgggccagggaaccctggtccaccgtctcctcncgccttaccgaccgtaacgggcccaagtccggttcccttcccccgtcggg

SEQ ID NO: 38068 - DNA, 609 bp, Homo sapiens
  misc_feature: GYAE6OF01DY5MM.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtgttcttcctcctcctggtggcagctcccagatgggtcctgtcccaggtgcagctacagcaggtggggcgcaggactgttgaagccttcggagaccctgtccctcacctgcgctgtctagtggtgggtcctttcagtggttactacgtggagctggactccgccacgtcccgaggggaagggctggagtggagttggggaatcaatcgacgaggggaataccaactaccaacccgtccctacaagagtcgagtcaaacatagcagtagacacgtaccaagaaccacgttctcccgtagtaagttgagttctgtcgaccgtcgcggacacggctgttgtatttagttgtgcgagctaggtggtcgtgggtacccgtgggaccttacggtcggggccaacgggtacccctgggtccctaccggtccttcccgtacgcgtcccttacccgaacccgtaacgggtccccctaagtccccggttcccttccccccggtcggg

SEQ ID NO: 38069 - DNA, 574 bp, Homo sapiens
  misc_feature: GYAE6OF01A7D73.43.29.C07.1.454.CMB.1.raw
  modified_base (217)..(217): a, c, t, g, unknown or other
  misc_feature (217)..(217): n is a, c, g, or t
  modified_base (467)..(467): a, c, t, g, unknown or other
  misc_feature (467)..(467): n is a, c, g, or t
  modified_base (513)..(513): a, c, t, g, unknown or other
  misc_feature (513)..(513): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctnacctgcgctgtctatggtggtccttcagtggttactactggagctggatccgcagtcccagggagggctggagtggattggggaagtcaatcacgaggggaataccaatacaacccgtcctcaagagtcgagtcaacatagcagtagacacgtaccaaagaaccagttacctccctagaagttgagttctgtcgaccgtcgcggacacggctgtgtattagtgtcgagagcaggtggcgtacggtaccgnggtctacgtcggggaccagggaccccgtgggtacccaccggttccnccttacgacgtccttaccccaacgtaacgggccctaactccgggtcccttcccccgtcggg

SEQ ID NO: 38070 - DNA, 630 bp, Homo sapiens
  misc_feature: GYAE6OF01ELS3L.43.29.C07.1.454.CMB.1.raw
  modified_base (182)..(182): a, c, t, g, unknown or other
  misc_feature (182)..(182): n is a, c, g, or t
  modified_base (243)..(243): a, c, t, g, unknown or other
  misc_feature (243)..(243): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgcgctgtctatggtggtccttnagtggttactactggagctggactccgccacgtcccagggagggctgggagtggagttggggaagtcgaatcgacgaggggaactaccaactaccaacccgtccctacaagacgtcgagtcaacatagacagtacgacacgtaccaaagaacctacgttcctacccgtagtaacgttgtacgtttctcgtcggacccgtcggacggacgaccggtcgttgtgttaagtttagttgtcggacgagcgaggtggctgggtaccgtggtcgtacggtcggggaccgtacgggtaacccgttggtacctacccggttcctcccttcgacgtcccttacccgaacccgtaaccgggtcccctaacgtcccggttcccgttccccccgtcggg

SEQ ID NO: 38071 - DNA, 561 bp, Homo sapiens
  misc_feature: GYAE6OF01BCF21.43.29.C07.1.454.CMB.1.raw
  modified_base (439)..(439): a, c, t, g, unknown or other
  misc_feature (439)..(439): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagtcccgagggaagggctggagtggatggggaagtcaatcacgaggggaagtaccaactaccaacccgtccctacaagagtcgagtcaacatagcagtagacacgtaccaagaaccagttctccctgaagttgagttctgtcgacccgtcgcgacgacgctgtgtatnttgtgcgagcagtggctgggtaccgtgcgtacgtcgggccagggtaccctggtccgtacccggtctcccgtcgcgtccttccgaccgtacggccctaacgtccgtcccgttcccccgtcggg

SEQ ID NO: 38072 - DNA, 806 bp, Homo sapiens
  misc_feature: GYAE6OF01B8GKF.43.29.C07.1.454.CMB.1.raw
  modified_base (183)..(183): a, c, t, g, unknown or other
  misc_feature (183)..(183): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcaggtggggcncaggactgttgaagccttcggacgaccctgtccctcacctgcgctgtctagtgggtgggttcctttcgaggttcggttactacgttggagtcgtggactccgccgaacgtccccgaggggaacggggcgtgggaggtcggtaggttagggggaaagttcgaaagtcgaacggaaggggtaaacgtaacccaaactaaccgaaaccccgtcccgtacgaaacggacgtaccgaagtacaaaccagtaacgacaagttaacgaacctaaccgtaccgaaaacgaaccgtacgtttaccctacccgttaggtaaacgtttacggtacgtttccgtacggttacggtaaccccggttaccggtaccgggaacccgtaacgggtaccttagggttagtttaacgtttagtttcgggtaggtacggttaacggctaaggggttcggtacggttaccgggttaccgggtcgggtaccgttaaccgggtcggggtaacccggtaacggggtaaaccccgttcgggtacccgtaacccggttcgtaccccgtacgtaccggtacccgtttacccgaacccggtaaccggggccccttaaccgttcccggttccccgttcccccgtaccgggg

SEQ ID NO: 38073 - DNA, 581 bp, Homo sapiens
  misc_feature: GYAE6OF01EH332.43.29.C07.1.454.CMB.1.raw
  modified_base (439)..(439): a, c, t, g, unknown or other
  misc_feature (439)..(439): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagtcccagggagggctggagtggattggggaagtcgaatcgacgaggggaagtaccaaactaccaacccgtccctacaagagtcgagtcaaacatagcagtacgacacgtccaagaaccagttcctccctgaacgttgagttctgtcgaccgtcgcgacacggctgtntattatgtgcgngnagtggctgggtaccgtggtctacggtcggggccaacgggaacccgtggtaccacccgttcctccctcgacgtcccgttacccaacccgtacgggcccctaagtcccggttcccttcccccggtccggg

SEQ ID NO: 38074 - DNA, 573 bp, Homo sapiens
  misc_feature: GYAE6OF01AEJ26.43.29.C07.1.454.CMB.1.raw
  modified_base (375)..(375): a, c, t, g, unknown or other
  misc_feature (375)..(375): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtgggcgcaggactgttgaagccttcggagaccctgtccctcacctgcgctgtctatggtgggtccttcgagttggttactactggagctggatccgccagtcccgagggaagggctggagtggagttggggaagtcaagtcacgaggggaagtaccaactacaacccgtcctcaagagtcgagtacaacatagacagtanacacgtaccaaagaaccagttctccgtagtaagttgagttctgtgaccgtgcggacacggctgtgtattagtgtgcgagcaggtggcgtggtaccgtggtactacgcggggccgaagggacccgtggtccaccgtctacctcgacgtcccttccaaccggtaccggccctaagttcccggtcccgttcccccgtcggg

SEQ ID NO: 38075 - DNA, 570 bp, Homo sapiens
  misc_feature: GYAE6OF01B75OY.43.29.C07.1.454.CMB.1.raw
  modified_base (182)..(182): a, c, t, g, unknown or other
  misc_feature (182)..(182): n is a, c, g, or t
  modified_base (454)..(454): a, c, t, g, unknown or other
  misc_feature (454)..(454): n is a, c, g, or t
  modified_base (522)..(523): a, c, t, g, unknown or other
  misc_feature (522)..(523): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgcgctgtctatggtggtccttcagtggttactactggagctggactccgccagtcccagggaggggctgggagtggatttggggaagtcaatcactaagggggaataccaaactacaaaccccgtccctacaaacgagtacgagtacaaacatacgcagtagacacgtaccaaagaaccagttacctccctagaacgttgagttctagtcgaccgtcgcggacacggctggtntattattgtgcgagcagtggctggtaccgtggctaccgtgggcccagggacctggtcaccgtctcccnncgccttcccaaccgtaacgggccccaatccggttcctcccccgtcgg

SEQ ID NO: 38076 - DNA, 761 bp, Homo sapiens
  misc_feature: GYAE6OF01BL9CK.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcaccgtgcgctgtctagtgggtcggtccttcgagttgttactacgtggtagcgtggactccgccacgtcccgagggaagggctggaggtggagttaggggaagtcaagtcgacgaagggaacgtaaccgaacgtaaccgaacccgtccctacaacggtacgtacgaacgtacaaacagtacgacgtaacgtaacgaaccgtaacgtacccgaaaagtaaaccctacgtttacccttaccccgttaggtaacggtttacgtaacggtttaccgttcggtaccggtaacccggtccggtaccggtaccgtaccgggtcgttaggttacgttaacgttttacgttggtacggtacggagtacgtaacgggttcggtccggttacggggtacccgtgggttaccgttacggtcggggtacccgtaaccggggtaaccccgttcgggtacccgtacccggttccgttacccgtccgtacgtcccgttacccgaaacccggtaccgggaccccttacggttccccggttccccgttccccccggtaccggg

SEQ ID NO: 38077 - DNA, 656 bp, Homo sapiens
  misc_feature: GYAE6OF01AVR89.43.29.C07.1.454.CMB.1.raw
  modified_base (355)..(355): a, c, t, g, unknown or other
  misc_feature (355)..(355): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcgagtggttactacgtggagctggatccgccagtccccgagggagggctggagtggagttggggaagtcaatcgacgaggggaagtaccaactacaacccgtccctacaagngtacgacgtacaacatacgcagtagacacgtaccaacgaacctagtacctcccgtagaacgttgtagttctggtcgacccgtcggcggacgacggccgttggtgttaatttattgtggacggagtccgaggtcgggtccgttgggttacccggtgggtacccgttacggtcgggggacccgaacggggtaccccgtgggtacccgacccggttccgtccctacgtacggtcccctttaccccgaacccgtaaccggggcccccttaacgtccccgggttccctttccccccggtcccgggg

SEQ ID NO: 38078 - DNA, 625 bp, Homo sapiens
  misc_feature: GYAE6OF01BZTU8.43.29.C07.1.454.CMB.1.raw
  modified_base (180)..(180): a, c, t, g, unknown or other
  misc_feature (180)..(180): n is a, c, g, or t
  modified_base (277)..(277): a, c, t, g, unknown or other
  misc_feature (277)..(277): n is a, c, g, or t
  modified_base (351)..(351): a, c, t, g, unknown or other
  misc_feature (351)..(351): n is a, c, g, or t
tcagtgtgagtagtcacgaccggtgctcgatttagagtgctacgaagggtaaggggtaggtgggaacgtgcctttcgtgtacgagtcattggacctcctgcacaagaacagtgaaacacctgtggttcttcctacctcctggtggcgagtcgtcccagatgggtccttcgttccaggtgntaagctacagcagtgggcgcaggactggttgaagccgttcggataccctgccctcacggtcgcgctgtctatggtggtccttcagtgttactatganctggatccgcagtcccaggagggctggacgtggatggaacgtgaagtcagaggagtaccaatacaaccgttccngaagagtcgagtcaacatagcagagacacgtacaaggaacccagttcacccgtgaacttcgaagttcgtacgtacgacccgtacgacggaacgacgctagtgtagtatagtagacgagctagaggcgtacggtaccggtacggcgtaacgttggggaccgtagggtaaaccccgtgggtaccgtaacccggtacgtacccttacgacgtacccgtttcccgaacccgaacgggtaccccaagttacccggtcccgtttacccccccgtccgggg

SEQ ID NO: 38079 - DNA, 700 bp, Homo sapiens
  misc_feature: GYAE6OF01BDCEA.43.29.C07.1.454.CMB.1.raw
  modified_base (182)..(182): a, c, t, g, unknown or other
  misc_feature (182)..(182): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcncaggactgttgaagccttcggacgaccctgtccctcacctgcgctgtctagtggtcggttccttcgagtcggttactacgtggagctggactccgccacgtcccgagggaacgggctggagtggagttggggaatcgaatcgagaggggaactaccaactaccaaccccgtcctacgaagacgtcgagtacaacatagctaagtagaccacgtaccaaagaaccgtagttacctccctagtaacgttgtagttcgtgtacgtacccggtcggaccggtaccgacgggtccttaggttacgtaagtttacgttggtacggccgtaagccgtaggttcgggtccggttacggggttacccggtggtaccgttaccgggtacggggacccgtaacggggtaaccccgttggggtacccctacccggtcccttcccgtaccggtacgtcccgttacccccgaacccgggaaccgggtccccctaacggtttccccggttacccctttcccccccggtcgggg

SEQ ID NO: 38080 - DNA, 842 bp, Homo sapiens
  misc_feature: GYAE6OF01AWLNW.43.29.C07.1.454.CMB.1.raw
  modified_base (185)..(185): a, c, t, g, unknown or other
  misc_feature (185)..(185): n is a, c, g, or t
tcagtgtgagtagtcacgaccggtgctcgatttagagtgctacgaagggaaaggggagtgggaagtgctttctgagagtcatggacctcctgcacaagaacatgaaacacctgtgttcttcctcctcctggtggcagctcccagatgggtcctcgtcccaggtcgcagctacagcaggtggggcnaggactgttgaacgtcctttcgggacgtaccctgtccccttcacctgccgcttcgtctagtggtcggtccttcgagttggttactactgggagtcgttggacttcccgccacggttccccgaggggaaggggtcctaggggtacggttggggtaaggtttacggggggaaaacgttcaaaacgttccggaacggtaacgggggtaaacgttaaccccaaacgttaacccgaaccccggtaccccttaacgaaacggtacgttaccggacgtaacaaaccagtacgaccgtaagtaaacgactacccgtaaccgaaacgtaaacccagtttcccgtacccttaaggtacgtttacgtacgttcgtacgtacgtacccggtaccggtacggaacgaccggtcgttcggttagtttaacgtttacgttacggttggtacggacggtaccgtaggtcgggtacggttccgggtaacggtcgggtaccgttaccgggtacggggtcccgaaacggggttaccccggtacgggttacccgtaacccggtttccgtacccgttacccggtaccggtacccgttttaacccccgaacccggtaacccggggtacccccgttaagggttacccccggtttccccggttttcccccccggacccggg

SEQ ID NO: 38081 - DNA, 658 bp, Homo sapiens
  misc_feature: GYAE6OF01DQ2Z6.43.29.C07.1.454.CMB.1.raw
  modified_base (182)..(182): a, c, t, g, unknown or other
  misc_feature (182)..(182): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcncaggactgttgaaaccttcggagaccctgtccctcacctgcgctgtctatggtggtccttcagtggttactacgtggagctggactccgccacgtccccgaggggaagggctggagtggagttgggggaagtcaagtcacgaggggaacgtaccaactaccaacccgtccctacaagacgtcgaagtacaacatagacagtaacgacacgtaccaagaaccagttcctacccgtagtaacgttgaagtttctggtacggtacccgtcggacggaacgacggtcttgtagttatttagttgtagcggagccgtaggtcgggtcttacgggtaccgtcgggtcgttacggttcgggggacccgaacggggtaaccccgttgggtacccgacccgttccgtccctcgacggttcccttacccgaccgaaaccggggtcccctaacggttcccggtttcccttcccccgtgggtcccccg

SEQ ID NO: 38082 - DNA, 618 bp, Homo sapiens
  misc_feature: GYAE6OF01D3QCI.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagtcccgagggaagggctggaggtggagttgggggaagtcgaagtcgaacgaggggaacgtaccaacgtaaccaaccccgtccctacgaacgagtcgagtcaacatagcagtacgacacgtaccaaagaacctagttctaccctagtaacgttgagttcgtgtcgaccgtcgacggactacggctgttgtatttagttgtgcgagcaggtggcgttgggtaccgttggctacggtcggggaccgtacggggtacccttcgggtccctaccggtccttaccgtcgtacgtcccgttacccgacccggtaacgggaccctacggttcccggttcccttcccccgtcggg

SEQ ID NO: 38083 - DNA, 684 bp, Homo sapiens
  misc_feature: GYAE6OF01CLE6P.43.29.C07.1.454.CMB.1.raw
  modified_base (352)..(352): a, c, t, g, unknown or other
  misc_feature (352)..(352): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctagtggtggtccttcagtggttactagtggagcgtggactccgccacgtcccgaggggagggcgtggagtggagttggggaagtcaatcacgaggggaataccgaactaccaacccgtcctanaagagtcgagtacaacatagcagtagacacgtacaacgaacctacgttcctacccgtagtaacgtttgtacgtttcgttacggtcggacccgttcggaccgggtaacgtaccgggtactgggtttacgttagtttagtttacgtcggacgtacgacggtacggtcgggtccggttcgggtaccggttcgggtaccttaacgggtcggggacccggtaacgggtaccccgttcgggtacccgtacccgttccgtacccgttcgtccggtcccttaccccgaacccgtaacggggtccccctaaggttccccgttcccgttcccccggtccggg

SEQ ID NO: 38084 - DNA, 714 bp, Homo sapiens
  misc_feature: GYAE6OF01E3NPE.43.29.C07.1.454.CMB.1.raw
  modified_base (183)..(183): a, c, t, g, unknown or other
  misc_feature (183)..(183): n is a, c, g, or t
  modified_base (418)..(418): a, c, t, g, unknown or other
  misc_feature (418)..(418): n is a, c, g, or t
tcagtgtgagtagtcacgaccggtgctcgatttagagtgctacgaagggaaaggggatgggaagtgctttctgagagtcatggacctcctgcaacaagaacatgaaacacctgtggttcttcctcctcctggtggcagctcccagatgggtcctgtcccaggtgcagctacagcagtggggcncaggactgtgaacgccttcggagaccctgtccctcacctgcgctgtctagtggtcgggttacccttgaggttcggttaacctacgtggacgtctggtactcccgccacggtccccgaaggggagggcgtggagtgggagtagggggtaatcgaagtcgaacggacggggtaaactaacccgtaaacctaacccaaaccccgtccctacgaacgacggttcgaacgtacaaactanaaggcaaggtacgaactacgtaaccaaacgtaacctacgttcctaccctagtaagtgtacgtttcgtaggtacgtacccggacggccgggacgtaaccgggtcttaggtttattaacgtttagttcggtggtacgcgccgtagggtcggtacggttcggggtaaccggtgggtaccgttacggtaccgggggtaaccaaccggggttacccgtcgggtaccctccgtccgtaccctcgtaactcccgtacccaaccggacggtccccaggtccccgttcccgtacccccgtccggg

SEQ ID NO: 38085 - DNA, 639 bp, Homo sapiens
  misc_feature: GYAE6OF01DVBOX.43.29.C07.1.454.CMB.1.raw
  modified_base (181)..(181): a, c, t, g, unknown or other
  misc_feature (181)..(181): n is a, c, g, or t
  modified_base (220)..(220): a, c, t, g, unknown or other
  misc_feature (220)..(220): n is a, c, g, or t
  modified_base (471)..(471): a, c, t, g, unknown or other
  misc_feature (471)..(471): n is a, c, g, or t
tcagtgtgagtagtcacgaccggtgctcgatttagagtgctacgaagggaaaggggatgggaagtgctttctgagagtcatggacctcctgcacaagaacatgaaacacctgtgttcttcctcctcctggtggcagctcccagatgggtcctgtcccaggtgcagctacagcagtggggcncaggactgttgaacgtccttcggacgaccctgtcccctnaccctgcgctgtctagtcggtggtccttcaggttcggttactacgtggagcgtggactccgccgtacgtcccgaggggaacgggcgtggacgtggagttggggaagtcaatcgaagagggaataccaactacgaacccgtcctacaagagtcgagtacaacgactagcgtaagtacgacaccgtacgaaacgtaacctaagttcctacccgttagtaaacgttgtacgttctgtacgaccgtcgacggacncggtactgtgtacttagtcgtgcgagcgtacgtcggtcgtgggtaccgtgtccgttacggtcggggaccctaacgggtacccgtgggtacccaccggttcctccgttacgacgtaccttacccgaaccggtacggacccctacggttcccgtcccgttccccgacggg

SEQ ID NO: 38086 - DNA, 1046 bp, Homo sapiens
  misc_feature: GYAE6OF01D7L1W.43.29.C07.1.454.CMB.1.raw
  modified_base (187)..(187): a, c, t, g, unknown or other
  misc_feature (187)..(187): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttccttcctcctcctggtggcagcctcccagatgggtcctgtcccaggtgcagctacagcgaggtggggcgngaggtactggttagaacgtccgtttacgggacgtaccccgtcggtaccccctcacccgttggcccgtctttcggttaccgttaaggttcgggggttaccggggttccccttttacggtaacggttttaccgggggttttaaccttaccggtttaggggaaggtccgttacgggacgtccccggtacccgtaacccggttacccccgggaaggggggaaacgggggtccgttaggggtaacggggttacggggttaaggtttaacgggggggaaaacggttaccgtaaaacgttaccgggaaaccggggtaaacgggggtaaaccggtaaccccgtaaaaccgttaaaccccggtaaacccccgttaccccgtaacggtaaaccgggtacggtaacggtaacggtacctaaaccgtaaagtaacggacgtaaaggttaaacggaacccgtaaccgtaacccgaaacggtaaacccgttacggtttaccccgttaacggtacggttaacgggttaagttaccgtttcgtaccggttacggaccccggttacggacccgggtaacgtaccggtaccgtttaggttacgttaacgttttaacggttcgggttacggaccggtacggtacggttaacggttaccggggttccggtaaccggggtttaccgtccggggtaacgttaccggggtaccggggaccggttaacccggggtaacccggtcgggttacccccgttaaccgggttcccgttaccccgtcgggttaaaccctacccgtttacccccgaaacccggggttaaccccgggtaccctaaccgggttttccccccgggtccccgttttcccccccggtacccgggg

SEQ ID NO: 38087 - DNA, 557 bp, Homo sapiens
  misc_feature: GYAE6OF01EHU8B.43.29.C07.1.454.CMB.1.raw
  modified_base (182)..(182): a, c, t, g, unknown or other
  misc_feature (182)..(182): n is a, c, g, or t
  modified_base (243)..(243): a, c, t, g, unknown or other
  misc_feature (243)..(243): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgcgctgtctatggtggtccttnagtggttactactggagctggatccgccagtcccagggaagggctggagtggattgggggaagtcaatcgacgaggggaataccaactacaacccgtccctacgaagagtcgagtcaacatagcagtagacacgtaccaagaaccagttctccgtgaagttgagttctgtcgaccgtcgcgacacggctgtgtattatgtgcgagcagtggctgggtaccgtggctacgtggggccagggaaccctggtccaccgtctccgtcacgtccttacccaccgtaacgggcccaagtccggttccttcccccgtcggg

SEQ ID NO: 38088 - DNA, 749 bp, Homo sapiens
  misc_feature: GYAE6OF01EYGR4.43.29.C07.1.454.CMB.1.raw
  modified_base (182)..(182): a, c, t, g, unknown or other
  misc_feature (182)..(182): n is a, c, g, or t
  modified_base (204)..(204): a, c, t, g, unknown or other
  misc_feature (204)..(204): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcncaggactgttgaagccttgganaccctgtccctcacctgccgctgtctatgggtcggtccttcgagttggttactacgtggagctggactccgccacgtcccgagggaacgggcgtggagtggagtggggaagtcgaatcgaacgaggggaacgtaccaacgtaccaacccgtccctacgaagacgtacgacgtacaaacacgtacgacgtaaggtaacgaaccgtaacgtacccgaaaacgtaaaccctacgtttaccctaccccgttaggtaacggtttacgtaacggtttcgttacggtaccggtacccgggtccggtaccgggtaaccgtaaccgggtctttagggttacgtttaacgttttagttacggtcggtacgtacggacgtagggtcggtaccggttcggggttacccggttacgggtccgtaccgggtacgggggacccgtaacggggtaccccgttcgggtacccgtaacccggttcctacccgtccgtacgtcccgttacccgacccggtaaccgggtccctaaccgttcccggttcccgttcccccggtcggg

SEQ ID NO: 38089 - DNA, 782 bp, Homo sapiens
  misc_feature: GYAE6OF01E13YW.43.29.C07.1.454.CMB.1.raw
  modified_base (181)..(181): a, c, t, g, unknown or other
  misc_feature (181)..(181): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttccttcctcctcctggtgcagctcccagatggtcctgtcccaggtgcagctacagcaggtgggcncaggacttgttgaacgtccgtttacggagaccccttcgtcccttcaccttgccgtcttcgttcttagttcgggtcggttaccttcgaggttacggttacctacgtggagtcgtcggactcccgaccgacgtcccggaaggggaacgggcgtggacggtgggtagtaggggaacttacgaacgtacgacggtaaggggaacgtaaccaacctaaccgaaccccgttaccctacgaacgacggtacgaacgtaccaaacagtaacgactaagtacgaactaaccggtaccaaaacgtaacctacgtttcccgtacccgttaggttaacgttacggttacgtttaccgtacggttacggtacccgggttacggaaccgggtaaccgtaaccgggtcgtttaggttagttttacgttttagttcgggttacggaccggttaagtcgagggttcgggaccgtttcggggtaccgttggtaccgtacggttacgggcgtaccgggaacggttacccgtaggtccccgtaccgttccgtaccctcgtacccgtccgttaacccgaccggtaccggaccccttacggttccccgttcccgtcccccggg

SEQ ID NO: 38090 - DNA, 678 bp, Homo sapiens
  misc_feature: GYAE6OF01BIUD2.43.29.C07.1.454.CMB.1.raw
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcaggtggggcgcaggactgttgaacgccttcggacgaccctgtccctcacctgcgtctgtctagtgggtcgggttccttcgaggttcggttaactacgttgggacgtcgtggactcccgccgacgtcccgaggggaacgggcgtgggacgtgggtaggttagggggaagtacgaagtccgaacggaagggggtaaacgtaacccgtaaactaacccgtaaaccccggttcccctaagaaacgtacgtacggaacgtacaaacagtaacgacgaagtaacgactaccgtaccgaaacgacctagttacctccgtagtaagttcgtagttcgtgtcgtacccgtcggacgacgacggtctgttgtatttgtgtgacgngngaggtggtcgtagggtacccgtggccgtacggcggggaccgtacgggaccgtcggtccgaccgtccgtccgtcgacgtccctaccgaacccgtacggaccctacggtccgtcccgttcccgtcccggg

SEQ ID NO: 38091 - DNA, 661 bp, Homo sapiens
  misc_feature: GYAE6OF01DLDVR.43.29.C07.1.454.CMB.1.raw
  modified_base (180)..(180): a, c, t, g, unknown or other
  misc_feature (180)..(180): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctctcctggtggcagctcccagatgggtcctgtcccaggtgcagctacagcagtgggcncaggactgtgaagccttcggacgaccctgtccctcacctgcgctgtctatggtggtccttcagtggttacacgtggagctggatccgcagtcccagggagggctggagtggagttggggaagtcaatcgacgaggggaactaccaaactacgaacccgtccctacaacgtagtaccgagtaccaaactacgtacgacaaggtaacgactaccgtaccgaaacgaacctacgttcctacccgtagtaacgtttcgacgtttcgtggtacgaccgtcgacggaccgacggtctgtagttattagttggtgacgtacgtcgtaaggtcggtccgtgggtaccgtgggtaccttacggtcggggacccgtaacgggtaaccccgtcgggttaccgacccggttcctacccgttacgaccgttacccgttacccgaacccggtaacgggcccctaagttcccgggttcccttcccccggtaccggg

SEQ ID NO: 38092 - DNA, 656 bp, Homo sapiens
  misc_feature: GYAE6OF01CV4K2.43.29.C07.1.454.CMB.1.raw
  modified_base (309)..(309): a, c, t, g, unknown or other
  misc_feature (309)..(309): n is a, c, g, or t
  modified_base (384)..(384): a, c, t, g, unknown or other
  misc_feature (384)..(384): n is a, c, g, or t
  modified_base (491)..(491): a, c, t, g, unknown or other
  misc_feature (491)..(491): n is a, c, g, or t
tcagtgtgagtagtcacgaccggtgctcgatttagagtgctacgaagggaaaggggagtgggaagtgctttctgagagtcatggacctcctgcacaagaacatgaacacctgtgttcttcctcctcctggtggcagctcccagatgggtcctgtcccgaggtgcagctacagcgaggtggggcgcaggtactggttgaagtcccgttcggacgtacccctcgtccctcacctgcgtctgtctagtgggttggtccttgagtgttactgtggagcgtggactcccgcctacgtcccgaggggacgggcgnggagtggagttgggatcagtcacgagggaactaccaactacctaaccccgtcctacgaagcgtacgagtacaacngtacgcgaagtacaacgtaccgtacctaaagaacccgtagttccctccgtagtaacgttcgagtttctgcgtaccgtcggcgacgtcgtgtgttgtacttgttgtgngtagcgtgtggtacgtcgggtaaccggtggtacctcgggtacggggacccgtaacgggtaccccgtgggtaccccacccggttcctacccgtcgtccgtaccccgttacccgacccggtaaccgggccccttaggttcccccggttcccgttccccggtcccggg

SEQ ID NO: 38093 - DNA, 903 bp, Homo sapiens
  misc_feature: GYAE6OF01D7BPV.43.29.C07.1.454.CMB.1.raw
  modified_base (184)..(184): a, c, t, g, unknown or other
  misc_feature (184)..(184): n is a, c, g, or t
tcagtgtgagtagtcacgaccggtgctcgatttagagtgctacgaagggaaaggggagtgggaagtgctttctgagagtcatggacctcctgcacaagaacatggaaacacctgtggttcttcctcctcctggtggcagctcccagatcgggtcctgtcccaggtgcagctacagcagtgggcncaggactgttgaacgtccttcggacgtaccctgtcccctcaccgtgcgctgtctatcggtggtccttcgaggtggttactacgtggagctggactccgctagtcccgaggggtaaggggcctagggacgttgggacgtttcggggggaaagttctaaagtccaacgtaaggggaacgttaacctaaacgtaaccgaaaccccggttccctacaaacggtacgttaccggaacgttaccgaaaccgtataacggacaacggttaacgaaccgtaaccggttacccaaacggtaaacccgtaacggtttaccctaccccgttaaggtaaacggtttcgaacggtttaccttacggttaccggtaaccccggttcggacccgggtaacctaacccggggtcccgtttagggttacggttaacgttttacggtttacggttcgggtaaccggtacgggtaccgttacgggtttaccggggtacccgttttacgggggttaaccccggttcggggtaacccgttaaccgggtttccggggggaacccgttaaacccggggggtaaccccgttcggggttacccccgtaccgggtttaccccggtttaccccggttaccggtaacccgggttaccccttttaccccgggaaacccggttaaaccgggggtacccccttaaacggtttccccggggtttcccgtttaccccggtttccccccgggg

SEQ ID NO: 38094 - DNA, 772 bp, Homo sapiens
  misc_feature: GYAE6OF01CLFUR.43.29.C07.1.454.CMB.1.raw
  modified_base (108)..(108): a, c, t, g, unknown or other
  misc_feature (108)..(108): n is a, c, g, or t
tcagtgtgagtagtcacgaccggtgctcgatttagagtgctacgaagggaaaggggatgggaagtgctttctgagagtcatggacctcctgcacaagaacatgaaacncctgtgttcttcctcctcctggtgcagcctcccagagtcgggtcctcgtcccgaggtcgacagcctaacacgcgaggtcggggaccgcgaaggtacctggttacgaacgtccgttacggaccgcccttcgtcccctcacctcgcgtacttgtctagtcgggttcggtccttgagttcgtaacctgtggacgtcgtcggactcccgaccgtaccggtacccgggaggggaacgggtcgtagggtaggttaggtaacgggttggggaaaccgttgaaacgtccggtaacggaacggggtaacctaacccgaaaccgtaaccccgaaccccgtcgtaacgaacggtcgtacgactaccaaactgacacgtaagaccgaacaccggtaccaaagtactacgttcctaccgtagtaacgttcggtactttcgtcgtacggtaccgtaccggtacggaacccgaggttcctaggtttagtaacgttttctagggacgaccggttaaggcgtacgggtttcgggaacgttccgggtacgtcggtaccgtaacggggcggaaccggttacgtaccgtcgggtaccacccggtccctacgaccggtccgtaccgttacccggaaaccggtccggccccgttaacgttccccggtacccttccccggtacccgg

SEQ ID NO: 38095 - DNA, 1043 bp, Homo sapiens
  misc_feature: GYAE6OF01C202R.43.29.C07.1.454.CMB.1.raw
  modified_base (182)..(182): a, c, t, g, unknown or other
  misc_feature (182)..(182): n is a, c, g, or t
tcagtgtgagtagtcacgaccggtgctcgatttagagtgctacgaagggaaaggggatgggaagtgctttctgagagtcatggacctcctgcacaagaacatgaaacacctgtgttcttcctcctcctggtgcagctccagatgggtcctgtcccaggtgcagctacgagcgaggtggggcncgaaggtcttagttacggaacgtccgtttacgggaaccgtacccgttcgttcccctaccacccgtcgccgtccttacggtttcgttacggttcggggtttccgggtttcccctttacgtaagggttttcggtttttaaccctaggttacggggtacgtaccggttacgggaacccggttcccccgtaacccggtaacccgggtttaccccgggaaggggggtaaaccgggggtccggttaagggggtaggtttaggggtaaaggggtttaacgggggtaaaaccgttaccgttaaacggtaaccggaaaccggggtaaacgggggtaaaaccgtaaaccccgtaaaacccgttaaccccggaaacccccgttaccccgtaaacggtaaacgggttaccggttaaaccggtaacgttaaacccgaaaacgttaacggtacggtaaccctaaaggtaaaccggtaaccgtaacccggtaacccgaaaacggtaacccttaacgtttcccgaccgttaaggtaacggtttacggttaggtttaccggtacggttaccgggtaacccggtccgggtaacgggtaacccgggtaccggttacgtttacggttacggttttaactttacggtttacgggtacggtacggtaagtccggtaggttacggttccgggtttaacgggttccggtcgggttaccgtaccggggtacggggtacccgggtaaccgggtaccccgttacgggttcccgtacccggttccgttacccgttacccgtaccggtaaccccggtttaccccgaaacccggtaaccccgggttccggttaccgttccccgggttccccgttcccccccgggtaccggg

SEQ ID NO: 38096 - DNA, 868 bp, Homo sapiens
  misc_feature: GYAE6OF01DMZKC.43.29.C07.1.454.CMB.1.raw
  modified_base (310)..(310): a, c, t, g, unknown or other
  misc_feature (310)..(310): n is a, c, g, or t
  modified_base (334)..(334): a, c, t, g, unknown or other
  misc_feature (334)..(334): n is a, c, g, or t
  modified_base (406)..(406): a, c, t, g, unknown or other
  misc_feature (406)..(406): n is a, c, g, or t
  modified_base (504)..(504): a, c, t, g, unknown or other
  misc_feature (504)..(504): n is a, c, g, or t
  modified_base (540)..(540): a, c, t, g, unknown or other
  misc_feature (540)..(540): n is a, c, g, or t
tcagtgtgagtagtcacgaccggtgctcgatttagagtgctacgaagggaaagggatgggaagtgctttctgagagtcagtggaccctcctgaccaacaaagaactatacggaaaccaccgttggttcggtttcctttccctccgtccgttggggtcggcaaggccctcccgagtagttcgggtcctcgtccccgaggtgaccagtcctaagacgcgtaaggggtggggacccagaagggtcttgggttacgaaccggttcccgtttcgggaacctaccccgtcggtccctacacccgtgccgtaccgtnttctggtacggttcggtccttagnggtttaaccggtctacggtgacgtgtaccggactcccggacccgtaaccggacccggtaaaggggaccgggnggtaggtacggtgggtaggtaacggggtaactacgtacgtacggaacggaacgggtaaccgaaccctaaaccctaaccgtaacccggtcctaaacggngtaccgacgtaagtacaaccgtaacgtcgaaccganaaaccggaccttacgaacccgaaagtacttaaccgtccgtttaaccgagttaagttacgttacggttacgttacgggtacgacccggttaccggaacggtaccgtacggttacggtacgttagtttaacgtttaggttacggtacgtacggtaacgtcgtaacggtcggttaccggttaacgggttccggtaccgggttacggtaccgggtcgggtaaccggtaccggtaccgtccgggtacccctaccggttccctaccggttactccggtaacccgtacccaccggtaaccgaccctacggttccccgtcccgttacccgcccggg

SEQ ID NO: 38097 - DNA, 809 bp, Homo sapiens
  misc_feature: GYAE6OF01BJMRR.43.29.C07.1.454.CMB.1.raw
  modified_base (692)..(692): a, c, t, g, unknown or other
  misc_feature (692)..(692): n is a, c, g, or t
  modified_base (756)..(756): a, c, t, g, unknown or other
  misc_feature (756)..(756): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcgaggtggggcgcagggactggttagaacggtccttacgggacgtacccctgtcccctacaccctggccgtctgtctagtgggtcggttctcgtagttcggttactacgtggacgtcgtacggtactcccggaccgtaccggtaccccggaagggggaacggggtccgttaggggaggttggggtaacgggtttagggggaacgtaccgtaagtaccgaacgggaacgggggtaactaacccaactacccgaaccccgttcctaacgaagtacggtcgaacgtacaaacgtagtacgacgtaaggtaaccgaacctaaccggtaacccaaacggtaaccctaccggtttacccgtacccggttaacggtaaggttttaccggtacgttttccgttagggtacccgtaaacccggggtcgggtaacccgggaccggtaccgggttcgttagggttacgtttaaacgtttcgttggacggtaccgtagtaccggtaggtcgggtaccgttggggttacccgnggttaccgtcggggtacgggccgtaaccggggtacccgttggtacccgtaccgtcctcgtacgngtaccctaccgacggtaccggccctaacggtcccgttcccgtccccggtccgg

SEQ ID NO: 38098 - DNA, 870 bp, Homo sapiens
  misc_feature: GYAE6OF01CGKFJ.43.29.C07.1.454.CMB.1.raw
  modified_base (108)..(108): a, c, t, g, unknown or other
  misc_feature (108)..(108): n is a, c, g, or t
  modified_base (158)..(158): a, c, t, g, unknown or other
  misc_feature (158)..(158): n is a, c, g, or t
  modified_base (178)..(178): a, c, t, g, unknown or other
  misc_feature (178)..(178): n is a, c, g, or t
tcagtgtgagtagtcacgaccggtgctcgatttagagtgctacgaagggaaaggggatgggaagtgctttctgagagtcatggacctcctgcacaagaacatgaaacnctgtgttcttcctcctcctggtgcagctccagatggtcctgtcccaggtncagctacagcgaggtgggcncgaggtacttggttagaacgtccgttacggacgtaccccgttcgttcccctctaccgtgccgtccttagttaccgttaggttcgggttcgggttcctttaggaggtttcggtttaaccgtacgttgggacgtcgtggtaccgttcccggaccgtaaccggtacccggaagggggtaacggggtcgttagggtaacggtagggttaagggtttacggggaaacttcgtaaaacgtcggaacgggtaacgggggtaaaccttaacccaaaccgttacccgtaacccccgttccctaagtaaacggtacgtacggtaacgtaccaaacgtattaacggacgaacggtaacgaccgtaaccgtaacccgaaaacgttaaccctacggtttaccctaccggttaaggtaacgtttcgggttaaccgtttcgtacggtaccgggttacccggtacggaccgggtaaccgacggttcgttaggtttagttactttaggtcggtagaccggttagtcgtaaggttcgggtacgtttacgggtaccggttccggtacgtaccgggtacgggaccggtaaccgggttacccgtccggtccgtaaccggttcccgtacgttacccggcggttccccgtaaccccggaaccggtaccccggtaccttaccggtttccccggttaccccgtcccccgggtaccgg

SEQ ID NO: 38099 - DNA, 746 bp, Homo sapiens
  misc_feature: GYAE6OF01CL7KF.43.29.C07.1.454.CMB.1.raw
  modified_base (166)..(166): a, c, t, g, unknown or other
  misc_feature (166)..(166): n is a, c, g, or t
  modified_base (179)..(179): a, c, t, g, unknown or other
  misc_feature (179)..(179): n is a, c, g, or t
  modified_base (594)..(594): a, c, t, g, unknown or other
  misc_feature (594)..(594): n is a, c, g, or t
tcagtgtgagtagtcacgaccggtgctcgatttagagtgctacgaagggaaaggggatgggaagtgctttctgagagtcatggacctcctgcacaagaacatgaaacacctgtgttcttcctcctcctggtgcagctccagatgggtcctgtccaggtgcagctanagcgaggtgggcncgaggtacttgttcgaacgtccgttcgggacgcccttcgtaccctccaccgtcggcgtacttcgtcgttaggtcggggttcggttccttgtacggttcgtttaacgcgtggactcgttcggactcccgacgtaccggtaccggaagggggaggtcgtagggagtcgggtaggttacggggaatcgaaagtccgaacgggaacggggtaaacctaccgaaaccgtacccaaccccgtccaagaacggtacgtacggtacgtaacaaacgagttaacgactaacggtaccgaacctaaccgtaaccgaaacgtaacccgttacgtttccctaacgtaggtagttcgtacgttcgtgaccggtacccgtacggccgaaccgtggtcgttggttaacgttattcgtggtcggagtacgngtgggtccggtacgttacgggttacgcggtacgttacgggcgggtaaccggtaccggttaccgtcgtcccgtacgttcccgtaccgtagtccggttaacccacccggtaacggtaccggtcctacccggttcccgttcccgttcccggcccg

SEQ ID NO: 38100 - DNA, 856 bp, Homo sapiens
  misc_feature: GYAE6OF01CO20Q.43.29.C07.1.454.CMB.1.raw
tcagtgtgagtagtcacgaccggtgctcgatttagagtgctacgaagggaaaggggatgggaagtgctttctgagagtcatggcctcctgcacaagaacatgaaacacctgtgttcttcctcctctggtgcagctccagagtgggtcctgtcccaggtgcagctacagtcgaggtgggcgcgaaggtacgttgttacggaaacgttccgttcggaacgtcccccgttgtacccctctaaccgtgccgtcttgtactagtgggttgggttcccttagaggttcggtaacttacgtgggacgtgtacggtacttacccgccgtaacggttacccggaggggaacggggtccgtagggaggttacgggtaagtttagggggaaacttcgaaacgttacgaacgggtaaggggaaacctaaccgtaaaccgtaacccgtaaccccgtaccgtacgaaggaactacgtaacgtacaaacgtataacgacgaacgtacgaacgaaccgtaccgaaaacgtaaaccgtaacgtttacccgacccgttaaggtaacggtttacggtaacggtttcgtacggttacgtaacccgggttcgaaccgggtacggtaccggttaccgttaggttaagttaaacgttttaggtttcggtacgggccggtaagtacggtaaggttccgggtacggttaccgggtaccgggttcgtaacccgttacgggtaccgggaccggtaaacggggtaccccgttacggacccggttacccgttacccgtaccgtacccgtaaccggttaccttacccggaaaccggtaccggtacccgtacccgtttacccggttccccgttccccgggtacccgg

SEQ ID NO: 38101 - DNA, 858 bp, Homo sapiens
  misc_feature: GYAE6OF01CC50T.43.29.C07.1.454.CMB.1.raw
  modified_base (250)..(250): a, c, t, g, unknown or other
  misc_feature (250)..(250): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctccgtggtggcagcctcccagagtcggtcctgtcccaggtcgcgagcctacagcgaggtgggcgtacgaggtacttggttagaacgtcccgttcggaacgtcccctcgtccctcgaccctgccgnttgtctagtcgggtcgtcctgtagttcgtactagtggacgtctcggactcccggaccgtaccggtccggaaggggtacggtcgtaggtacggtgggtaggtacggggtaaagtctaagtaccgaagggaaacgggtaacctaacccgtaacctaaacccgtaaccccgtacctacgaaaaccgtcggtacggactaccgaaatacgtaacgaccgaaggttacgaaccgtaaccgtaaccgaaacgttaccgttaccggttcctaccggttaaggttacgttacggttacgttaccggttacggtaccggtaacccggtccggtaccggtaaccggtacggttcggttacggttcgttaaacgtttgttacggtacggtaccggtacgtccggtaggtaccggtacggttacccgggttaccggtaccgggttaaccgttccggggtacggggtaacccggttaacccgggtacgttaccccggaccgttacccggttccctacccggtacccgtcccgggttaccccgttaacccggtaaaccccgggtaaccccggtcccgttacccggggtttcccccgttcccccgttccccgggtaccccggg

SEQ ID NO: 38102 - DNA, 541 bp, Homo sapiens
  misc_feature: GYAE6OF02JIY4I.43.29.C07.1.454.CMB.1.raw
  modified_base (504)..(504): a, c, t, g, unknown or other
  misc_feature (504)..(504): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtcccctcacctgcgctgtctatggtgggtccttcagtggttactactggagctggatccgccagtccccagggaaggggctggagtggattggggaagtcaatcacaggggaagtaccaactacaacccgtcctcaagagtcgagtcaacatagcagtagacacgtccaagaaccagttctccctgaagttgaagttctgtgaccgtcgcggacacggctgtgtattattgtgcgagcagtggctggtaccgtggctacgtggggccagggaaccctggtcaccgtctcctcngccttccaccgacgggcccatcggttctccccgtcgg

SEQ ID NO: 38103 - DNA, 541 bp, Homo sapiens
  misc_feature: GYAE6OF02F5R57.43.29.C07.1.454.CMB.1.raw
tcagtgtgagtagtcacgaccggtgctcgatttagagtgctacgaagggaaaggggatgggaagtgctttctgagagtcatggacctcctgcacaagaatatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagtcccccaggaaggggctggagtggattggggaagtcaatcacaggggaagtaccaactacaacccgtccctcaagagtcgagtcaacatagcagtagacacgtccaagaaccagttctccctgaagttgagttctgtgaccgtcgcggacacggctgtgtattattgtgcgagcagtggctgggtaccgtggctacgtgggccagggaccctggtcaccgtctcctcagtccttccaccagggcccagtccggtcttcccccgtcgg

SEQ ID NO: 38104 - DNA, 558 bp, Homo sapiens
  misc_feature: GYAE6OF02HE7VD.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagtccccagggaaggggctggagtggattggggaagtcaatcacgaggggaagtaccaactacaacccgtccctcaagagtcgagtcaacatagcagtagacacgtccaagaaccagttctccctgaagttgagttctgtgaccgtcgcggacacggctgtgtattattgtgcgagcaggtggcgtgggtaccgtggccttacgtcggggccaggggaaccctgggtccaccggtctcctcagtccttccaccgaacgggccccagtccggttccttccccgtcgg

SEQ ID NO: 38105 - DNA, 560 bp, Homo sapiens
  misc_feature: GYAE6OF02IS7JG.43.29.C07.1.454.CMB.1.raw
  modified_base (453)..(453): a, c, t, g, unknown or other
  misc_feature (453)..(453): n is a, c, g, or t
  modified_base (485)..(485): a, c, t, g, unknown or other
  misc_feature (485)..(485): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgcagtccccgagggaagggctggagtggagttggggaatcgaatcgaacgaggggaataccaaactaccgaacccgtccctacgaagacgtcgagtcaacatagacagtagacacgtcaaagaaccagttctcctagaagttgagttctgtcgaccgtgacggacacggctgtgtattatgtagngagcaggtcgcgtaggtaccgtggcttacggngggtaccagggaccctgggccaccgtctcctcacgtcctaccgacgacgggcccagtccggttcctccccgtcgg

SEQ ID NO: 38106 - DNA, 547 bp, Homo sapiens
  misc_feature: GYAE6OF02JDMX0.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagtccccagggaagggctggagtggattgggggaagtcaatcacgaggggaagtaccaactaccaacccgtccctacaagagtcgagtcaacatagcagtagacacgtaccaagaacccagttcctccctgaagttgagttctgtgaccgtcgcggacacggctgtgtattattgtgcgagcagtggctggtaccgtggctagtgggccagggaccctggtccaccggtctcctcagtccttccaccgacggcccagtccggtcctccccgtcgg

SEQ ID NO: 38107 - DNA, 551 bp, Homo sapiens
  misc_feature: GYAE6OF02FVKJH.43.29.C07.1.454.CMB.1.raw
  modified_base (422)..(422): a, c, t, g, unknown or other
  misc_feature (422)..(422): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagtccccagggaagggctggagtggattggggaagtcaatcacaggggaagtaccaactacaacccgtcctcaagagtcgagtcaacatagcagtagacacgtccaagaaccagttctccctgaagttgagttctgtgaccgtcgcggacncggctgtgtattattgtgcgagcagtggctggtaccgtggctacgtgggccagggaaccctgggtccaccggttctccgtcacgtccttccgaccgaacgggccccagtcccggtccttccccctcggg

SEQ ID NO: 38108 - DNA, 540 bp, Homo sapiens
  misc_feature: GYAE6OF02GZR6E.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagtccccagggaaggggctggagtggagttggggaagtcaatcacgaggggaagtaccgaactacaacccgtcctcaagagtcgagtcaacatagcagtagacacgtcaagaaccagttctccctgaagttgagttctgtgaccgtcgcggacacgctgtgtattattgtgcgagcagtggctggtacgtggctacgtcgggaccagggaccctgtcaccgtctcctcacgtccttccaccgacggcccagtccggtcctcccctcgg

SEQ ID NO: 38109 - DNA, 562 bp, Homo sapiens
  misc_feature: GYAE6OF02IQYQF.43.29.C07.1.454.CMB.1.raw
tcagtgtgagtagtcacgaccggtgctcgatttagagtgctacgaagggaaaggggatgggaagtactttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagtcccccagggaaggggctgggagtggattgggggaagtcgaatcgacgaggggaagtaccaactacaacccgtcctacaagagtcgagtcaacatagcagtagacacgtaccaagaaccagttcctccctagaagttgagtttctgtgaccgtcgcggacacggctgtgtattattgtgcgagcagtggctggtaccgtggctacgtcgggccacgggacctggtccaccgtcgtcctcacgtccttccgaccgaacggcccagtccggtccttcccccgtggtccccg

SEQ ID NO: 38110 - DNA, 556 bp, Homo sapiens
  misc_feature: GYAE6OF02JEYIQ.43.29.C07.1.454.CMB.1.raw
  modified_base (182)..(182): a, c, t, g, unknown or other
  misc_feature (182)..(182): n is a, c, g, or t
  modified_base (243)..(243): a, c, t, g, unknown or other
  misc_feature (243)..(243): n is a, c, g, or t
  modified_base (514)..(514): a, c, t, g, unknown or other
  misc_feature (514)..(514): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgcgctgtctatggtggtccttnagtggttactactggagctggatccgccagtcccccagggaagggctggagtggagttgggggaagtcaatcgaacgaggggaagtaccaactaccaacccgtccctacaagagtcgagtcaacatagcagtagacacgtccaaagaaccagttcctcccgtagaacgttgagttctgtcgaccgtcgcggtacacggctgtgtattattgtgcgagcagtggctggtacgtggcttacgtgggccagggaccctggtcaccgtctccgtnacgcttaccgacgacgggcccagtccggtccttccccgtcgg

SEQ ID NO: 38111 - DNA, 547 bp, Homo sapiens
  misc_feature: GYAE6OF02GBY85.43.29.C07.1.454.CMB.1.raw
  modified_base (438)..(438): a, c, t, g, unknown or other
  misc_feature (438)..(438): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtcccctcaccctgcgctgtctatggtgggtccttcagtggttactactggagctggatccgccagtccccagggaagggctggagtggattggggaagtcaatcacgaggggaagtaccaactacaacccgtcctcaagagtcgagtcaacatagcagtagacacgtaccaagaaccagttcctccgtagaagttgagttctgtgaccgtcgcggacacggctgttntattattgtgcgagcagtggctggtccgtgctcgtgggccagggaccctggccaccgtctcctcacgtcttaccgaccgaacggcccacgtcggtcccttccccgtcgg

SEQ ID NO: 38112 - DNA, 590 bp, Homo sapiens
  misc_feature: GYAE6OF02FNZJL.43.29.C07.1.454.CMB.1.raw
  modified_base (455)..(455): a, c, t, g, unknown or other
  misc_feature (455)..(455): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctagtggtggtccttcgagtggttactctggagctggatccgccagtccccagggaagggctggagtggagttggggaagtcaagtcacgaggggaataccaactaccaacccgtcctacaagagtcgagtcaacatagcagtagacacgtaccaagaccagttcctaccgtagtaacgttgagtttctgtcgaccgtcgcggacacggctgtagtagttattcggngtcgagcgagtcggcgtaggtaccgtggcctacgtcggggccgaggggtacccttgggcccacccggttctcccgtcgtacgtccttacccgacccgtaacggggccccagttcccggtcccttcccccgtcggg

SEQ ID NO: 38113 - DNA, 590 bp, Homo sapiens
  misc_feature: GYAE6OF02IP5HT.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagttggttactactggagctggatccgccagtccccgaggggaaggggctggagggtggagttgggggaagtcgaagtcgaacgaggggaagtaccaactacaacccgtccctacaagacgtcgagtacaaacatagcaagtacgacacgtacaaagaaccagttacctccgtagtaagttgagttctgtcgaccgtcgacgacacggctgtagtattatgtgcgagcagtgcgtcggtaccgtgctacggtcgggaccgagggtacccgtggtaccaccggtctcccgtagacgtaccttaccgaaccgtacgggcccctaggtcccggttcccttccccgtcggg

SEQ ID NO: 38114 - DNA, 647 bp, Homo sapiens
  misc_feature: GYAE6OF02H0TWO.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgccgctgtctagtggtcggtccttcagttggttactactggagctggatccgccacgtccccgagggaagggcgtggagtggagttggggaagtcgaagtcacgagggaacgtaaccaacgtacaacccgtccacaagagtcgagtacaacatagacagtagacacgtaccaaagaaccagttcctaccctgtaagttgtagttctggtcgacgtcggcgacgacggcttgtagttatttagtgttgacgaggctaaggtcgggcgtacgggttaccggtggtccgttaacggtcggggacccgtaacggggaccccgttagggtcccgtaacccggttccctcccgttaccgacggtacccgttacccgaacccgtaacggggaccccctacgttcccgggttaccctttcccccggtacccggg

SEQ ID NO: 38115 - DNA, 548 bp, Homo sapiens
  misc_feature: GYAE6OF02F9I8D.43.29.C07.1.454.CMB.1.raw
  modified_base (472)..(472): a, c, t, g, unknown or other
  misc_feature (472)..(472): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtcctttagtggttactactggagctggatccgccagtccccagggaggggctggagtggattgggggaagtcaatcacgaggggaagtaccaactacaacccgtccctcaagagtcgagtcaacatagcagtagacacgtccaaagaaccagttctccctgaagttgagttctgtgaccgtcgcgacacggctgtgttattattgtgcgagcagtggctggtaccgtgctacgngggccagggaaccctggtccacgtcgtcctcacgccttccaccgacgggcccagtccggtccttccccgtggcccg

SEQ ID NO: 38116 - DNA, 926 bp, Homo sapiens
  misc_feature: GYAE6OF02FZIDQ.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcaggtggggcgcagtcgacgttgtagacgtccggtacggaccgtaccgtccgtccctacctccgtcgccgtcgttcgttacttaggttggggttccgggtttccttacggtacgggtttacgtttaaccgttacggtagggtacgtcggtacggtaccgtcccgaccgtaccccggtacccggggaagggggtacgggtcggtagggtacgggtaggttaggggtaaggggtaacgtaacgtaacgtaccggaaacggggtaaacggggtaaacccgtaacccgtaaaccgtaaccccgtaacccccgttacctaacggaaacggtacggtaacgtacgtaaaccaaacgtaagtaacgacgtaaacggtaaccgaaccgtaacccgtaaaccgaaaaccgtaaccgttaccgttacccgttaccggtaaggttaaggttcgttaccgtttacgtacgggtacccgtaccggtcgggaaccgtaacccggtcggttgttaggttaagttttaacgtttcggttggacggtaaccggtacgtacgggtagggttccggtaccgggtttaccggggttaccgtcgggttaaaccggttcgggggacccggggtaaccgggtaaaccccggggtttcccgtagggttacccccgttcccggttaccgtttacccgacggttcccgttaccctaaccccgggaaaccgggtccccggacgtttacccgggtttacccccgttccccccggtacccggg

SEQ ID NO: 38117 - DNA, 589 bp, Homo sapiens
  misc_feature: GYAE6OF02IIW03.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactatggagctggatccgccagtccccgagggaagggctggagtggagttggggaagtcaatcacgaggggaactaccaactacaacccgtccctacaagagtcgagtcaacatagcagtagacacgtaccaaagaaccagttcctccctagaagttgagttctgtcgaccgtcgcggacgacggtctgttgtattagtgtgcgagcgagtggcttgggtaccgttggccttacggtcggggaccgacggggtaaccctgggtacccaccggttcctccctcgacgtccttacccgaaccgacgggtcccaacggttccggttcccttcccccgtccgg

SEQ ID NO: 38118 - DNA, 546 bp, Homo sapiens
  misc_feature: GYAE6OF02GI73Z.43.29.C07.1.454.CMB.1.raw
  modified_base (182)..(182): a, c, t, g, unknown or other
  misc_feature (182)..(182): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgcgctgtctatggtggtccttcagttggttactactggagctggatccgccagtccccagggaacgggctggagtggattggggaagtcaatcacaggggaataccaactacaacccgtcctcaagagtcgagtcaaacatacgcagtagacacgtccaaagaaccagttcctaccctgaagttgagttctgtgaccgtcgcggacacggctgtgtatttatgtgcgagcgagtgcgtggtaccgtggactcgtgggccagggaacctgtacaccgtctacctcagtccttccaccgacggcccaagtccggtccttccccgcgg

SEQ ID NO: 38119 - DNA, 585 bp, Homo sapiens
  misc_feature: GYAE6OF02FJ8P0.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggactccgccacgtcccccgagggaaggggctggagtggagttggggaagtcaatcacgaggggaacgtaccaactacaacccgtcctcaacgagtcgagtcaacatagcagtagacacgtacaagaccagttcacctagaagttgacgtttcagtcgaccgtcgacggacacggctaggtgtattagttgtgacgtagcgtaggtaggtctagggtaccgttggtacctacgtcggggctacgggaccctggtccaccgtctccgacgtacgtccttaccgaccgtacgggccctaagtcccggttcctcccccgtacggg

SEQ ID NO: 38120 - DNA, 807 bp, Homo sapiens
  misc_feature: GYAE6OF02H892B.43.29.C07.1.454.CMB.1.raw
  modified_base (540)..(540): a, c, t, g, unknown or other
  misc_feature (540)..(540): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcaggtgggcgcaggactgttgaacgtccgttcggagaccttgtccctcacctgcgctgtctagtggtcggtccttcgaggttggttactacgtggagtcgtggtacgtccgccacgtaccccgaggggtaaacgggcgtggagtagggagttaggggaagtcaagtacacggaaggggaagtaacccgaaactaccgtaaccccgtaccgtacgaaacggtacggtcgaacgtacgaaacagttaagacgtaagtaagaccgtaacgtaaccgaaaacgtaaaccctaacggttccttccccgtaaggtaaacgttaggttacgtttaccggttaggtaccggtaaccgtaccggaccgggtaaaccncgggtaccgttggttaaccggtttaagtttaacgttttcggcgttacggacgacgtacgggtaggtaccgttacgggtacccggtacggtaccgttaccgggtacggggtacccgtaaacggggttaaccccggttacgggtcccggtaacccgttccccggtccccgttacggtaacccgtttcccgttaaccccccggtaaccggtaaccccggggtccccttaaccgggttacccgtttacccccggtttcccccggtcccggg

SEQ ID NO: 38121 - DNA, 621 bp, Homo sapiens
  misc_feature: GYAE6OF02GHXNG.43.29.C07.1.454.CMB.1.raw
  modified_base (577)..(577): a, c, t, g, unknown or other
  misc_feature (577)..(577): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtgggcgcaggactgttgaagccttcggagaccctgtccctcacctgcgctgtctagtggtggtccttcgagtggttactacgtggagctggatccgccacgtcccccgaggggaaggggcgtggagtggagttgggggaagtcaagtcgaacgaggggaacgtaccgaaactaccgaaccccgttccctacgaagacgtcggaacgtaccaaacatacggcaagtagaaccacgtaccaaacgaaccctacgttcctccctagtaacgttagtagttacgtggtacgaccgtcggacggtacgaccggtcgttggtagttattgttgtgacgagcgtaggtggcgtcggtccgtggcgtcggtcggccgacgggtacctcggtcgtacccgtctcctcgacnccttacccgaccgacggtcccagtccggttccctccccgtccgg

SEQ ID NO: 38122 - DNA, 692 bp, Homo sapiens
  misc_feature: GYAE6OF02HJA6B.43.29.C07.1.454.CMB.1.raw
  modified_base (388)..(388): a, c, t, g, unknown or other
  misc_feature (388)..(388): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtgcagctcccagatgggtcctgtcccaggtgcagctacagcagtggggcgcaggactgttgaagccttcggagaccctgtccctcacctgcgctgtctatggtggtcctcagttgttactacgtggagcgtggactccgccgagtcccccgaggggaacggggcgtggaggtggtaggttggggaagtcgaatcgacgagggaactaccaactacaacccgtccctacaagagtacgagtacaacatagacaagtanaacgacgacaaacgaaccagttcctacccgtagtaacgttgtagttcgttgtacggtaccggtacgacggaccgaacggtcgtgttacgttaatttagtttcgtgtacgagtcgtaggtcgggtcgttacgggttaccgggtacggtaccgttacggggtacgggacccgggaaccgggtaacccgttcgggtaccgtaccccggttccgtaccccgttacgtaccgttacccgttaccccgaacccggtaacccgggtcccctaacccggttcccggtttccccgttacccccggttcccggg

SEQ ID NO: 38123 - DNA, 635 bp, Homo sapiens
  misc_feature: GYAE6OF02JZOA5.43.29.C07.1.454.CMB.1.raw
  modified_base (388)..(388): a, c, t, g, unknown or other
  misc_feature (388)..(388): n is a, c, g, or t
  modified_base (586)..(586): a, c, t, g, unknown or other
  misc_feature (586)..(586): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggtactgttgaagccttcggagaccctgtccctcacctgcgctgtctatggtcggtcttcagtgtactcgtggagcgtggactccgccacgtccccgagggacggcgtcggagtgggagttggggaatcgaatcgtacgaggggtaacgtaccaacgtaccaacccgtcctacgaacgacgtacgagtacaaacagagcagtanacacgtacaagaccattctcctagtacgtgtacgttcgtacgtcgaccgtcgcggaacctacggtcttaggtacgtttacttagttacgtagtccggtacgtcgtagggttcggtacgttacgggtacccggttggtaccgttaacggttccgggaccggtaaccgggtacccgtgggtacctaccggtcttacccgngtaccgtaccttccgaccgtacggcctagtcccggtccttccccgtcgg

SEQ ID NO: 38124 - DNA, 586 bp, Homo sapiens
  misc_feature: GYAE6OF02IZEO0.43.29.C07.1.454.CMB.1.raw
  modified_base (181)..(181): a, c, t, g, unknown or other
  misc_feature (181)..(181): n is a, c, g, or t
  modified_base (242)..(242): a, c, t, g, unknown or other
  misc_feature (242)..(242): n is a, c, g, or t
tcagtgtgagtagtcacgaccggtgctcgatttagagtgctacgaagggaaaggggatgggaagtgctttctgagagtcatggacctcctgcacaagaacatgaaacactgtggttcttcctcctcctggtggcagctcccagatgggtcctgtcccaggtgcagctacagcagtggggcncaggactgttgaagccttcggagaccctgtccctcacctgcgctgtctatggtggtccttnagtgttacactggagctggatccgccagtcccccaggggaaggggctggaggtggagttgggggaagtcaagtcgacgaggggaagtaccaactaccaaccccgtccctcaagacgtcgagtcaacatagcagtagacacgtaccaagaaccagttcctccctagaacgttgtagttctgtgaccgtcgcggacacggctgtgtattattgtgcgagcgtagtggctgggtaccgtggcgttacgtcggggccaggggaaccctgggtccacccggttctcccgtcacggtccttacccgaacccgtacgggcccctagtcccggttcccgttccccctccggg

SEQ ID NO: 38125 - DNA, 651 bp, Homo sapiens
  misc_feature: GYAE6OF02HY9R1.43.29.C07.1.454.CMB.1.raw
  modified_base (173)..(173): a, c, t, g, unknown or other
  misc_feature (173)..(173): n is a, c, g, or t
  modified_base (261)..(261): a, c, t, g, unknown or other
  misc_feature (261)..(261): n is a, c, g, or t
  modified_base (377)..(377): a, c, t, g, unknown or other
  misc_feature (377)..(377): n is a, c, g, or t
  modified_base (397)..(397): a, c, t, g, unknown or other
  misc_feature (397)..(397): n is a, c, g, or t
  modified_base (482)..(482): a, c, t, g, unknown or other
  misc_feature (482)..(482): n is a, c, g, or t
tcagtgtgagtagtcacgaccggtgctcgatttagagtgctacgaagggaaaggggagtgggaaggtgctttctgagagtcatggacctcctgcacaagaacatgaaacactgtgttcttcctcctcctggtggcagctcccagatcgggtcctgtcccaggtcgcagctacngcaggtggggcgcaggctgttgaacgtccttcgggacgaccctcgtccctccacctggccgtctcgtactagtgggcgggttccttanagttcggttacttacgtggagcgtggactccgcagtccccgagggaacgggcgtggagtggaggttgggaagtcaatacacgaaggggaataccaaacgtacaacccgttcccganaacgagtccgaatccgaaantaagctagtacgactacgtacaaagaactacgttctacccgtagaacgttgtacttactgacgaccggttcgacggacacgggtntacggtgttactattgtgtacgagtcgaggtacggcgttacgggtaccgtcggtactcgggtgggtacccgagggtaacccgtcgggtaccgtaaccggtccttaccggtcacgtcccgttacctaccgtaacgggcccctaacgtccgtaccccgttcccgtaccggg

SEQ ID NO: 38126 - DNA, 659 bp, Homo sapiens
  misc_feature: GYAE6OF02HAJIG.43.29.C07.1.454.CMB.1.raw
tcagtgtgagtagtcacgaccggtgctcgatttagagtgctacgaagggaaagggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaacgccgttacggagacccgtgtcccctgacctgcgctgtctagtgggtcggtcccttgagttcggttaactactggagcgtaggatccgcacgtccccgagggaagggctggaggtggagttggggaatcgaagtcgaacgaaggggaaactaaccaaactaaccaaacccggttccctacgaaaggagtcgaacgtacaaacatagacaagtaacgactaacgtacaaagaaccagttcctaccgtagtaacgttagagttcagtcgaccgtgcgacaggctagttacgtattagttgagcgtagctaggtcggtacgtcgggtaccgttggaccttacgggtacgggacccgtaaggggtaacccctgggtacccaaccgggttcctacccgtacgtaacgttcccttaacccgaccgtaaccggggccctacggttcccggttcccttacccccgtacggg

SEQ ID NO: 38127 - DNA, 775 bp, Homo sapiens
  misc_feature: GYAE6OF02HM89Q.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtgcagctcccagatgggtcctgtcccaggtgcagctacagcaggtggggcgcgaggactggttagaacgtccttcgggacgtaccctcgtccctcacctgcgctgtctagtggtcggttccttcgagttcggttactacgtggacgcgtggactccgccgtacgtccccgaggggagggcgtgggtaggtggtaggttaggggaatacgaacgtacgacggaaggggaactaaccgaaacctaaccgtaaccccggtccctaacgaacggtacgtacggacgtaccgaaactaagtacgacgtaaggtaacgaaccgtaccgtaaccgtaaacgtaacccgttacgtttaccctacccgtaaggtaacggtttcgtaacgtttcgtacggtacggtacccggtcgggtaccgggaccgtacggtcgttaggttacgtttacgttagtttcggtggtacgtacggtgtacgggtcggtccggtacgggttaccggtcgggtacgttaccgggtacggggacccgtaacggggtacccgttcggtaccgtaccccggttcgttacccgtcgttccggtacccttacccgaacccggtaaccgggtcccctacgggttaccccggttccccgttccccggtcccggg

SEQ ID NO: 38128 - DNA, 705 bp, Homo sapiens
  misc_feature: GYAE6OF02H0EBA.43.29.C07.1.454.CMB.1.raw
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (437)..(437): a, c, t, g, unknown or other
  misc_feature (437)..(437): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcgaggtggggcgcaggactggttgaacgtccgttcggacgacccctcgtccctacacctgccggcttgtctagttcgggtcggttccttcgaggttcggttactacgtggagtcgtaggactccgccacgtccccgaaggggagggctgggagtaggtagttagggaagtcaagtcgacggagggaactactaacaccaacccgtccanaagacgtcgactacaanacgtacgacaagtacgaactacgtacaaacgtaaccgtnttaccgtaccgtagtagttcgtacgttcgtagtacgacccggtggaccgacgtacggtcttaggttagttaatttagttggtacgtacgtacggtatgggtacgggtcgttacggggtaccggtcggtaccgtttccgggacggggaacccgtaacgggtacccggttgggtaccccgtaccgttccgttacccgtccgaccgttcccttacccgaaaccggtccgggaccccttaaccggtcccggtttccccgtcccccgtacggg

SEQ ID NO: 38129 - DNA, 645 bp, Homo sapiens
  misc_feature: GYAE6OF02FY0RB.43.29.C07.1.454.CMB.1.raw
  modified_base (216)..(216): a, c, t, g, unknown or other
  misc_feature (216)..(216): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttggagaccctgtccctnacctgcgctgtctatggtggtcttcagtgttactactggagctggatccgtcacgtccccgagggaagggctggacggtggagttggggaagtcaagtcagagggaataccaactacaacccgtcctacaagacgtcgaagtcaaacatagacaaggttagacaacgtaccaaagaacctagttacctaccgtagtaagttagaacgttcgtgtacgtaccgtcgacggactacggtctggtacgtagttacttgtgtacgtagtacgtaggtcggtacgttaggtaccgtaggtcgtaacggtcgggacccgtaaggggtaacccgtcgggttacccaaccggttccgtacccgttacgaacggttcccttaacccggaccgtaaccgggtcccctaggttcccggttacccgttccccccgtacggg

SEQ ID NO: 38130 - DNA, 828 bp, Homo sapiens
  misc_feature: GYAE6OF02HWJMG.43.29.C07.1.454.CMB.1.raw
  modified_base (192)..(192): a, c, t, g, unknown or other
  misc_feature (192)..(192): n is a, c, g, or t
  modified_base (690)..(690): a, c, t, g, unknown or other
  misc_feature (690)..(690): n is a, c, g, or t
tcagtgtgagtagtcacgaccggtgctcgatttagagtgctacgaagggaaaggggatgggaagtgctttctgagagtcatggacctcctgcacaagaacatgaaacacctgtggtttccttcctcctcctgggtggcagctcccagtatcgggttcctcgcccaggtgctagctacagcgaggtcggggcncgaaggtacttggttagaacgtccgtttcgggaacgaccccgttcgtccctaccgtacctcggccgtcgttcgtaccgttaaggtcggggttcgggttcccctttacggaaggtttcggggtttaaacctacggtagggtaccgtacgtacggtaaccgttccccggaacccgtaccggtaccccgggaagggggtaaccggggcttaggggtaagtacgggtacgggttaacgggggaacgtacgtaaagtaccggaacgggtaaacgggggtaacctaaacccgtaaaccttaaccccggaaccccgtttacccaaaggtaacggtacgtacgaagtaacccaaagtagtacgacgaaagtaacgacctacgaaaccgaaatacccggtactttaccgtaacgtaggtaaacggttacgtacgtttccgacgttacggaccgtcggaccggtaacgcggtattaggtagttaacgttagttcggtacgtacggtanccgtaggtacggtccgtaacgggtccgttaggccggtttaacgggccgggtaacgacgggtacccgtcggacctccgtctacgtccgtcgtaccttacccgacgtaaccggcttaacgtccgtacccgtccgtaccgg

SEQ ID NO: 38131 - DNA, 772 bp, Homo sapiens
  misc_feature: GYAE6OF02JVE9P.43.29.C07.1.454.CMB.1.raw
tcagtgtgagtagtcacgaccggtgctcgatttagagtgctacgaagggaaaggggagtgggaagtgctttctgagagtcatggacctcctgcacaagaacatgaaacacctgtggttcttcctcctcctggtggcagctcccagatgggtcctgtcccaggtgcagctacagcagtggggcgcgaggactgttgaagccgttcggagaccctgtcccgtcacctgcgctgtctatggtggtccttacgagttggttactacgtggagtctgggactccggccacggtcccccgaggggtaacgggcgtgggaacgtaggagttggggaagttcaagtccgaacggaggggaactaacccgaaacgtacctaaaccccggtcctacgaaaagcgtacgaacggttaccaaacgatacgacgtaacggtaacgaccgaaccgttacccaaacgtaaccctagttacccgtacccgtagtaaacggtttcgtacggttacgttacggtacgtaccgttaccggacggtaaccgtaccgggtcgtttacggttacgtttaacgtttaagttcggtacgtacggaacggtcgtaaacggttacgggtccgttaccgggtaccgggtacggttaccgttaccgggttacgggaccgtaaccgggtaacccgttcgggtaccctacccggtcgtacccgttcgtaccggtacccttacccgaacccggtaccggtccccgtaacggtttccccggttacccgtttacccccgtccggg

SEQ ID NO: 38132 - DNA, 776 bp, Homo sapiens
  misc_feature: GYAE6OF02I0E89.43.29.C07.1.454.CMB.1.raw
  modified_base (181)..(181): a, c, t, g, unknown or other
  misc_feature (181)..(181): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctccagatgggtcctgtcccaggtgcagctacagcagtggggcncaggactgttgaagccttcggagaccctgtccctcgacctggccgctgtcctagtgggtcggtcctttcaggttggttaactacgtggagtctggactccgaccagtccccgaggggaggggctggaggtggagttggggagtcgaagttcacgaaggggaactacgaacctacaaacccgttccctacaaggcgttacgacgttacaaactacacgacgtaagtacgtaacaaccgtaccgaaaacgtaacccgtagtttccctacccgtaggtaaacggttcgtaacgttttcgtacgttacggtacccggtacggtaccgggaacgaccgggtcctttacgggttcgtttaacgtttaacgtttcggtacggtaccggtacggaccttaacgggttcgggtacccgtttacggggttacccggtcgggtacctttaaccggggtccggggtaccgaacgggggtaaccccttggggtaacccgttacccggtcccgttaccgttaccggaccgttacccgtttaccccgaacccggtacgggtaacccccgtaggtcccccgggttttaccccttaccccccggtcccgggg

SEQ ID NO: 38133 - DNA, 706 bp, Homo sapiens
  misc_feature: GYAE6OF02GHE7V.43.29.C07.1.454.CMB.1.raw
  modified_base (181)..(181): a, c, t, g, unknown or other
  misc_feature (181)..(181): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtgggcncaggactgttgaagccttcggagaccctgtccctcacctgcgctgtctagtggtggtccttcgagtgttacactggagctggatccgccacggtcccccgaggggaacggggcgtgggaggtgggacgttagggggaacgtacgaagtccgaacggaaggggaacgtaacccgaaaccgtaacccgaaaccccgtcccctacgaacgacgttccggacgtacaacaatacgacaagtacgaactacgtaccaaacgaaccgagtttacccaccgtagaacgttcgtacgtttctcggtacgacccgtcgacggacctaccgggtcttacggttgtaacgtttagttcggttgcggtagccgtaggtcggtacgttcgggttaccggtggtaccgttaccggtcggggccgaacgggttacccgtagggttccccgtaccggttcccgttcccgttacgaccgttacccgttaccgaacccgtacggtacccgtaccgttacccggtcccctttaccccggtccgg

SEQ ID NO: 38134 - DNA, 715 bp, Homo sapiens
  misc_feature: GYAE6OF02JLBEV.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcgaggtactggttgaagtcccttcggagacccctgtcccctcacctgcgcttgtcctagtgggtcggtccttcaggttggttacacgtggagtctggactccgccacggtccccgagggagggctggaggtggagttgggagtacgatcgacgagggactaaccgaacgtaccaacccgtccctagaagcgtacgagtacaaacagtacgacaaggtaacgaccgtacggtacccaaaggtacctacgttacctaccctagtaacgtttagtacggtttacgtacggttacggtaccggtccggaacggtaccgtaaccggtcgtagttacggttactttaaggttcggtacgacggtacgtacgtaggttacggtccgttagggttaccggtgtccgttacggtacgggacccgacgggttaaccccgtcgggtaccgttacccggtaccgttcccgtcgtaccgttacccgtttaccaacccggtaaccggtcccgtaacggttcccgttacccggttcccccgtaccggg

SEQ ID NO: 38135 - DNA, 762 bp, Homo sapiens
  misc_feature: GYAE6OF02IDFT7.43.29.C07.1.454.CMB.1.raw
tcagtgtgagtagtcacgaccggtgctcgatttagagtgctacgaagggaaaggggatggaagtgctttctgagagtcatggacctcctgcacaagaacatgaaacacctgtggttcttcctcctcctggtggcagctcccagatgggtcctgtcccaggtgcagctacagcagtggggcgcagggactgttgaagccgttcggagacccctgtccctcacctgcgctgtctatggtggtccttcgagttcggttactacgtggagcgtggatccgccacgtcccccgaaggggaacggggcgtagggacggtgggtagttgggggaagttcgaagtcgaacggaggggaaacgtaaccgaaactaccaacccgtacccgtacgaacggacggtcgaacgtaccaaacgtataggctaaggttaacgaaccaccgtaaccaaacggtaaaccctaggtttacctaccccgtagtaaacggtttcgtaacggttttccgttaaggtaccggtaaccggttccggacccgggtactaaccgggtcttacggttagtttacgtttaggttaggttcggacggtagtacgtaagggttcgggtcgtacgggttaccggtgggtaccctacgggttacggggacccgtaacgggtaaccccgttgggtacccgtacccggttctacccgttacgaccggttaccgttcccggaaccgtaaccggggtccctaacggttccccggtttcccctacccccgggttccgg

SEQ ID NO: 38136 - DNA, 680 bp, Homo sapiens
  misc_feature: GYAE6OF02JHV4V.43.29.C07.1.454.CMB.1.raw
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagtccttcgganaccctgtccctcacctgcgctntctagtggtggttccttcaggttggttactcgtggagctggactccgccacgtccccgaggggaagggcgtaggacgtgggacgtttagggggaactcgaacgttcgaacggaaggggaacttacccgaactaccgaacccgtccctagaacgtacggtcgaagtacaaactatacgactaggtacacgaacgtaccaaacggaaccctaggttccctacccgtagggtaaacttacggtaacgtttcgtacggtcgtaacccggttcggacccgggtaacgtaaccggtcgtcgttagttaacgttaggtttacgtgaccggtaacgctaggtcggtcggtcggtaccgtgggtcctaaggtcgggacctacgggaaccgttcggtaccaccggtcctctacgacgtcctcccgaacgtaccggcctaccgtcggttaccctccccgtcgg

SEQ ID NO: 38137 - DNA, 749 bp, Homo sapiens
  misc_feature: GYAE6OF02GWWJG.43.29.C07.1.454.CMB.1.raw
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctcctcctggtggcagctcccagatgggtcctgtcccgaggtgcagctacgagcaggtggggcgcagggactgttgaacgtccgttcggacgtaccctgtccctcgacctgcgctgtctanggtggtccttcgagttgtacacgtggngctgactccgcacgtccccgagggagggctgggagtggtagtggggaatcaagtcgaacggtagggaactaccgaactacaacccgtccgtacaaggtacgtcgaacgtaccaaagataggacaggtaacgcgtaaccgtcccgaaaaggtaaccctacggttcctaccccggtaaggtacggttacgttacgttacggttcgacggtacccggttacggaccggaaccggtacggtaccttaggttacgtttaactttacggttacggttcgacggtaacggtacggtaggttccgggtaccggtttaccgggtacccgggtacggtccgttaaccgggttcggggaacccggtaacgggttaaccccggttgggtaccccgtacccggttacccttcccgtcgtaaaccggtccctttacccggaacccgtaaccgggtaccctaaccggttcccggttcccgttcccccgtaccggg

SEQ ID NO: 38138 - DNA, 725 bp, Homo sapiens
  misc_feature: GYAE6OF02F6KYL.43.29.C07.1.454.CMB.1.raw
  modified_base (170)..(170): a, c, t, g, unknown or other
  misc_feature (170)..(170): n is a, c, g, or t
  modified_base (273)..(273): a, c, t, g, unknown or other
  misc_feature (273)..(273): n is a, c, g, or t
tcagtgtgagtagtcacgaccggtgctcgatttagagtgctacgaagggaaaggggatcgggaagtgctttctgagagtcatggacctccgtgcacaaggaacatgaaacacctgtggttcttcctcctcctgggtcggcagcctcccagatgggtcctagtcccaggtncgagctacagcaggtggggcgcaggactgttagaagtccttcggacgaccctgtccctcacctgcgctgtctagtggtggtccttgagtgttactacgtgganctggactccgacacgtcccagggacgggctggagtggagtggggagtcagtcagagggaacgacaactaccaaccgtccacgaagtacgtacgacgtacaaactagtacgactaagtacgactaaccgtacaaacgaacccgtagttccctaccgtagtaacgtttagtacgtttacgcggttaccggaacccggttcggaccggaaccgacggttcgtagttacgttagtttagttggacgtcgacgtccgtaagggttcggtcgtacggggttaccgtcgtaccggttacgggcggggttaaccggaccgggttaaccccgtgggttacccctaacccggttcccgttacccgtccgtaacccggtttcccctaaccccgtaaccccggtaaccgggtccccctacgggtttaccccccggtttaccccggttccccccgttcccggggg

SEQ ID NO: 38139 - DNA, 861 bp, Homo sapiens
  misc_feature: GYAE6OF02ITWBD.43.29.C07.1.454.CMB.1.raw
  modified_base (186)..(186): a, c, t, g, unknown or other
  misc_feature (186)..(186): n is a, c, g, or t
  modified_base (212)..(212): a, c, t, g, unknown or other
  misc_feature (212)..(212): n is a, c, g, or t
tcagtgtgagtagtcacgaccggtgctcgatttagagtgctacgaagggaaaggggatggggaagtgctttctgagagtcatggacctcctgcacaagaacatgaaacacctgtggttccttcctcctcctggtggcacgctcccagatgggtcctgtcccaggtgcagctacagcaggtggggcncaggactgttgaacgtccgttcgganacctcgtaccgtcccacctacgtcgctctcgtaccgtaggtgggtccgttctagtaggttaccgtactaggaggtcgtggtacgaccgtccccgacgtacccggaccgggaaggggtacggtcggaggtaggtacggtagggtaggtactagacgtacggaagggtaacggtaactaacctaaccgtaacccgtacccgtacaaacggacggtaccgtacgtaacctaaccaaagttaccgtaacgaagtaacggtaacgaacccgtaacgtaaccaaaccggtacccgtttaccgtaccttaccggtaaagtttacgtacggttacgtacggttgggtaaccccggtacggacccggggtaacgtacccgggaccgttaggtttagttacggtttaactttacggggttcggtaaaccggacgtacggttaaccgggtacggtttccgggtaacggtttaaccggggttccgtaccgggttaaccggggttcccgggaaccgggggttaacccgaacccggggttccggtacccggttaaccccgtccgttaacccgttacctaccggtacccgtttacccggtaaccccggggacggtaccccgggtactttacccccgggtttcccggttacccccttacccgggg

SEQ ID NO: 38140 - DNA, 867 bp, Homo sapiens
  misc_feature: GYAE6OF02HP14F.43.29.C07.1.454.CMB.1.raw
tcagtgtgagtagtcacgaccggtgctcgatttagagtgctacgaagggaaggggatgggaagtgctttctgagagtcatggacctcctgcacaagaactatcgaaacacctgtggttccttcctccgtccctgggtaggcacggtcctacccagattcgggtcctgtcccgaggtcgcgagctaccgagccgaggtggggcgcgtaggacctggttagaacgtcgttcgggaactccctcggtacccttcgaccgtggccgtcgttagtcctaaggttcgggtcggttccctttagaggttcgggttaactacgtggaacgtgtacggtcgttccggccgaaccggttcccgggaaacggggtacggggtccttacggggtacggttacgggtaacggttagggggtaaccgtacttaacggtaccggtaccggaaacggggggtaacttaaccccggtaaacgttaaacccgaaccccccggtttccgttaaacccggaaaggtacgggttaccgtaacggaaccgtaaacgttaacgggtaccgaagtaaacggttaggaaacccgttaccggaaccgtaaacggtaacccgtaccggtttaaccctcccgggtaagtaacggttacgtaacgttcggtacggttacggaccggtacggtaccggaccgtacggtcgttacggttacgtttacgttaacgtcgttaaacggccgtaggtaccttagggccgtaccggtgggttaaccgtcggacgttacggtacgggaccgaacggttacccgcggtaaccgtccggtccgttaccgtcgtaccgtaccgccgaccgtacggacccgtaccggtcgttccccgttccgacccgg

SEQ ID NO: 38141 - DNA, 921 bp, Homo sapiens
  misc_feature: GYAE6OF02IQ8C9.43.29.C07.1.454.CMB.1.raw
tcagtgtgagtagtcacgaccggtgctcgatttagagtgctacgaagggaaaggggatgggaagtgctttctgagagtcatggaccctcctgcacaagaacatgaaacacctgtggttcttcctcctcctggtggcagctcccagatgggtcctgtcccaggtgcagcctacagcaggtggggcgcaggactggttgaacgccttacgggacgacccctggtccccctcacctgccgctgtctagtcggtcgggttcccttcgagttggttacctacgtcggagtcctggactcccggacctacggtaccccccggaaggggggaacggggtaccgtagggacggttagggaggtttacgggggggaagttacgaacgttccgaacggtaacgggggggtaaaccgtaacccgtaaaaccggtaaccccgtaaacccccgggttacccccgtaccgaaaacgggttacggaaccgggtaacggttaccaaaacgtaagttaacggaccggtaaacggtaaaacgggtaacccctaaaccgggttaaccccgaaaaaccggtaaaaccccttaaccggttttaaccccccgtttacccggttaaaccggtttaacgggtttaccggtttaacggttttaccgggtacggtttaccgggtaaccccgggttaccggacccggggtaaccgtaacccggggtcgttacggttaaccggtttagtttaacgtttggttacggacgtaacggtcgtagggttcggtacgttacggggtacccggttgggtacccgttacgggccgggtaccggaaccgggttaacccggtcgggtaccaacccggttcctacccgtacgtccttacccgtacccgtaaccggtacccgggtaccctaccggttcccgtcccgttcccccggtccgg

SEQ ID NO: 38142 - DNA, 793 bp, Homo sapiens
  misc_feature: GYAE6OF02F6NKH.43.29.C07.1.454.CMB.1.raw
  modified_base (507)..(507): a, c, t, g, unknown or other
  misc_feature (507)..(507): n is a, c, g, or t
  modified_base (643)..(643): a, c, t, g, unknown or other
  misc_feature (643)..(643): n is a, c, g, or t
  modified_base (656)..(656): a, c, t, g, unknown or other
  misc_feature (656)..(656): n is a, c, g, or t
  modified_base (682)..(682): a, c, t, g, unknown or other
  misc_feature (682)..(682): n is a, c, g, or t
tcagtgtgagtagtcacgaccggtgctcgatttagagtgctacgaagggaaaggggagtgggaagtgctttctgagagtcatggacctcctgcacaagaacatgaaacacctgtggttcttcctcctcctggtgcagctcccagagtggtcctgtcccaggtgcagctacgagcgaggtcggggccgcgaggacttggtttaggaacgtccgtttacgggacgtaccccttggttccccctctacccgttgccgtccttaggttacctaaggttcgggttcgggtccttttacggaggtttacggtttaacctaccggtggtacgtccgtaggtactcccggacgtaccggtaccccggagggggtaacgggtccgtgggtaacggtggttaggtaacggggtaactacgtaaaccgttcgaaccggaaggggtaacgtaacccgtaaacctaccgtaaccccgttccgaacgtaaacggtcgtaccggtaagtacccgaaaacgtntaacgggtactacggtaaccgaccgtacggttaaccaaacgtaccgtacgtttccgacccgtaggttaacgttgaccttgtacgacggtacccgtagacggtccgaagtcttcggtattaacgttgtcgtcgaacnggacgtgtcggtntaccggttcgacggtccgtaacgggnggaaccctaacgggtacctggttacccacccgggtttcacccggttactcccttaccggacccaccgggtaaccgtccccgttaggtacccttcccggtttacccggccgg

SEQ ID NO: 38143 - DNA, 750 bp, Homo sapiens
  misc_feature: GYAE6OF02HVPFR.43.29.C07.1.454.CMB.1.raw
  modified_base (180)..(180): a, c, t, g, unknown or other
  misc_feature (180)..(180): n is a, c, g, or t
  modified_base (348)..(348): a, c, t, g, unknown or other
  misc_feature (348)..(348): n is a, c, g, or t
tcagtgtgagtagtcacgaccggtgctcgatttagagtgctacgaagggaaaggggatgggaagtgctttctgagagtcatggacctcctgcacaagaacatgaaacacctgtgttcttcctcctcctggtgcagctcccagattgggtcctgtccaggtgcagctacagcaggtgggcncaggacgttgttaggaacgtcctttacgggacgtaccctcgtccctacacctggccgacttgtactaggttcgggtcggttccttacgaggttcggttaacgtacgtggacgtcggtaggacttccccggctaccggtaccccgaagggggtaacgggtctacggggnggtaggtaggttaacggggtagtacgaacgtacgacggaacggggtaacaaccgtaacgtaaccctaaccccggtcctaagaacgcgttacggaactacaaacagtagactaacggtacaacgtaccgaaccaacgtaaactccgttactaccgtaggtacgtttgacgtttacgtgtacggtaccgtaccgacggtacgtaccggtcgtggttacttagtttaacgttcggagaccggtagcggttagtcggtcggtacgttacggtacggtagttccggggtacggtaacccgcggggttaccctgggtaccctaccggtcccttaccggtcaccggttcccttacccgtaaccggtacccgttccgtaccggttaccgtttccccgtacccgtcccggg

SEQ ID NO: 38144 - DNA, 683 bp, Homo sapiens
  misc_feature: GYAE6OF02F67LL.43.29.C07.1.454.CMB.1.raw
  modified_base (185)..(185): a, c, t, g, unknown or other
  misc_feature (185)..(185): n is a, c, g, or t
  modified_base (231)..(231): a, c, t, g, unknown or other
  misc_feature (231)..(231): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttccctcctcctggtggcagctcccagatgggtcctgtcccaggtgcagctacagcaggtgggggcncgaggactgttgacgtccgttcggagaccctcgtccctcacctgcnctgtctagtggtcggtccttcaggtcgtactcgtggagctggctccgccacgtccccggagggagggcgtggacgtgggtagtagggggaatacaacgtacgaaggagggtaacgtaacccgaaaccgtaacctaaccccgtccctaanaacggaacgtcgaagtaccaaacgtanaagacagtaacacctacgtaccgaaacgaccgtacgttcccgtacctaggtaagttagtacgtttacgtggtaccgtaccggtaccggcgacgtaccgtgttgtcgttattacgtgtcgagcgcgtaggtcggtacgtggtcgtacgggtctacggcgggaccgtaccggtaccggtcggttaccgtaccgttcccgtcgttaccgaccggtaccgttaccccgaccgggacggttccccaccggtttcccgttaccccggttaccccgtcccggg

SEQ ID NO: 38145 - DNA, 875 bp, Homo sapiens
  misc_feature: GYAE6OF02HU298.43.29.C07.1.454.CMB.1.raw
  modified_base (108)..(108): a, c, t, g, unknown or other
  misc_feature (108)..(108): n is a, c, g, or t
tcagtgtgagtagtcacgaccggtgctcgatttagagtgctacgaagggaaaggggatgggaagtgctttctgagagtcatggacctcctgcacaagaacatgaaacncctgtggttccttcctcctcctggtgcagcctcccagagtggtcctgtccaggtgcagctacagcgtagggtggggccgcgtaaggtacttgttaggaacgtccgtttacgggacacccctcgtaccctcaccgttggcctcgtcgtctaagttcgggttcggttccttcgtaggttcggtttaacctacgtcgggtaacgtcggtaggtacgtccgccgtaaccgtcccccgggaagggggtaacggggtccgtaggggtacggttagggtaggtttaaggggacgttacgtaacgtacggaacggaacggggtaacctaaacctaaccgtaaccgtaaccccgtccgtaacggaaacgtcgaacgtacgtaccgaaatcggaacacgtaacggaacgtaaccggtaacgtaaccaaaaccggtaaccgtacgtttaccgtacccgtaacggttaaggttcgttaaacgtttccgttcgggtaccggtacgttcccgggagtaacccggaccggtcgttacggttacgttttacgtttagttacgtcggtacggacgttacggtaggttaccggggttctaaacccggggtttccggtcggtacccggtttaacggggtccggggtaacccggtaacggggttaccccggtttccgtaccccgaacccggtttccccggtaaccgttcggaaccccgtttaccgtaacccggacccgacccgggtacccttacccgggtcccctttacccccggtccggtccccgg

SEQ ID NO: 38146 - DNA, 927 bp, Homo sapiens
  misc_feature: GYAE6OF02GVXAV.43.29.C07.1.454.CMB.1.raw
  modified_base (239)..(239): a, c, t, g, unknown or other
  misc_feature (239)..(239): n is a, c, g, or t
tcagtgtgagtagtcacgaccggtgctcgatttagagtgctacgaagggaaaggggatgggaagtgctttctgagagtcatggacctcctgcacaagaacatgaaacacctgtggttcttcctctcctggtggcagctcccagatgggtcctagtcccaggtgcagctacagcagtggggcgcgaggacttggttagaacgtccgttcggacgaccccttggtcccctcaccgttgccncgtgtctagtgggttcggtccttcgtaggttcgttactacgtcggacgcgttggacttcccgaccgtacgtcccccgaagggggaacggggccgttggggtaacgttaggggtacggtttacgggggggaaacgtttaccgtaaacggtttacccgaaacggggtaaacggggggtaaaaccgtttaaccccgtaaaaacccgtttaaaccccgaacccccgggtttacccctaaccggtaaaccggtacgggttaacccgaacggttaccaaaaccgtaacgtacgtaccgtaaacggtacggtaaccctaccgtaacccggaaactaaaccccgttacggtttaccctacccgttaacggtaaacggtttacggtaccgttttaccgtacggttaccgggaaccccggtttacgggacccgggtaaccggtacccggttccggttacggtttacggtttaaccttttaagggttttccgggtcgtaccgggtaacggccggttacgggttccgggtaccggttttaccgggggtaccgttacgggtaccgtttaccgggcgggttaaacccggtacgggtaacccgggttcggtaaccccgtcggttccttaccgtaccctcgttacccttacccggaccgtaacgggccctaaccggtttccgttacccccgttcccggtcccgg

SEQ ID NO: 38147 - DNA, 823 bp, Homo sapiens
  misc_feature: GYAE6OF02G4A9Y.43.29.C07.1.454.CMB.1.raw
tcagtgtgagtagtcacgaccggtgctcgatttagagtgctacgaagggaaaggggatgggaagtgctttctgagagtcatggacctcctgcacaagaacatgaaacacctgtggttcttcctcctctggtgcagctcccagagtcgggtcctcgtcccagggtgacagtcctaacgagtcgagggttgggggccacgaagggtacttgttagaacgtcccgtttacgggacgtaccccgtcgtacccctctaccgtgcgtctcgttctagtcgggtcggttccttcgaggttacgttactacgtggagtcgtggacgtccgccacgtaccccggaaggggacgggtcgtgggacggtagggtaaggttacgggggaagttaccgaacgttaccggaaaccgggtaagggggtaaccgtaacccgtaaaccgttaaaccccgaacccccggtttacccgacgtaaacggtaccggtacgtaaccgtaccgaaactacgtaacgacgtaaaggtaacgaaccgtaaccggtaacccgaaacgtaaacccgttacgtttacccgtacccgtaagggtaacggtttacggttaacgtttcgtacgggtacccggtacccgggttacggtaacccgggtaccggtaccggttcgtaggttacgtttaagtttcggtaggtcggaacgtacggcgtaggtcgtacgtcggtacgtgaccgttagggtcggaaccggtacgtacgtccgtaccgtccgtcgtacccgtagtccctaccgttcccgacggtacccgtacccgttacggtccccggttcttaccccggcgg

SEQ ID NO: 38148 - DNA, 159 bp, Homo sapiens
  misc_feature: GYAE6OF01BDHH9.35.34.D01.1.454.CMB.1.raw
  modified_base (159)..(159): a, c, t, g, unknown or other
  misc_feature (159)..(159): n is a, c, g, or t
tcagtacagatcgtcacgaccggtgctcgatttagatcgtctgtgttggttgggtgtggtggtctccactccagccttgacgggctgctatctgcccctcggtcactctgttcccgcctcctcacgatctgtactgagcgggctggcaaggcgcatagn

SEQ ID NO: 38149 - DNA, 163 bp, Homo sapiens
  misc_feature: GYAE6OF01DJ8K4.35.34.D01.1.454.CMB.1.raw
  modified_base (163)..(163): a, c, t, g, unknown or other
  misc_feature (163)..(163): n is a, c, g, or t
tcagtacagatcgtcacgaccggtgctcgatttagatcgtctgtgttgggtttggggtgtggtggtctccactcccgccttgacgggctgctatctgcccctcggtcactctgttcccaccctcctcacgatctgtactgagcgggctggcaaggcgcatagn

SEQ ID NO: 38150 - DNA, 161 bp, Homo sapiens
  misc_feature: GYAE6OF01DQ91J.35.34.D01.1.454.CMB.1.raw
  modified_base (161)..(161): a, c, t, g, unknown or other
  misc_feature (161)..(161): n is a, c, g, or t
tcagtacagatcgtcacgaccggtgctcgatttagatcgtctgtgttggtttggggtgtggtggtctccactcccgccttgacgggctgctatctgcccctcggtcactctgttccaccctcctcacgatctgtactgagcgggctggcaaggcgcatagn

SEQ ID NO: 38151 - DNA, 189 bp, Homo sapiens
  misc_feature: GYAE6OF01BPQU1.35.34.D01.1.454.CMB.1.raw
  modified_base (170)..(189): a, c, t, g, unknown or other
  misc_feature (170)..(189): n is a, c, g, or t
tcagtacagatcgtcacgaccggtgctcgatttagatcgtctgtgttgggtttggggaagaggaagactgacggtccccaggagttcaggtgctgggcacagcggccctgggctgcctggtcaaggctacttccacgatctgtactgagcgggctggcaaggcgcatagnnnnnnnnnnnnnnnnnnnn

SEQ ID NO: 38152 - DNA, 185 bp, Homo sapiens
  misc_feature: GYAE6OF01C7EST.35.34.D01.1.454.CMB.1.raw
  modified_base (173)..(185): a, c, t, g, unknown or other
  misc_feature (173)..(185): n is a, c, g, or t
tcagtacagatcgtcacgaccggtgctcgatttagatcgtctgtgttgggtttgggggaagaggaagactgacggtcccccaggagttcaggtgctgggcacagcggccctgggctgcctggtcaaggactacttccacgatctgtactgagcgggctggcaaggcgcatagnnnnnnnnnnnnn

SEQ ID NO: 38153 - DNA, 166 bp, Homo sapiens
  misc_feature: GYAE6OF01DP61H.35.34.D01.1.454.CMB.1.raw
  modified_base (166)..(166): a, c, t, g, unknown or other
  misc_feature (166)..(166): n is a, c, g, or t
tcagtacagatcgtcacgaccggtgctcgatttagatcgtctgtgttgggtttgggggtgtggtggtctccactcccgccttgacggggctgctatctgccccctcggtcactctgttcccgccctcctcacgatctgtactgagcgggctggcaaggcgcatagn

SEQ ID NO: 38154 - DNA, 164 bp, Homo sapiens
  misc_feature: GYAE6OF01BI0Y0.35.34.D01.1.454.CMB.1.raw
  modified_base (164)..(164): a, c, t, g, unknown or other
  misc_feature (164)..(164): n is a, c, g, or t
tcagtacagatcgtcacgaccggtgctcgatttagatcgtctgtgttgggtttgggggtgtggtggtctccactcccgccttgacgggctgctatctgcccctcggtcactctgttcccaccctcctcacgatctgtactgagcgggctggcaaggcgcatagn

SEQ ID NO: 38155 - DNA, 167 bp, Homo sapiens
  misc_feature: GYAE6OF01CVGXF.35.34.D01.1.454.CMB.1.raw
  modified_base (166)..(167): a, c, t, g, unknown or other
  misc_feature (166)..(167): n is a, c, g, or t
tcagtacagatcgtcacgaccggtgctcgatttagatcgtctgtgttgggtttgggggtgtggtggtctccactcccgccttgacggggctgctatctgccccctcggtcactctgttcccaccctcctcacgatctgtactgagcgggctggcaaggcgcatagnn

SEQ ID NO: 38156 - DNA, 176 bp, Homo sapiens
  misc_feature: GYAE6OF01CEZF3.35.34.D01.1.454.CMB.1.raw
  modified_base (167)..(176): a, c, t, g, unknown or other
  misc_feature (167)..(176): n is a, c, g, or t
tcagtacagatcgtcacgaccggtgctcgatttagatcgtctgtggttgggtttgggggtgtggtggtctccactcccgccttgacggggctgctatctgccccctcggtcactctgttcccaccctcctcacgatctgtactgagcgggctggcaaggcgcatagnnnnnnnnnn

SEQ ID NO: 38157 - DNA, 165 bp, Homo sapiens
  misc_feature: GYAE6OF01D29JM.35.34.D01.1.454.CMB.1.raw
  modified_base (165)..(165): a, c, t, g, unknown or other
  misc_feature (165)..(165): n is a, c, g, or t
tcagtacagatcgtcacgaccggtgctcgatttagatcgtctgtgttgggtttgggggtgtggtggtctccactcccgccttgacgggctgctatctgccccctcggtcactctgttcccaccctcctcacgatctgtactgagcgggctggcaaggcgcatagn

SEQ ID NO: 38158 - DNA, 174 bp, Homo sapiens
  misc_feature: GYAE6OF01BZUXC.35.34.D01.1.454.CMB.1.raw
  modified_base (173)..(174): a, c, t, g, unknown or other
  misc_feature (173)..(174): n is a, c, g, or t
tcagtacagatcgtcacgaccggtgctcgatttagatcgtctgtgttgggtttgggggaagaggaagactgacggtcccccaggagttcaggtgctgggcacagcggccctgggctgcctggtcaaggactacttccacgatctgtactgagcgggctggcaaggcgcatagnn

SEQ ID NO: 38159 - DNA, 252 bp, Homo sapiens
  misc_feature: GYAE6OF01DVD4F.35.34.D01.1.454.CMB.1.raw
  modified_base (248)..(252): a, c, t, g, unknown or other
  misc_feature (248)..(252): n is a, c, g, or t
tcagtacagatcgtcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttccacgatctgtactgagcgggctggcaaggcgcatagnnnnn

SEQ ID NO: 38160 - DNA, 539 bp, Homo sapiens
  misc_feature: GYAE6OF01BAMBJ.35.34.D01.1.454.CMB.1.raw
  modified_base (150)..(150): a, c, t, g, unknown or other
  misc_feature (150)..(150): n is a, c, g, or t
  modified_base (173)..(173): a, c, t, g, unknown or other
  misc_feature (173)..(173): n is a, c, g, or t
  modified_base (178)..(179): a, c, t, g, unknown or other
  misc_feature (178)..(179): n is a, c, g, or t
  modified_base (181)..(183): a, c, t, g, unknown or other
  misc_feature (181)..(183): n is a, c, g, or t
  modified_base (185)..(186): a, c, t, g, unknown or other
  misc_feature (185)..(186): n is a, c, g, or t
  modified_base (188)..(188): a, c, t, g, unknown or other
  misc_feature (188)..(188): n is a, c, g, or t
  modified_base (190)..(192): a, c, t, g, unknown or other
  misc_feature (190)..(192): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagcggngtgttctaggcgctattaaaggncagtnngnnngnngngnnngggngctgacngctggggtcctgagngtctctgtgcagcctntggatcacttgagtagctatggcatgagctgggtccnccaggctccgagggcgggntggagtggtctcttntagttgtgctgtggtcgtctacacatacgtacgcagctntgtgaagggtccgttcnccgtctacgagacactaactaccaaacgacctaccttgtactactacgacaactacgaacgacgacgtacgacgacgaccgacgacgacggtacgtacgtattacgtagtacgtacgtaagtacggtacggtaacggtagggtaggttacggttacgttacgtacgtcgtcggtcggg

SEQ ID NO: 38161 - DNA, 165 bp, Homo sapiens
  misc_feature: GYAE6OF01DN3YY.35.34.D01.1.454.CMB.1.raw
tcagtacagatcgtcacgaccggtgctcgatttagatcgtctgtgttgggtttgggggtgtggtggtctccactcccgccttgacggggctgctatctgccccctcggtcactctgttcccaccctcctcacgatctgtactgagcgggctggcaaggcgcatag

SEQ ID NO: 38162 - DNA, 166 bp, Homo sapiens; identical to SEQ ID NO: 38153
  misc_feature: GYAE6OF01C3Z4C.35.34.D01.1.454.CMB.1.raw
  modified_base (166)..(166): a, c, t, g, unknown or other
  misc_feature (166)..(166): n is a, c, g, or t

SEQ ID NO: 38163 - DNA, 168 bp, Homo sapiens
  misc_feature: GYAE6OF01EGKQP.35.34.D01.1.454.CMB.1.raw
  modified_base (165)..(168): a, c, t, g, unknown or other
  misc_feature (165)..(168): n is a, c, g, or t
tcagtacagatcgtcacgaccggtgctcgatttagatcgtctgtgttgggtttgggggtgtggtggtctccactcccgccttgacgggctgctatctgccccctcggtcactctgttcccgccctcctcacgatctgtactgagcgggctggcaaggcgcatagnnnn

SEQ ID NO: 38164 - DNA, 540 bp, Homo sapiens
  misc_feature: GYAE6OF01CXDPI.35.34.D01.1.454.CMB.1.raw
  modified_base (335)..(335): a, c, t, g, unknown or other
  misc_feature (335)..(335): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtgggggatcgtgggggaggcgtggtccagcctggggaggtccctgagactctcctgtgcagcctctggattcaccttcagagtacttatttcatcgacctggactccgcagctccgagggaaggactggagtggtcncacacatcagcaagtactggacaactcccatcgtactacgcagactcgtgtagacggcatcactagtttacggacaacgtccgtaaggtcacgtgtatctagactaatgaacacgacctaggagtagtacgacgacgacggaccattctattacgtgtgacaaggtcgttcgtaggtacggtggtagagtagttggtggtaccgg

SEQ ID NO: 38165 - DNA, 166 bp, Homo sapiens
  misc_feature: GYAE6OF01EKT3Y.35.34.D01.1.454.CMB.1.raw
  modified_base (166)..(166): a, c, t, g, unknown or other
  misc_feature (166)..(166): n is a, c, g, or t
tcagtacagatcgtcacgaccggtgctcgatttagatcgtctgtgttgggtttgggggtgtggtggtctccactcccgccttgacggggctgctatctgccccctcggtcactctgttcccaccctcctcacgatctgtactgagcgggctggcaaggcgcatagn

SEQ ID NO: 38166 - DNA, 174 bp, Homo sapiens; identical to SEQ ID NO: 38158
  misc_feature: GYAE6OF01EU40B.35.34.D01.1.454.CMB.1.raw
  modified_base (173)..(174): a, c, t, g, unknown or other
  misc_feature (173)..(174): n is a, c, g, or t

SEQ ID NO: 38167 - DNA, 189 bp, Homo sapiens
  misc_feature: GYAE6OF01B2QXH.35.34.D01.1.454.CMB.1.raw
  modified_base (166)..(189): a, c, t, g, unknown or other
  misc_feature (166)..(189): n is a, c, g, or t
tcagtacagatcgtcacgaccggtgctcgatttagatcgtctgtgttgggtttgggggtgtggtggtctcctactcccgccttgacgggtctgctatctgccccctcggtcactctgttcccgcctcctcacgatctgtactgagcgggctggcaaggcgcatagnnnnnnnnnnnnnnnnnnnnnnnn

SEQ ID NO: 38168 - DNA, 166 bp, Homo sapiens; identical to SEQ ID NO: 38153
  misc_feature: GYAE6OF01DEFFH.35.34.D01.1.454.CMB.1.raw
  modified_base (166)..(166): a, c, t, g, unknown or other
  misc_feature (166)..(166): n is a, c, g, or t

SEQ ID NO: 38169 - DNA, 174 bp, Homo sapiens; identical to SEQ ID NO: 38158
  misc_feature: GYAE6OF01EXFD0.35.34.D01.1.454.CMB.1.raw
  modified_base (173)..(174): a, c, t, g, unknown or other
  misc_feature (173)..(174): n is a, c, g, or t

SEQ ID NO: 38170 - DNA, 176 bp, Homo sapiens
  misc_feature: GYAE6OF01EIQ9D.35.34.D01.1.454.CMB.1.raw
  modified_base (159)..(159): a, c, t, g, unknown or other
  misc_feature (159)..(159): n is a, c, g, or t
  modified_base (165)..(176): a, c, t, g, unknown or other
  misc_feature (165)..(176): n is a, c, g, or t
tcagtacagatcgtcacgaccggtgctcgatttagatcgtctgtgttgggtttgggggtgtggtggtctccactcccgccttgacgggctgctatctgccccctcggtcactctgttcccgccctcctcacgatctgtactgagcgggctggcaaggcncatagnnnnnnnnnnnn

SEQ ID NO: 38171 - DNA, 166 bp, Homo sapiens
  misc_feature: GYAE6OF01A8EX3.35.34.D01.1.454.CMB.1.raw
  modified_base (166)..(166): a, c, t, g, unknown or other
  misc_feature (166)..(166): n is a, c, g, or t
tcagtacagatcgtcacgaccggtgctcgatttagatcgtctgtgttgggtttgggggtgtggtggtctcaactcccgccttgacggggctgctatctgccccctcggtcactctgttcccgccctcctcacgatctgtactgagcgggctggcaaggcgcatagn

SEQ ID NO: 38172 - DNA, 176 bp, Homo sapiens
  misc_feature: GYAE6OF01BLUVE.35.34.D01.1.454.CMB.1.raw
  modified_base (173)..(176): a, c, t, g, unknown or other
  misc_feature (173)..(176): n is a, c, g, or t
tcagtacagatcgtcacgaccggtgctcgatttagatcgtctgtgttgggtttgggggaagaggaagactgacggtcccccaggagttcaggtgctgggcacagcggccctgggctgcctggtcaaggactacttccacgatctgtactgagcgggctggcaaggcgcatagnnnn

SEQ ID NO: 38173 - DNA, 173 bp, Homo sapiens
  misc_feature: GYAE6OF01EPJ67.35.34.D01.1.454.CMB.1.raw
  modified_base (173)..(173): a, c, t, g, unknown or other
  misc_feature (173)..(173): n is a, c, g, or t
tcagtacagatcgtcacgaccggtgctcgatttagatcgtctgtgttgggtttgggggaagaggaagactgacggtcccccaggagttcaggtgctgggcacagcggccctgggctgcctggtcaaggactacttccacgatctgtactgagcgggctggcaaggcgcatagn

SEQ ID NO: 38174 - DNA, 167 bp, Homo sapiens; identical to SEQ ID NO: 38155
  misc_feature: GYAE6OF01A4CQD.35.34.D01.1.454.CMB.1.raw
  modified_base (166)..(167): a, c, t, g, unknown or other
  misc_feature (166)..(167): n is a, c, g, or t

SEQ ID NO: 38175 - DNA, 642 bp, Homo sapiens
  misc_feature: GYAE6OF01B5SLY.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggggagtcgtgggggaggcgtggtccagcctgggagtccctgagctcctctgtgcgagcgtcgtggtacttccaccttcagttagttagtggctatgcctacggtcgggtcccgccgaggcctccgaggacggaaggggctgggaggtgggtggctagttatagtggtatgagtaggtaagtcaaagtaaagactagtcgacgaacgtaccgttccggtagggaacggggtccgtattacccgaaccgtacttcccgtacccgaaggaacgtaacctaaacttacccgaaacgtaaccgacgtccttaggtaaccttcgtacgaactaaacgttacgaaacgacgtaccgtagacgacgaccgaacgacgacggtctaggttagtacgttacgtggtcgacggaacgaacgtacggtaaggaagtacgtggtaccttaaacgg

SEQ ID NO: 38176 - DNA, 165 bp, Homo sapiens
  misc_feature: GYAE6OF01ATLDP.35.34.D01.1.454.CMB.1.raw
tcagtacagatcgtcacgaccggtgctcgatttagatcgtctgtgttgggtttgggggtgtggtggtctccactcccgccttgacggggctgctatctgccccctcggtcactctgttcccgccctcctcacgatctgtactgagcgggctggcaaggcgcatag

SEQ ID NO: 38177 - DNA, 530 bp, Homo sapiens
  misc_feature: GYAE6OF01CSVZE.35.34.D01.1.454.CMB.1.raw
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (486)..(486): a, c, t, g, unknown or other
  misc_feature (486)..(486): n is a, c, g, or t
  modified_base (508)..(508): a, c, t, g, unknown or other
  misc_feature (508)..(508): n is a, c, g, or t
  modified_base (521)..(521): a, c, t, g, unknown or other
  misc_feature (521)..(521): n is a, c, g, or t
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaggcgtgggggagtcgtgggggaggcgtggtccagccgtggggaggtccctgagctctcctgngcaggcgtctggattcaccttnagtagttatggcatgcacgtcggggtcccgccagggcctccgaggcgaaggggctggagtgggngcagttanagtggtatgatggaagtcaataaagctatgcagactcgtaggaacggcgatcacctatctacagacgaactaactaccaagaaccacgctgtatctagacaaatagaacagacctagagacgaccgacgacgacgntgtacgtattactgtgacgaanaacgacgtagagngtgctaacg

SEQ ID NO: 38178 - DNA, 543 bp, Homo sapiens
  misc_feature: GYAE6OF01CAFXH.35.34.D01.1.454.CMB.1.raw
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggggagtctgggggaggcgtggtccagcctgggaggtccctgagactctcctgtgcagcgtctggattcaccttcagtagttatggcatgcacgtgggtccgccaggcctccgagggcaaggggctgggagtgggtgctagttatagtggtatgatgggaagtcaagtaaagctatgcagactcggtagaacgggccgattccacatctcagacgacaattaccaagaacacgctgtactctagacaaatgaacacgcctagacgacgacccgacgaccgacggctaggtacgtacttacgtggtcgacgaagaaccgtaggtagaaggtacgtgggacttaacg

SEQ ID NO: 38179 - DNA, 182 bp, Homo sapiens
  misc_feature: GYAE6OF01CT2X4.35.34.D01.1.454.CMB.1.raw
  modified_base (167)..(182): a, c, t, g, unknown or other
  misc_feature (167)..(182): n is a, c, g, or t
tcagtacagatcgtcacgaccggtgctcgatttagatcgtctgtgttgggtttggggggtgtggtggtctccactcccgccttgacgggctgctatctgcccccctcggtcactctgttcccaccctcctcacgatctgtactgagcgggctggcaaggcgcatagnnnnnnnnnnnnnnnn

SEQ ID NO: 38180 - DNA, 165 bp, Homo sapiens
  misc_feature: GYAE6OF01BMNX5.35.34.D01.1.454.CMB.1.raw
  modified_base (164)..(165): a, c, t, g, unknown or other
  misc_feature (164)..(165): n is a, c, g, or t
tcagtacagatcgtcacgaccggtgctcgatttagatcgtctgtgttgggtttgggggtgtggtggtctccactcccgccttgacgggctgctatctgcccctcggtcactctgttcccaccctcctcacgatctgtactgagcgggctggcaaggcgcatagnn

SEQ ID NO: 38181 - DNA, 165 bp, Homo sapiens; identical to SEQ ID NO: 38176
  misc_feature: GYAE6OF01A55A6.35.34.D01.1.454.CMB.1.raw

SEQ ID NO: 38182 - DNA, 621 bp, Homo sapiens
  misc_feature: GYAE6OF01C819O.35.34.D01.1.454.CMB.1.raw
  modified_base (613)..(613): a, c, t, g, unknown or other
  misc_feature (613)..(613): n is a, c, g, or t
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagcgtgggggatcgtgggggaggcgtggtccagccgtgggaggtccctgagactctcctgtgcagcgtctggattcaccttcagtagttatggcatgcacgtgggtcccgccagggcctccgaggccgaagggggctagggaggtggggtggctaaggtttatagtcgggtatagtagtaggtaaggtaagtaactaaagtaaactagttagacgaacgtaacgtaccggttacggaacgggaccggtacttactaccacgtactacctacgaacgtaacaactaactaaacgaaacgtaaccgacgtacgtacgtactacgtaacgtaaactaagtaacgaacgtacgtacgagaacgaccgaaccgacgacgacgtacgtagttacgtactagtcgacgagaacgaacgtagagagngtgtaacg

SEQ ID NO: 38183 - DNA, 177 bp, Homo sapiens
  misc_feature: GYAE6OF01BJ3CI.35.34.D01.1.454.CMB.1.raw
  modified_base (173)..(177): a, c, t, g, unknown or other
  misc_feature (173)..(177): n is a, c, g, or t
tcagtacagatcgtcacgaccggtgctcgatttagatcgtctgtgttgggtttgggggaagaggaagactgacggtcccccaggagttcaggtgctgggcacagcggccctgggctgcctggtcaaggactacttccacgatctgtactgagcgggctggcaaggcgcatagnnnnn

SEQ ID NO: 38184 - DNA, 176 bp, Homo sapiens; identical to SEQ ID NO: 38172
  misc_feature: GYAE6OF01DSAIY.35.34.D01.1.454.CMB.1.raw
  modified_base (173)..(176): a, c, t, g, unknown or other
  misc_feature (173)..(176): n is a, c, g, or t

SEQ ID NO: 38185 - DNA, 166 bp, Homo sapiens
  misc_feature: GYAE6OF01CHBJ2.35.34.D01.1.454.CMB.1.raw
  modified_base (165)..(166): a, c, t, g, unknown or other
  misc_feature (165)..(166): n is a, c, g, or t
tcagtacagatcgtcacgaccggtgctcgatttagatcgtctgtgttgggtttgggggtgtggtggtctccactcccgccttgacggggctgctatctgccccctcggtcactctgttcccgccctcctcacgatctgtacgagcgggctggcaaggcgcatagnn

SEQ ID NO: 38186 - DNA, 576 bp, Homo sapiens
  misc_feature: GYAE6OF01AR791.35.34.D01.1.454.CMB.1.raw
tcagtacagatcgtcacgaccggtgctcgatttagatcgtctgtgttgggtttgggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctcgtggagtagtaaggttgggggaataaatagtagcttgctggtactcagcagaacgccgaggccagtccctgtcgtcggtcatctatacaagactagacaacggccggtcctacgagggtactcccgtaggacgtcggtacttccgtcgtcggtcctacctaacgtcgtacgggaaccacgaccgacctactctacgactagtacgacggccgggtaaccagggtctacggtgaggtcggaggctagtaacttacgttacgtacggtcgtacgggtcggtaggacgacgcgacgcgtagtggtggtacgtcgggacggcggacagtcctacggtaccgtcgtacgcgacggtacccg

SEQ ID NO: 38187 - DNA, 193 bp, Homo sapiens
  misc_feature: GYAE6OF01D8V2R.35.34.D01.1.454.CMB.1.raw
  modified_base (168)..(193): a, c, t, g, unknown or other
  misc_feature (168)..(193): n is a, c, g, or t
tcagtacagatcgtcacgaccggtgctcgatttagatcgtctgtgttgggtttggggggtgtggtggtctccactcccgccttgatgggctgctagtctgccccctggtcactctcgttcccgccctcctcacgatctgtactgagcgggtctggcaaggcgcatagnnnnnnnnnnnnnnnnnnnnnnnnnn

SEQ ID NO: 38188 - DNA, 549 bp, Homo sapiens
  misc_feature: GYAE6OF01EIQCY.35.34.D01.1.454.CMB.1.raw
  modified_base (344)..(344): a, c, t, g, unknown or other
  misc_feature (344)..(344): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggggatcgtgggggaggcgtggtccagccgtgggaggtccctgagactctcctgtgcagcgtctggattcaccttcagtagttatggcatgcacgtgggtccgccaggctccgaggcgaaggggctgggagtgggtggcagttanagtggtatgagtggaagtcaataaagctatcgacagactccgtaggaacgggccgattccacctactctccagacgacaattaccaagaacacgctagtactctagacaaatgaacacgcctagacgacgaccgaacgacgacggtcgtagttacgttattacgtgtcggacggaagaaccgtacggtagagagtggcttaaacg

SEQ ID NO: 38189 - DNA, 251 bp, Homo sapiens
  misc_feature: GYAE6OF01DDLKC.35.34.D01.1.454.CMB.1.raw
  modified_base (247)..(251): a, c, t, g, unknown or other
  misc_feature (247)..(251): n is a, c, g, or t
tcagtacagatcgtcacgaccggtgctcgatttagatcgtctgtgttgggtttggggggtgtggtggtctccactcccgccttgacgaggctgactattactgtcagtcttatgatggtagcaagtatgtggtcttcggcggagggaccaagctgaccgtcctatgtcagcccaagactgccccctcggtcactctgttcccgccctcctcacgatctgtactgagcgggctggcaaggcgcatagnnnnn

SEQ ID NO: 38190 - DNA, 596 bp, Homo sapiens
  misc_feature: GYAE6OF01EDS8E.35.34.D01.1.454.CMB.1.raw
tcagtacagatcgtcacgaccggtgctcgatttagatcgtctgtgttggatttgggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagcgtgggggagtcgtggggggagcgtggtccagcctgggagtccctgagactctcctgtgcagcgtctggattcaccttcagttagttatggcatgctacgtggggtcccgccgaggcctccgagggcgaaggggctgggagtggggtgctagttatagtggtatgagtggaagtcaaataaagactatgacaagtactccggtaggaacgggccgtattccacctattccctaccgaagacgaacctaacttaccaaagaacacgcttagtactctagaactaaagtacgaacacgacctagaacgacgacccggaacgaccgacggacgttaggtacgttaatttacgtggtacggacgaaacggaacgtacggtaaggaacggtagtcggtaaaccg

SEQ ID NO: 38191 - DNA, 663 bp, Homo sapiens
  misc_feature: GYAE6OF01CDMLT.35.34.D01.1.454.CMB.1.raw
  modified_base (307)..(307): a, c, t, g, unknown or other
  misc_feature (307)..(307): n is a, c, g, or t
tcagtacagatcgtcacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcactgctcgtaggagataaggttggggaataatagtgcttgctggtatcagcagaacgccaggccacgtccctgtcgttgtcagtctatcaaagntacgcaacggccgcctacgaaggtactcccgtagacgcgtacttccgtcgtcggtaccctacgtaaccgtcgtacgggaaaccctacgaccggtaccctacgttaccgtaccgtaacctactaccggaacgggacccgggaacccgtagggtaccttaaggtacgggtacgtacgggaacggtcgtacgtaacgtttaacgttacgtcggtacgtacgggtaccggtagggaccgacggaccgacggtccgtaaccgttggtacggttaccgggttacggggaccgggtaacgggaacccgtaacggccgttaccgggaaccccgttaccggtacgggtccgaacccggtacccgg

SEQ ID NO: 38192 - DNA, 614 bp, Homo sapiens
  misc_feature: GYAE6OF01B2PQK.35.34.D01.1.454.CMB.1.raw
  modified_base (385)..(385): a, c, t, g, unknown or other
  misc_feature (385)..(385): n is a, c, g, or t
tcagtacagatcgtcacgaccggtgctcgatttagatcgtctgtgttggggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtgggggatcgtgggggaggcgtggtccagccgtgggacggtccctgagactctcctgtgcagcgtctggattcaccttcagtagttatggcatgcacgtcgggtccgccgaggctccgaggcgaaggggtctgggaggtgggtggctagttatagtggtatgagtagggaagtcaataaagactancgacaggactccggtaggaacgggccgtattccaacctatcctaccgaagaacgtaacctaacttacccgaaacgtaaccgaccgtcgttagttaactcgtacgaactaaacgtacgtaaccgaacggtcccgtaggaacggacgacccgaaccggaccgacggtcgtagttagttacttacgtggtcggacgaagaaccgtaggtaacgagacgtcggtcgttaaacg

SEQ ID NO: 38193 - DNA, 165 bp, Homo sapiens
  misc_feature: GYAE6OF01B360B.35.34.D01.1.454.CMB.1.raw
tcagtacagatcgtcacgaccggtgctcgatttagatcgtctgtgttgggtttgggggtgtggtggtctccactcccgccttgacggggctgctatctgccccctcggtcactctgttcccgacctcctcacgatctgtactgagcgggctggcaaggcgcatag

SEQ ID NO: 38194 - DNA, 600 bp, Homo sapiens
  misc_feature: GYAE6OF01DOPHA.35.34.D01.1.454.CMB.1.raw
  modified_base (156)..(156): a, c, t, g, unknown or other
  misc_feature (156)..(156): n is a, c, g, or t
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (336)..(336): a, c, t, g, unknown or other
  misc_feature (336)..(336): n is a, c, g, or t
  modified_base (496)..(496): a, c, t, g, unknown or other
  misc_feature (496)..(496): n is a, c, g, or t
  modified_base (514)..(514): a, c, t, g, unknown or other
  misc_feature (514)..(514): n is a, c, g, or t
tcagtacagatcgtcacgaccggtgctcgatttagatcgtctgtgttgggtttggggggagaggagcccagcactagaagtcggcggtgttccattcggtgatcagcactgaacacagaggactcaccatggagtttgggctgagcgtggttttcncgttagctcttttaagaggtgtccagtgtcaggtgcagcgtgggggatctgggggagcgtggtccagcccgtagggcggtccctgganacctctccgtgtgcaagccgtatggnttcaccttnagttagttanggcatgcacgtggtccgccgaggcctaccgaggccgaagggggtccngggtagtgggtcggactagttagtatgggtactggtaagtcggaagttacaattaaacgctaagtggaccaagtcgtaccggtagaacggggcctacttacgacctatactacccgagaacgaactaacttacccaaggaaccacggtctaggtacctanacgtacaaatacgaacgngtacctggaacgacgaccgacgacgtcgattcggtacgtagttacgtagtcgaccgtagaactcggtaacagtactggcttaaacg

SEQ ID NO: 38195 - DNA, 654 bp, Homo sapiens
  misc_feature: GYAE6OF01BIW0W.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggacctcaccatggagtttgggctgagctgggttttcctcgttgctcttttaagaggtgtccagtgtcaggtgcagctgggggatcgtgggggagcgtggtccagccgtgggagtccctgagactctcctgtgcagcgtctggattcaccttcagtagttatggcatgcacgtgggtccgccaggcctccgaggcaaggggctgggagtgggtgcagttatagtggtatgagtggaagtcataaaggactagtgcaagtacgtaccggtaggaacgggtccgtagttccaaccgtatcctacccgaagaacgtaactaaacgttacccgaaagtaaaccacgtacgtagtaactacgtacgaacctaaagttacgaaaccgacgtacccgtaggaacggaaccggacccggtaaaccgacccggaaccgggtccgttacggttacgttaacgtttaccggtacggttacgggaccgtaaacggaaaccgtaacgggtaaacggaaggtaacgttagggtaccgttaaaaccgg

SEQ ID NO: 38196 - DNA, 628 bp, Homo sapiens
  misc_feature: GYAE6OF01A054Q.35.34.D01.1.454.CMB.1.raw
  modified_base (224)..(224): a, c, t, g, unknown or other
  misc_feature (224)..(224): n is a, c, g, or t
tcagtacagatcgtcacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctgganataaggtggggataaatatgcttgctggtatcagcagaacgccaggccagtccctgtgtggtcagtctatacaagatagcaaggcgccctgacggactcccgtagacgcgtactttctcgtcggcctaccctaacgtcgtacgggaaccaccgacgtacccaccttaccgacgtaaaccctataccgaacgggacccgggaacccgacggtacgttaacggtcgggtaacgtcgggtacggtcctaagtaacgttaacgtttacgtcggtaccgtagggtccgttacgggactacggtacgaaggtccgtaacgtggttacggttacggttaccggggacgggaacgggtaccgaacggtccgtacggtacccgtaccggttacggaccgtaccggtaacccgg

SEQ ID NO: 38197 - DNA, 671 bp, Homo sapiens
  misc_feature: GYAE6OF01EOFRT.35.34.D01.1.454.CMB.1.raw
tcagtacagatcgtcacgaccggtgctcgatttagatcgtctgtgttgggtttggggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagcgtgggggagtcgtgggggaggcgtggtccagccgtggggacgtccctgagactctcctgtgcagcgtctggacttccacctttcaagttagttatggctatgcctacgttcggggtcccgccgagggcctaccgagggccgaaggggctgggagttgggttggctaggttgtggtggtatgagtagggaaagtaatagattacgtatggacaagaccgaccggtaggaacgggaccgtacttaccaccactacctaccaacgaacgaactaacttaacctaaacgtaaacctacctttacgttaccgtacgtaactaaacgtacgaaccgtaacgtaccgtacgaacgacggaccggaacggaccggaacggacgtaagtaacttaagttaccccccccccgtggtacggacggaacggaacggacggacggtacgggaccggtaccccgtaaccccggtacgtcggaacgg

SEQ ID NO: 38198 - DNA, 192 bp, Homo sapiens
  misc_feature: GYAE6OF01AUM20.35.34.D01.1.454.CMB.1.raw
  modified_base (158)..(158): a, c, t, g, unknown or other
  misc_feature (158)..(158): n is a, c, g, or t
  modified_base (163)..(192): a, c, t, g, unknown or other
  misc_feature (163)..(192): n is a, c, g, or t
tcagtacagatcgtcacgaccggtgctcgatttagatcgtctgtgttgggtttgggggtgtggtggtctccactccgccttgacgggctgctatctgcccccgtcggtcactctgttcccaccctcgtcacgatctgtactgagcggctggcaaggcnatagnnnnnnnnnnnnnnnnnnnnnnnnnnnnnn

SEQ ID NO: 38199 - DNA, 564 bp, Homo sapiens
  misc_feature: GYAE6OF01BA47W.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagatgtgtccagtgtcaggtgcagcgtgggggagtcgtgggggaggcgtggtccagcctggggaggtccctgagactctcctgtgcagcgtctggattcaccttcagtagttatggcatgcacgtggggtccgccgaggcctccgaggcgaaggggctgggagtggggtgcagttatagtggtatgagtggaagtcaagtaaagactagtgcaagacctccggtaggaacgggtccgtattccgacctatccgtaccaagaacgaacaacttaccaaacgaacacgctgtactcgtagacaaatgaacagacctagagacgaccgacgaccgacggcttaggtcgtagttacgtggtacgacgaacggaacacggtagaagtgtggtaaccg

SEQ ID NO: 38200 - DNA, 626 bp, Homo sapiens
  misc_feature: GYAE6OF01C509I.35.34.D01.1.454.CMB.1.raw
  modified_base (310)..(310): a, c, t, g, unknown or other
  misc_feature (310)..(310): n is a, c, g, or t
  modified_base (345)..(345): a, c, t, g, unknown or other
  misc_feature (345)..(345): n is a, c, g, or t
tcagtacagatcgtcacgaccggtgctcgatttagatcgtctgtgttggatttgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtgggggagtcgtgggggaggcgtggtccagccgtgggaggtccctgagactctcctgtgcagcgtctggattccaccttcagttagttatggcagtgcacgtggggtcccncgaggcctaccgagggcaaggggctgggagtgggngctagttatatggtatgatggaatcaataaagctagtgacaagtacctccggtaggaacgggtcccgattccaaccacttccctaccaagaacgaactaacttaccaaagaaccacgtcttagtacttcgtagaacctaaagttacgaacctacggtaccctaaggaacggacgacccggaaccggtaaccgaaccgggtccttaggttacgttaatttaacgtgggttacgacggaaacggaaaccgtaacgggtaagaacggtacggttgggtaaaccg

SEQ ID NO: 38201 - DNA, 177 bp, Homo sapiens; identical to SEQ ID NO: 38183
  misc_feature: GYAE6OF01BCSIA.35.34.D01.1.454.CMB.1.raw
  modified_base (173)..(177): a, c, t, g, unknown or other
  misc_feature (173)..(177): n is a, c, g, or t

SEQ ID NO: 38202 - DNA, 164 bp, Homo sapiens
  misc_feature: GYAE6OF01AV862.35.34.D01.1.454.CMB.1.raw
  modified_base (158)..(158): a, c, t, g, unknown or other
  misc_feature (158)..(158): n is a, c, g, or t
  modified_base (164)..(164): a, c, t, g, unknown or other
  misc_feature (164)..(164): n is a, c, g, or t
tcagtacagatcgtcacgaccggtgctcgatttagatcgtctgtgttgggtttgggggtgtggtggtctccactcccgccttgacgggctgctatctgccccctggtcactctgttcccaccctcctcacgatctgtactgagcgggctggcaaggcncatagn

SEQ ID NO: 38203 - DNA, 174 bp, Homo sapiens; identical to SEQ ID NO: 38158
  misc_feature: GYAE6OF01DJMPV.35.34.D01.1.454.CMB.1.raw
  modified_base (173)..(174): a, c, t, g, unknown or other
  misc_feature (173)..(174): n is a, c, g, or t

SEQ ID NO: 38204 - DNA, 165 bp, Homo sapiens; identical to SEQ ID NO: 38176
  misc_feature: GYAE6OF01BR51Q.35.34.D01.1.454.CMB.1.raw

SEQ ID NO: 38205 - DNA, 252 bp, Homo sapiens
  misc_feature: GYAE6OF01DHVXQ.35.34.D01.1.454.CMB.1.raw
  modified_base (247)..(252): a, c, t, g, unknown or other
  misc_feature (247)..(252): n is a, c, g, or t
tcagtacagatcgtcacgaccggtgctcgatttagatcgtctgtgttgggtttgggagaggcgggtggcattttgactactggggccagggaaccctggtcaccgtctcctcagcctccaccaaggcccatcggtcttcccctggcgccctgctccaggagcacctccgagagcacagcggccctgggctgcctggtcaaggactacttccacgatctgtactgagcgggctggcaaggcgcatagnnnnnn

SEQ ID NO: 38206 - DNA, 523 bp, Homo sapiens
  misc_feature: GYAE6OF01EJO80.35.34.D01.1.454.CMB.1.raw
  modified_base (309)..(309): a, c, t, g, unknown or other
  misc_feature (309)..(309): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggggggatcgtgggggaggcgtggtccagcctggggaggtccctgagactctcctgtgcagcgtctggattccaccttcagttagttatggcatgccacgttcggggtccnccgaggcctccgagggcgaaggggctgggagtgggtgctagttatagtggtatgagtggaagtcaataaagctatgcagactcgagaggcatcacatcncaganacatacaanaacncgntntatctnacaatcgaacagactagacgacgaccgacgacgacggctagtagtacgttagtggtgacgagaacgtacgtagagatggctaaacg

SEQ ID NO: 38207 - DNA, 692 bp, Homo sapiens
  misc_feature: GYAE6OF01CRUB7.35.34.D01.1.454.CMB.1.raw
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcgttgggtttttcctcggttgccttacttttaaggaggttgtccagtgtcaggtgcaggcgtgggggatcgtggggggagcggtggtccaggccgtggggacgtccctggacactctcctgtgcagcgtnggtattccactttagcctactntcggcagtcgagccgtcgggcccgaccggctaccggaggggtacggctggggagtcgggtcctacgtaacgttgtggacgtgggttactcggaccttacaagtaacacgtagttcgggacacgtaaggtccgtccggtagggaaccggggtcccgtttaccaccgtagtccgtaccgagaacgaactaacttacccgaaagtaacccttagtttcgtaccctagaacctaagtcgaacacgtccgtagaacggacgaccgggaagaccgacgggacctaattacgtagttaccgtagggtacaacgggaaggtaaggcggtaaacggttccggggaaccccgtacccccggtaaccccggaggtaaccggacgtacccggtggggaccccggg

SEQ ID NO: 38208 - DNA, 969 bp, Homo sapiens
  misc_feature: GYAE6OF01DSFJY.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagtcgttgggttttcctcgttgcttcgttttaaggaggttgtccagtgtcgaggtgcaggtcggtggggggagtcggtggggggacggtcggttcggtccaggcccgttggggaccggtccctgaacgtccttccgtccgtggtcgacgacggtccgtcgtaggtacttccgtaccttcgaagtttaacgtttagcgggactaagtcggtaccgtaaccggttcgggggttacccccaccggtaacggggtccccttacccgggaaacgggggacccgggtaaaacgggggggttccgttaggggggtaaggggtttcggggggttacgggaccgtttaaagggttttaagttaagggttggggttaagttaggggtaacggttaaggggtaaaaccgtacctaaaaaggttaaaaaccggtaccgtttaagtacggaaccgtaaacggtaaccccgttacccggggttaacgggaaaccggggggtaccctaacgttttaccccgaaacccgttaacgttccccgttaaacccggaacggtaaacggtaaaccttaaaccgttaaccccggaaaagtaaacccgtacgtaccgtttaagttaacgttaccgttacgaaactaaaacgtacggaaaccaccgggttaccgaagggtaacggaacccggaacccggaaaccggtaacccggtacgggttacccgtttaagggttaaccgtttaacgtttacggttacgggtaaccgggaaaccggtaaacggaaaacccggttaacgggtaaacggttaagggtaacgttccgggtaaccgttttaaaaaccggg

SEQ ID NO: 38209 - DNA, 747 bp, Homo sapiens
  misc_feature: GYAE6OF01A9UIP.35.34.D01.1.454.CMB.1.raw
  modified_base (362)..(362): a, c, t, g, unknown or other
  misc_feature (362)..(362): n is a, c, g, or t
  modified_base (664)..(664): a, c, t, g, unknown or other
  misc_feature (664)..(664): n is a, c, g, or t
  modified_base (695)..(695): a, c, t, g, unknown or other
  misc_feature (695)..(695): n is a, c, g, or t
  modified_base (734)..(734): a, c, t, g, unknown or other
  misc_feature (734)..(734): n is a, c, g, or t
tcagtacagatcgtcacgaccggtgctcgatttagatcgtctgtgttgggtttggggggagaggagcccagcactagaagtcggcggtgtttccattcggtgatcagcactgaacacagaggactcaccagtggagtttgggctgagtcgttgggttttcctcgttgtcttcgttttaaggaggtgtccagtgtcaggtgcgaggtcggtgggggagtcggtgggggaggtcgtggtcccaggccgtggggacgtccctgacgtacctccgtccgtggtcgcgtaggtccgttcgtaggtaactttccgtacctttcgaaggtttacgttagtcggactagtcgaccgtacgttcgggcccncgacggtcctaccggagggtccgtaaggggtcgtacggggtacggttggggtacggtacgttaaaggttttagtacggttaggggttaactaggggtaacggttaaaggggtaaactaaccggtaaaagttaaaaggtaccgttaacggtacgtaccggtaaaccggtaaacccggttccgggtaaacgggtaaacccggggtccgtaacgtttacccgaaccgttaccgtacgtacccgaagtaacgtaaactaaccgtacgaacgaactccgtactagtacatacgaacgaatacgaacngtacgtagacgacgtacgacgtacgtacgtntacgtattacgtggagtccggaagacacgtacgacgtanacgtgtagtaacg

SEQ ID NO: 38210 - DNA, 659 bp, Homo sapiens
  misc_feature: GYAE6OF01ESMSE.35.34.D01.1.454.CMB.1.raw
  modified_base (282)..(282): a, c, t, g, unknown or other
  misc_feature (282)..(282): n is a, c, g, or t
tcagtacagatcgtcacgaccggtgctcgatttagatcgtctgtgttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtgggggatcgtgggggagcgtggtccagcctgggacgtcctgagactctctgtgcagcgtctggacttccacttcagtgttanggcatcgctacgtcgggtccgcgaggcctccgaggtcgaaggggctagggaggtggggtgtacgtaggttactagtggtagtacgtagtgggtaaattcaaagttaaaggctaagtgactaggaccgttcggtaggaaccgggtacctacttaccgaacctactccgtacccgaagaacgtaaccgtaaactacccgaaaggaacctaccgtcttaagtactacgtacgaactaaacgacgaaaccgcgtaccgtaggaacgtaaccggacccggtaacgtaacccggacgggtcgttacgtaaggtttaccttacggtacggtacgacggaaacgtaacgtaacgggaaggaagttacggtacgtacgttaaaacg

SEQ ID NO: 38211 - DNA, 737 bp, Homo sapiens
  misc_feature: GYAE6OF01DANHN.35.34.D01.1.454.CMB.1.raw
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaggcgtgggggatcgtgggggagcgtggtccagccgtgggacgtcccngagctctctgtgcngcgtntggacttccaccttcaggttagtttactgggactagtcgcctacggttcgggtcccgccaaggcctccgagggccgaagggggtctgggaggtggggngctaaggttntagtggtatggagtaggaaattaactaggtatacgtagcgacgtaagaccgtacggtagggaaacgggtccgtacttaccaacccgtacttacccgtaccgtaaaggaactaaacctaacgtttaacccgaaaagttaaccctttaacgttttacggttacccgtacgaaacctaaacgttacgaaaccgtaggtacccgttaaggacggaaccggaccgggaacgggaaccgtaacggggaacttaacgttaaacgtttaacgttaccgttacgggtacggaacggtaacggaaccggtaggtaacgggttacccggggaaacccgtaccccccgggtttaaccccgggaggttcggaacccggg

SEQ ID NO: 38212 - DNA, 775 bp, Homo sapiens
  misc_feature: GYAE6OF01DQ8B6.35.34.D01.1.454.CMB.1.raw
  modified_base (410)..(410): a, c, t, g, unknown or other
  misc_feature (410)..(410): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaggcgtgggggagtcgtgggggaggcgtggtccaggccgtggggacggtccctggacgaccttcgtccgtggtcgcaggccgttcgtggactttccacccgtttataaggtttaagtttagtcggactaagttcggaccgtaccggttcggggtccccgccgaagggtccctaccggaagggaccggtaaagggggtctagggagggttggggnggtactaggtttaagtagtaggtatcgagttaggaagtacaaagtaaaagacttaagtcgacgaacggtaccgttaccgggagggaacgggtccgtaacttacccgaacctacgttacccgtacccgaaagtaaccgaactaaaccgttacccaaaacgggtaacctaaccggtacgttaacggtaactacgtaacggtaaactaaacggtaacgtaaccaacgggtaccgtaaggaacggaccggtaacccggaaccgtaccgaccggtcgttaggttaacgtttacgttaacggtcggttaacggacggtaaaacgtaacgtaacggttaacgggaagtaacggtgggtaacctttaaacggg

SEQ ID NO: 38213 - DNA, 722 bp, Homo sapiens
  misc_feature: GYAE6OF01BQ1XF.35.34.D01.1.454.CMB.1.raw
  modified_base (676)..(676): a, c, t, g, unknown or other
  misc_feature (676)..(676): n is a, c, g, or t
tcagtacagatcgtcacgaccggtgctcgatttagatcgtctgtgttgggttggggggagaggagcccagcactagaagtcggcggtgttccattcggtgatcagcactgaacacagaggactcaccatggagttggctgagtcgttgggtttcctcgttgcttacgttttaagaggtgtccagtgtcgaggtgcgaggcggtgggggagtcggtgggggagcggtggtcccgaggccgtggggacggtcccgtagacgtacctcgttccgtggtcgcgagtccgtcgtaggtacttccaccgttgaaggtttagttacgcggactagttcggtaccgacggttccgggtaccccgacgacgggtcccaaccggaagggccgaagggggtcgtagggacggtgggtacgtgtaaggttttagtaggttggttaaagtggaaacgttagggtaaataaccgtaaagtaaaacggtactagtacgacgtaacgtaccgtacggtacggaacggtccgtacgttaccgaaccgttacgtacctaacggaaagtacgtaaaactaaccgttaaccgaaaacgtaaccgtacgtactacggtactataacgtaacaaagtacgaacgtacgccgtaaggacgaccggaccggaacacgccgtgttacgtacgtaagttggngtaacggacgtaagaacgtaacgtagaagcgtagtaccgttaaagg

SEQ ID NO: 38214 - DNA, 595 bp, Homo sapiens
  misc_feature: GYAE6OF01E3V36.35.34.D01.1.454.CMB.1.raw
  modified_base (255)..(255): a, c, t, g, unknown or other
  misc_feature (255)..(255): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (383)..(383): a, c, t, g, unknown or other
  misc_feature (383)..(383): n is a, c, g, or t
tcagtacagatcgtcacgaccggtgctcgatttagatcgtctgtgttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagttggtggagtcgtgggggaggcgtggtccagcctggggagtccctgagactctcctgngcagcctctagattccaccttcagtagctatagcatgcacgtgggtcccnccaggcctccgagggccaagggggcttgggagttggggtgctagttanatcatatgataggaaagtatgagttactangaccagactacggtgaacgggcatcaccatcctacagacacaacttaccaaagaacacgcttagtatcgtagaacaaatagaaactacgaccgtagacgacgtcgaggaacggaccgtacgggtccgttaggttacggttaacgtttactacggttacggaacggtaaacgtaccgttaacccgggtttaccccgttaaagttttaacccgg

SEQ ID NO: 38215 - DNA, 700 bp, Homo sapiens
  misc_feature: GYAE6OF01CQ668.35.34.D01.1.454.CMB.1.raw
  modified_base (326)..(326): a, c, t, g, unknown or other
  misc_feature (326)..(326): n is a, c, g, or t
tcagtacagatcgtcacgaccggtgctcgatttagatcgtctgtgttggggtttgggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagcgtgggggagtcgtgggggagcgtggtccagccgtggggacggtccccgagacctctccgtgtcgcaggcgttctggacttccacctttcgaagttagttagtggaccagtgactacgtcgggtcccnccgaggtcctccgaggaccgaagggggtctgggaggtgggtgactagttatagtggtatggagtaggaatacaataaacgctagtcgactagacgttccggtaggaaacgggtccctacgttaccaaccgtacttaccgtaccgaaggtaacgaactaaacgttacccgaaagtaaccctacgtacgttaggtaacttacgtacgaaactaacgtacgaacgaccggtaccgtagaacggaccgaacccggacggaaccgtacggtaccgttggttactttaacggttacgtagggttaacggaaccgaaacggtaaaccggtacggttaaaggtaacggtaggttacgggttaccttaaacggtttaaacggg

SEQ ID NO: 38216 - DNA, 777 bp, Homo sapiens
  misc_feature: GYAE6OF01CIDEM.35.34.D01.1.454.CMB.1.raw
  modified_base (248)..(248): a, c, t, g, unknown or other
  misc_feature (248)..(248): n is a, c, g, or t
tcagtacagatcgtcacgaccggtgctcgatttagatcgtctgtgttggggtttgggggggagaggagcccagcactagaagtcggcggtgttccattcggtgatcagcactgaacacagaggactcacatggagtttgggctgagtcttgggttttcctcgttgcttcgtttaagaggtgtccaggtgtcaggtgcagcgtgggggagtcggtgggggaggcgtggtccagccgtggggacgtcccngagtacctctccgtgtgcgtagcgtactggtacttccgtacttcgtaagttagttagtggtactagtcggcgtacggttccggggtacccgccgacggtccgtaccggaacgggtccggaaacgggggtcgtaggggtacgggttggggtacggtacgttaaggtttaagtaggttggttagtaggtaaggtaggtaaagtacgtaaaagttaaaggaccttaaggtccgaacgtacggtaccggtaccgggtaagggtaaaccgggtaccgtacgttaccgtaaacctaccgttacccgtaacccggtaagaaccggttaaacgtaaccgttaacccgaaaacgtaacccgtaccgtacgtttaccgttaacttacgttaacgaaactaaacgtaacggtaaaccaacgttccggtaacggacgaccggtacccggaacgaaccgtaacgcggttagttacggttaacttggtacggacgacgtaaaggaacctaacgggtaagacgtaacgtggtaccgttaaacgg

SEQ ID NO: 38217 - DNA, 594 bp, Homo sapiens
  misc_feature: GYAE6OF01D35DH.35.34.D01.1.454.CMB.1.raw
  modified_base (295)..(295): a, c, t, g, unknown or other
  misc_feature (295)..(295): n is a, c, g, or t
tcagtacagatcgtcacgaccggtgctcgatttagatcgtctgtgttgggtttggggggggagaggagcccagcactagaagtcggcggtgtttccattcggtgatcagcactgaacacagaggactcaccatgggagtttgggctgagcttgggtttttcctcgttgcttctttttaaggaggtgtccagtgtcaggtgcagcgtgggggatcgtgggggagcgtggtccagccgtggggacggtccctgagactctcctgtgcagcgtctggattccaccttcagttagttanggcatgcacgtcgggtccgcaggctccgagggcgaaggggctggaggtgggtgctagttatagtggtatgagtaggaagtcaaataaagctatcgacaggtacctccggtaggaacgggcctacttccacctatcctacagacgactaacttaccaaagaaccacgtacttagtactctagaacaaatacgaacacgtccgtaggaacgacgaccggaacgaccgtacggcgttagttacgttacttacgtaggtcgacgtaagaaaccgtacggtaggaagagttggaacttaaacgg

SEQ ID NO: 38218 - DNA, 698 bp, Homo sapiens
  misc_feature: GYAE6OF01EDQDT.35.34.D01.1.454.CMB.1.raw
  modified_base (345)..(345): a, c, t, g, unknown or other
  misc_feature (345)..(345): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtgcagtcgtgggggcgcgtggtccaggccgtgggacgtccctgacgtactctcctgtgaacgccttcgtggtacttccttccttacaagtaactagtggcatcgctacgtggtccgcaggcctcgaggcgagggctggagtggngcagtgatatctagttgagtaggaaataaataactgttaccgctaacggtaccgtccggtaggaaaccgggtccgtaactttacccgaaccgtataccgttaccgaacgtaacgtaacctaaacgttacccgaaaacggtaaccctaaccgtttacttacgttaccctttacgtaccgtaccgtaactaacgtaaccgaaaccggttaacggttacccggttaacgggtaacccgtagggaaccgggtaaccgtaccgggttaccttacggttaccgttaacgtttaccggtggtaccggacggtaacgaacgttaaacgtaaacgtaaagtttacgttaggtcgttaaacgg

SEQ ID NO: 38219 - DNA, 166 bp, Homo sapiens
  misc_feature: GYAE6OF01EHU2D.35.34.D01.1.454.CMB.1.raw
  modified_base (165)..(166): a, c, t, g, unknown or other
  misc_feature (165)..(166): n is a, c, g, or t
tcagtacagatcgtcacgaccggtgctcgatttagatcgtctgtgttgggtttgggggtgtggtggtctccactcccgccttgacgggctgctatctgccccctcggtcactctgttcccaccctcctcacgatctgtactgagcgggctggcaaggcgcatagnn

SEQ ID NO: 38220 - DNA, 835 bp, Homo sapiens
  misc_feature: GYAE6OF01CIORW.35.34.D01.1.454.CMB.1.raw
  modified_base (394)..(394): a, c, t, g, unknown or other
  misc_feature (394)..(394): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcttgggttttcctcgttgtcttacttttaagaggtgtcctagtgtcgaggtgcaggcgtgggggagtcgtgggggagcggtgtccagtccgtggggacggtccctgacgtacctcgttccgtgtcgcaggtccgtcgtggtacttccgtaccttgaagttacgttagtggacctagtcggtaccgtaccggttccggggtacccgacccgaggtcccgtaccggaaagggccggtaaacggggggtnttacggggagggttcggggtacggtacgttaaggtttagtaggttggtaaggtacgtaagtagggaaagttacctaaagtaaacgacttaagacggaccgtaacggttaccgtacccgggtaagggaacccgggtacccgttaacgttaccctaaccgttactaccccgtaaccgtaacggaacgtaaacctaaaccgttaacccgaaacgtaacccgtaaccgtaccgttaacgtaccgttaccgtaaccgtaaacgtaaacgtaaccggtaaccgtaaccggtacccgtaacggaaccggtaacccggacccggaaaccggtacccggaccggttaccgtaggttaaccggttaacgttaacggttcgtaacgggtaacccgtaaaggtaaaccgtacgggtaacgtaaggtaacggttaccggtaaccgttaaacggg

SEQ ID NO: 38221 - DNA, 835 bp, Homo sapiens
  misc_feature: GYAE6OF01CGOEK.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtgggggatcgtgggggagcgtggtccaggccgtgggacgtccctgagtacctctcctgtgcagcgtctggattcacctttcagttagttatcggactagtcgcgtacgtcggggtccccgccgagggcctaccggaggggacccggaagggggtcctagggggtaagggtttcggggggtaggtacctaagggttttaacgttaaggttacgggggttaattggggtaaagttacgggggtaaaacgtttaaccgtaaaagtttaaaaacgggcctttaaaggtccggaaacccgtaaaggttacccccggttaccgggttaaacgggggaaaccgggggtaccccgttaatttaccccgaacccgttacgttacccgtaaccccggaaggtaacggtaaaccctaaacgtttaaccccgaaagtaaaccgaccgttaccttagttaacctccgtaacgaaccgtaaagtacggaaaccacgggtcgtaggaaccggtacgaccccggaaacggtaccggtaaccgggtcttacggttacgttaaaccgttttaccgtaggtacccgggaaaccggaaaggttaaaccccaaggggtttaacgaaggttacggttaaggttacccttaaaacggg

SEQ ID NO: 38222 - DNA, 651 bp, Homo sapiens
  misc_feature: GYAE6OF01DFJO6.35.34.D01.1.454.CMB.1.raw
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (323)..(323): a, c, t, g, unknown or other
  misc_feature (323)..(323): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggtttcctcgttgctcttttaagnggtntccagtgtcaggtgcagcgtgggggagtcgtgggggaggcgtggtccaggccgtggggacggtccctggagacctctccgtgtgcaggtcgtctggattccaccttgaaggttagttagtggactatggcctacggtcgggtccncgaggtcctacgaggcgaaggggctagggacggtgggtggctagttangtggtangagtgggaaatcaaagtaagactagtcgacaagtaccgtcggtaggacggtaccgtataccaccgtatccacgaagaacgtaacctaacgtacccaaagaacctaaccgtcttaacgtaactcgttaacgaacgtaaatacggaacgtaccgacgttacggaaacggaccgacccggaaacgccgtaacggtccttaagggttacttaacgtacgttacggaccggagaaaccgaaagtaccggagaaacggttgtaccggtaacgttaacgg

SEQ ID NO: 38223 - DNA, 759 bp, Homo sapiens
  misc_feature: GYAE6OF01EK6TF.35.34.D01.1.454.CMB.1.raw
  modified_base (182)..(182): a, c, t, g, unknown or other
  misc_feature (182)..(182): n is a, c, g, or t
  modified_base (635)..(635): a, c, t, g, unknown or other
  misc_feature (635)..(635): n is a, c, g, or t
tcagtacagatcgtcacgaccggtgctcgatttagatcgtctgtgttgggtttggggagggctttgttggagaccttgcacttgtactccttgccattcagccagtcctggtgcaggacggtgaggacgctgaccacacggtacgtgctgttgtactgctcctccggtgtttccattcggtnatcagcactgaacacgagaggactcaaccgatggtagtttgggctgagtcgttgggttttcctcgtttgctttacgtttttaagagggttcgtaccgtagttggtccgtaagggttcgccgaaggtccggttggggggggtaacgttcgggttaggggggggacgcggggttcgggttaccccgacgggtccggttaggggggtaaccggttcccccgttagggaacgtccgttcccttcccggttgtcgggtaccgaagggttccggtcggttcgggtactttacccgtacctttacggtaagtttagtttacgcgggtctacgtcgtactaccggtttcggttacccggcgtaacggtcccgtacggacgggacgggaacggggtcggtagggtacgggtcgggtggtaccgtaggtttaatgtaggtttagacgtagtacggtacgtaanaaagttaagagttagtcgaacgtacgtacggtacccggtagggaacgggttcctacttaccgaccgtactccgtaacgacgaacctaacgttaactaaccaaccgaacgtcgttactggtaacc

SEQ ID NO: 38224 - DNA, 693 bp, Homo sapiens
  misc_feature: GYAE6OF01BAWBI.35.34.D01.1.454.CMB.1.raw
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (360)..(360): a, c, t, g, unknown or other
  misc_feature (360)..(360): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (569)..(569): a, c, t, g, unknown or other
  misc_feature (569)..(569): n is a, c, g, or t
  modified_base (578)..(578): a, c, t, g, unknown or other
  misc_feature (578)..(578): n is a, c, g, or t
  modified_base (650)..(650): a, c, t, g, unknown or other
  misc_feature (650)..(650): n is a, c, g, or t
  modified_base (681)..(681): a, c, t, g, unknown or other
  misc_feature (681)..(681): n is a, c, g, or t
tcagtacagatcgtcacgaccggtgctcgatttagatcgtctgtgttgggtttggggggagaggagcccagcactagaagtcggcggtgtttccattcggtgatcagcactgaacacagaggactcaccatgggagttgggctgagcgttgggttttcctcggttgtcttacgtttttaaaggaggttgtcctaggtgttacgagggtgcgagcggtagggggntcggnggggggagcggtggtaccaggcccggtggggacggtccctgagtcctcgtccgntcggactaggcgttcaggtacttccaaccgtttnagttaggtttctggctagttgaccgacgtttccgggggtcccncgtacgggtcctaacccggaaggggccgaacgggggcgtgggaacgggttggggtcgacgtagggttttaaaggttgggtaatggaaccgttagggaaccttacgaaagttaaacgnttagngacccgtagtaccggtcgtaggaacgggcgtaacttaccgactagcccgtagaacgagacctaaacgtacaacgaacacgtgtaacnctttacganaaacgtaagtacgaacgactaccggtaaggaccgaacgacccgacgtttaacgcggcttaggtcgtaagttncggtgaacgaaaggtactaaggagtaaacgngtcgagttaacg

SEQ ID NO: 38225 - DNA, 707 bp, Homo sapiens
  misc_feature: GYAE6OF01BSGZ6.35.34.D01.1.454.CMB.1.raw
tcagtacagatcgtcacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccgaggacagacagccagcactccacctgcctcgtggagtagttaaggttggggaataaagtatagtcttgcgtggtatcgagacgaaggaacgccgacggccctacgttccccgttagttggttcggtactacgtctatacgaagtactacgacgaacgccggtaccctacggacggtactccggtgacgacgtacgttccgtcgtcgtcctacctaacgtccggtaacggaacctacgacctaccgtacttcgaccgaacctacgaccgaccgggtaccggaacccgtaggtacgttaacggtagtacgtaggtaccgtacgttacgttactttaacgttacggttacggtacgggtacgggtaccgggttaaggaaccgtcggaaccgtacggtaccggttaggttacgggttaccgggtacgggttaccggggaaccggggtaacggaaccgtacggacccggttacggaaccccggtttacggacggtaaccgtacccggtaacccggg

SEQ ID NO: 38226 - DNA, 809 bp, Homo sapiens
  misc_feature: GYAE6OF01BAJ4O.35.34.D01.1.454.CMB.1.raw
  modified_base (408)..(408): a, c, t, g, unknown or other
  misc_feature (408)..(408): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcgttgggttttcctcgttgtcttcgttttaagaggtgtccagtgtcgaggtgcgagtcggtgggggagtcggtgggggaggtcggtgggtccgaggtccgtggggacggtcccgtaggagtacccttctccgtgtcgcgtacggcgttcctggtacttccgtaccgtttacgtaagttagttacgtggactagtcgtaccgtccggtcgggggtccacccggacggtccgtaccggagggacggtaacggggcgtaggggngggtggggtacggtactaagtttacgtaaggtggtaatcggaagtacggaagtactaaagtaaacgttacgagtacgacgtaacggttaccgttaccggaagggtaccgggtaccgttaaccgtttaccaaccgtaccttaccgaacgtaaacggtaacgtaaaccctaacgtaacccgtaaaggaaaccgtacccggttattaacgtaccgttaagtaccggtaaactaacggttaaccggaaccgtaacgttacccggaaggaaccgggaacccggaaccggtaacccggaaccgtaacgggttcgttaggtaaccgggttttacaacggttggaaccggaaccggtaaaggaaaccgttacgggaaagtacggtaagtaccggttaagttaaaccggg

SEQ ID NO: 38227 - DNA, 785 bp, Homo sapiens
  misc_feature: GYAE6OF01BAAP4.35.34.D01.1.454.CMB.1.raw
tcagtacagatcgtcacgaccggtgctcgatttagatcgtctgtgttgggtttggggggggagaggagcccagcactagaagtcggcggtgtttccattcggtgatcagcactgaacacagaggactcaccatggagtttgggctgagcttgggttttcctcgttgcttcttttaaggaggtgtccaggtgtcgaggtcgcgagcgtgggggagtcggtggggggagtcggtggtccgaggccgtggggacggtcccgtggacgtaccttccgtccgtggtagccgtaggtccgtcgtgggtactttcctaccgttcgaaggttacgtttagtggacctagttcggaccgtaccggttcggggtaccccgcccgtacgggtcctacccggaagggaccggaaagggggtcctaggggagggttggggtacggaccgttaaggtttataggtgggttaagtcgggaagttaggggaattaaccgaagttaaacggcttaagtcgacgtacggtacgtccgggagggaaccgggtccgtaacttacccgaccttacgttacctaccgaaggtaacgtaacctaacgttaacccaaacggtaaaccgtaccgtacgtttacgtactacgtaacgtaacgtaaagtacgaaccgaacgtaccgttacggaacggtaacccggacccggaacgtaccgtaccggtcgttagttacgttacgttacgtaggtacgaccggtaaacgtaaccggtaacggtaaggtaggtaacgtgggtaaccgttaaacgg

SEQ ID NO: 38228 - DNA, 882 bp, Homo sapiens
  misc_feature: GYAE6OF01CVZ1N.35.34.D01.1.454.CMB.1.raw
  modified_base (309)..(309): a, c, t, g, unknown or other
  misc_feature (309)..(309): n is a, c, g, or t
  modified_base (533)..(533): a, c, t, g, unknown or other
  misc_feature (533)..(533): n is a, c, g, or t
tcagtacagatcgtcacgaccggtgctcgatttagatcgtctgtggttggggtttggggggggagaggagcccagcactagaagtcggcggtgttccattcggtgatcagcactgaacacagaggactcaccatggtagtttggctgagtcgttgggttttcctcggttgcttacgttttaaggaggttgtccgtagtgtcgagggtcgcgaggtcggtggggggagttcgggaggggggacggcggttcggtccgaggccggttaggggtacggtcccgtaggacgtacgtcgttccgtggtcgacgnggtccgttcgtacggtctttaccgaccgtttagtaaggttagttagtacggtctaacggtcgtacctacgggtcggggtaccccgaccggtacggtcccgtaccggaagggaccggtaaacggggtacgtggggttacgggttgggttacggagttgggtttggttacggttaggttagtaggtaaacggttaagggtaaagttaagtaacgtaatacgttaancggaacgtaaacggcgtaacgggtaacgggaccgggtaccttaacgtaccaacccgttataccccggtaacctaacggtaaactaaaccgttaaaccgtttaacccgtaaaagtttaaccccgtttacgtttaccgtttaccgtaaacgaaacttaaaacgggttccaaaaaccgttccggaaccggttaagggaaccgacggtaacccgggaacggacggtaaccggtaacgttaaattaacgtttaacgttaccggtaggtaacggacgggaaaaacgtacggtaacgggaccggtaaccgggtaaccccggtaaccccgtaaaccgggtgtaacccggtaaccggg

SEQ ID NO: 38229 - DNA, 763 bp, Homo sapiens
  misc_feature: GYAE6OF01BLFCD.35.34.D01.1.454.CMB.1.raw
  modified_base (355)..(355): a, c, t, g, unknown or other
  misc_feature (355)..(355): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagcgtgggggatcgtgggggagcgtggtccagccgtgggacggtccctggacgacctctcctggtgcagcgtctggattccaccttcagtagttatggctatgcacgtgggtcccgccgtacggctaccgacggacgaaggggcgttagggaggtggggnggtacgtagtttagtagtggttaatggaagttagggaacgtacaaagtaaaacgtaccgttaagtacggacaacggtaccgtaccgggtaggtaaccgggacccgtacgtttaacccgaacccgtaacgttacccgtaacccgtaaacggtaacgaaaacccttaaacgtttaaccccgaaaagtaaaccctaccggtacttacggttaacttacgtaccgtaaactaaaacgtaacggaaacgtaaccgtaccgttaagggaacgaaccgggtaaccccggaacggtaaccggtaccgggtacgttacggttaacggtttaacgtttaccggttaacggtacggtaaccgtaaacggtaaacccggtaacggtaaggaggtaacgttgggtaaccgtttaaaaccgg

SEQ ID NO: 38230 - DNA, 719 bp, Homo sapiens
  misc_feature: GYAE6OF01E0AW7.35.34.D01.1.454.CMB.1.raw
  modified_base (173)..(173): a, c, t, g, unknown or other
  misc_feature (173)..(173): n is a, c, g, or t
  modified_base (213)..(213): a, c, t, g, unknown or other
  misc_feature (213)..(213): n is a, c, g, or t
tcagtacagatcgtcacgaccggtgctcgatttagatcgtctgtggttgggtttggggggagaggagcccagcactagaagtcggcggtgtttccattcggtgatcagcactgaacacagagacctcaccatggagttgggctgagctgggttttctcgttgcttctttaagnggtgtccagtgtcaggtgcagcgtgggggatcgtgggggngtcgtgccagtccgtgggacgtccctgacgtacctcgtcctgtgcgtaggtcttacgtggtacttccgtaccgttcaaggttacgtatcggctaagtcgacgtaccgtcgggtcccaccgtaggccttaacccgagggtcgaagggggtcctagggtaggtcggggtagtacggttaaggttactagttggggtaacttcgtaaggtcggtaaacgtactaaagtaaacggtcttaagcggtacttaaacggcccgttacggtaagggaaccggggtcctacgttacccaacgtacgtccgtacgaaggtaacgaactaacgtaaccaaacgtaacctacgtacgtagtactacgaacgtaacaaagtaacgacgacgacgtacgacggtacctacggaccgagtaccggtcgtaaggttcggtaaacgtttcggacgttaccgggaacggaaaccgtaaacccggtaaggtaaccggtaaggtaccggtccgttaacgtaaacgg

SEQ ID NO: 38231 - DNA, 821 bp, Homo sapiens
  misc_feature: GYAE6OF01DCA57.35.34.D01.1.454.CMB.1.raw
  modified_base (128)..(128): a, c, t, g, unknown or other
  misc_feature (128)..(128): n is a, c, g, or t
  modified_base (178)..(178): a, c, t, g, unknown or other
  misc_feature (178)..(178): n is a, c, g, or t
  modified_base (659)..(659): a, c, t, g, unknown or other
  misc_feature (659)..(659): n is a, c, g, or t
tcagtacagatcgtcacgaccggtgctcgatttagatcgtctgtgttgggttgggggggagaggagcccagcactagaagtcggcggttgttccattcggtgatcagcactagaacacagagctcacngtggtagttggctgagtcgttgggtttcctcgttgtcttacgtttaaggngtgtccagtcgtcgaggtgcgaggtcggtgggggacgtcgggtggggggacgccggtcggtaccgaacggtccggtaggggaccgtcccgtaggtaacgtccgtcctccggtgtcgaccgtcggtcgttacgtacggtacttaccgtaccgttacgttaagttacgttacggtggctacgggtcgacggtacggttccgggtccgtaccggtacggtaacccgtcgggaaaccgggcggggtaaaccggggtccggtaagggggtacggttaggggtcgtaacgttaaggttcggtaaggttggtacgtaacggtaggtaacggaagtaacgtaagtaaacggtaactagtacgtacgtaaaccggttccggtaacgggtaaccggtaacgggtcccttaacggtacctaccgtacgtaaccccgtaagaacgtaaaccgtaaacttaccggaaaccaacgtaacccgtacgtcgttaacncgtacgtaactaacgtaacggactaacggtaactcgaacggaccgtaaccggcccgtaacgaacggtcgtacgttcggtaaaacgttcgtaacggtacggtcgtaaaccggtaagtaaacccgtagggacggttaagtacgggtaaacccttagtaaccggg

SEQ ID NO: 38232 - DNA, 190 bp, Homo sapiens
  misc_feature: GYAE6OF01ATQR7.35.34.D01.1.454.CMB.1.raw
  modified_base (169)..(190): a, c, t, g, unknown or other
  misc_feature (169)..(190): n is a, c, g, or t
tcagtacagatcgtcacgaccggtgctcgatttagatcgtctgtgttgggtttgggggtgtggtggtctcccactcccgccttgacgggcttgctatctgcccccctggtcactctgttccaccctcctcacgatctgtactggagcgggctggctaaggcgtcatagnnnnnnnnnnnnnnnnnnnnnn

SEQ ID NO: 38233 - DNA, 785 bp, Homo sapiens
  misc_feature: GYAE6OF01DMMUD.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagtcgttgggttttcctcgttgcttcttttaagaggtgtccagtgtcgaggtgcaggcgtgggggagtcggtgggggagcgtggtccaggccgtggggacgtcccgtgacgtacctccgtccgtggtcgcgacggtccgttcgtaggtactttccacccgtttcaggttaagtttaagtggtacaagtgaccgtaccggttcgggtcccgccgaggtccgtaccgagggacgaacggggtccgtaggggacgttgggggtacggtcgtaaaggttttagtagttagggttaagtaggtaagttaaggggtaacgttaacgaaaagttaaaaacggtcgttaagtccggaacgtaaaggtaacccggtttaccgggtaagggaaccggggtacccgttaacttacccgaaacccctacgtaaccccgtaaccgtacggtaaaccgtaaacctaaccgtttaacccgaaaccgtaaacccgtacgtacttacgtacttacgtaacgaaacctaaagtaaccggaaactaccgcgtaaggacgaccgtaccggaccgaccggtacgtcttagttacgtaacgttaacgtggacgacggtaactaaccggtaacggtaaggagtaacgtgtaaccgttaaacgg

SEQ ID NO: 38234 - DNA, 644 bp, Homo sapiens
  misc_feature: GYAE6OF01AZMJU.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcgttgggttttcctcgttgtcttcttttaagaggtgtccagtgtcgaggtgcgagcgtggggagtcggtggggagcgtggtccagccgtgggacgtcctgagactctcgtgtgcagcgtcgtggtatccaccttgagttagttagtggcagtcgcgtacgtcgggtcccgcgaggctaccgaggcggaagggctgggagtgggacggtacgtagttagtagtggtagtggagtaggaaagttacaaagttaaacgcgtaagtacgagtaaccgtacgtacgggtacggaacgggtccctataccaacctcgtacctacgaagaacgtaactaacctaaccgaaagtaccgaccgtacgttagactacgaacgaactaagtacgaacgtcgacgtagaacgaccggaccgtacggaccgtggacgttataaggttactacgtgggtacgaaccggtaacgaaccggacgttaaggaagtagtaccgtaacgttaaacg

SEQ ID NO: 38235 - DNA, 642 bp, Homo sapiens
  misc_feature: GYAE6OF01CAQDP.35.34.D01.1.454.CMB.1.raw
  modified_base (110)..(110): a, c, t, g, unknown or other
  misc_feature (110)..(110): n is a, c, g, or t
  modified_base (183)..(183): a, c, t, g, unknown or other
  misc_feature (183)..(183): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
tcagtacagatcgtcacgaccggtgctcgatttagatcgtctgtgttgggtttggggctgggcctcaggaagcagcatcggaggtgcctcagccatggcatggatccctntcttcctcggcgtccttgcttactgcacgaggctccgtgcctccgtatgagctgacctcgacgcccacccgtnagttcgtccgtcgccccaggacagacacgccagtcatccacctgcctgtaggagtancgntagtcgacaagacaatatacttagtcgtacagacagacgtcgacggccacggtcccgtagtagtagagtagtataagtaagtaacgactacgaggacgacggaccgtacggacggtactcccgtaggacgtacgtacttcgtcgtccgcgtcgacgtacgtacgacgactacgtacgtacgtacgtacaactacgtacgtaggtacggacgtacgagacggaagagtacggaggtacgttaaggtcttaacgttcgtaacgttaacgtatacgaacgaccaacgaaccaacgtaaacgtacccgtacgggttcccggttaggttaccggggtaccggaaaccggtaccgtaaacgtccggtacggtaccccggttaccgtacggacccggtaaccccgg

SEQ ID NO: 38236 - DNA, 782 bp, Homo sapiens
  misc_feature: GYAE6OF01EB3F7.35.34.D01.1.454.CMB.1.raw
tcagtacagatcgtcacgaccggtgctcgatttagatcgtctgtgttgggtttgggagggctttgttggagaccttgcacttgtactccttgccattcagccagtcctggtgcaggacggtgaggacgctgaccacacggtacgtgctgttgtactgctcctcccggtgtttccattcggtgatcagcactgaacacagagactcaccagtggagtttgggctgagtcgttgggttttccctcgttgtcttcgttttaaggaggttgtcctagtgtacgagggtgcgaggtcggtggggggagtcggtggggggacggcggtgggtccaggtccggtggggacggtcccgtaggacgtaccgttcttcccgtggtcgcgtacggccgttcgtggtactttaccgtaccttcgtaaggttacggtttagtcggactagtcgaccgtacggtacggggttccccgaccggtacgggtcccgtaccggacgggacggtaacggggggtcgttaggggtacgggtacgggggttacgggtaaccgtaagggttttaagttagggttacgggttaagttagggtaaggttaacggggtaaacggttacgtaaaaggtttaaaaccggtaacgtttaacggtacggtaacggtaaccgtaacccggttacccgggtaagggtaacccggggtaccttaaccgttacccgaaccgtacgttaccctaaccggtaacgtaaaccgtaccaaacgtttacccgaaaacgtaacgtaccgtgttacggtaac

SEQ ID NO: 38237 - DNA, 846 bp, Homo sapiens
  misc_feature: GYAE6OF01DAT7U.35.34.D01.1.454.CMB.1.raw
  modified_base (291)..(291): a, c, t, g, unknown or other
  misc_feature (291)..(291): n is a, c, g, or t
  modified_base (336)..(336): a, c, t, g, unknown or other
  misc_feature (336)..(336): n is a, c, g, or t
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagtcgttgggttttcctcgttgcttcgttttaagaggtgtccagtgtcaggtgcgagcggtgggggagtcggtgggggaggcgtcggtaccgagccgtggggacgtccctagacgtacctccgtccgttggtcgacgagtccggttnttaggtactttaccgtacccgtttcgtaaggtttaacgtttaagnggacctaacggttcgacctaccggttcggggtaccccgaccgacgggtccctaccggaacgggaccggtaacggggtcgtaggggtaacgggttggggtacggacttaaggtttaagtaggtaggtactggtaagtacggaacttacaaagttaaacgctagcgacgtacgtaccgttcggagggaacggccttaagtaccgaacctacttcccgaacgacgaaacgtaactaacgtaaccaaacggtaaaccgaccgtacgttaacgttacgtaccgtaacgtaaacgtaaaacgttacgaaaacccgtacgtacccggtaaaggtaaccggaacccggaacggtaacccggtaaacccggtaaccggggttacctttaggttaaaccggtttaaaccgttttacggtaacgggttaccgggaaacccggttaaaaaccggttaaaacgtaacggggtttaaaacgacggtttaaaacgggtaccggttaaaacggttttaaaacccgg

SEQ ID NO: 38238 - DNA, 919 bp, Homo sapiens
  misc_feature: GYAE6OF01AZ8SN.35.34.D01.1.454.CMB.1.raw
  modified_base (176)..(176): a, c, t, g, unknown or other
  misc_feature (176)..(176): n is a, c, g, or t
  modified_base (195)..(195): a, c, t, g, unknown or other
  misc_feature (195)..(195): n is a, c, g, or t
  modified_base (305)..(305): a, c, t, g, unknown or other
  misc_feature (305)..(305): n is a, c, g, or t
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagcttgggttttcctcgttgcttcttttaagnggttgtccagtgtcaggtncagcgtggggatcgtggggacgcgtggtccagccgtggggacggtccctggacgacctctccgtagtcgcagtcgttctaggtacttcaccgtttcgagttagtttacgnggacattcgacctacgttcggggtccccgccgaacgggtccctccggaacggggtccgaaacggggggtcttacgggggtaaggttcgggggtacggtaccgttaaagggtttttaagtaacggtttacggggtttaaacgtcgggtaaaggttaccggggtaaaaaacggtttccaaaaaagggttttaaaaaccgggcccttttaaaggtccggaacccgtaaacggtaccccgtttacccgggtttaaggggaaaaccggggttccccgttaaacgtttaaccccgaacccgttacttacccggttaaccccgaaacggttaaacgtaaacccgttaaaccgtttaaccccgtaaaaacggtaaacccgtaacccgtaccggtttaacgtaaaccgtttcccggttaacgaccgttaaaacgtaccgtaaaccgacggttacccgtaacggtaaaccgggacggtaccccggtaaaccggaaccggtaacggtaccgtttacgggttaacgtttaaccggttaccggtttaagggtaaccggtaaccggaaacggttaaaacccgggtacggttaaacggaacggtaacgttcgggtaaaccgtttaaacg

SEQ ID NO: 38239 - DNA, 819 bp, Homo sapiens
  misc_feature: GYAE6OF01DW11X.35.34.D01.1.454.CMB.1.raw
  modified_base (204)..(204): a, c, t, g, unknown or other
  misc_feature (204)..(204): n is a, c, g, or t
  modified_base (490)..(490): a, c, t, g, unknown or other
  misc_feature (490)..(490): n is a, c, g, or t
tcagtacagatcgtcacgaccggtgctcgatttagatcgtctgtgttgggtttgggggggagaggagcccagcactagaagtcggcggtgtttccatccggtgatcagcactagaacacagaggactcaccatggtagtttgggctgagtcttcgggttttcctcgttgtcttacttttaaggaggtcgtccagtgtcgaggtncagtcgtgggtggtagtcgggtaggggggacgcggtggtccacggtccgtggggacggtccctgacgtacctctcgtgtaggacgcgtcgtaggtattccattaccttacaaacttaacgtagtcggactagtcgccgtacggtccgggtcccgaccgacggtcctaccggaagggacggtaaacggggtcgttaggggtaccggttaggggtttcggacgtttagggttggtacgggttaggtatagggaagtaaggtaaacgtttaaaagtcggtaatacgtancgtaacgaagaccggtaacggtagggaaccgggtccttaacttaccgaacgtaccgtactacgaaacggtaacgaaaccctaactttaaccgaaacgtaaccttttaccgtttaccgttacgtaacgtaacttaaacgtacgttaacgacggtacggtaacggaacggaaccggggaacccggtaacggaaaccgtaaccgggtaacgttaaacgtttaaacttacggttaacggtttagggaaccggttaacggaaacggtaacggaaccggtaccgggttaaccggggtaacccgtcccccggtaaaccccggtaggtaacccgggg

SEQ ID NO: 38240 - DNA, 818 bp, Homo sapiens
  misc_feature: GYAE6OF01DB3YG.35.34.D01.1.454.CMB.1.raw
  modified_base (201)..(201): a, c, t, g, unknown or other
  misc_feature (201)..(201): n is a, c, g, or t
  modified_base (277)..(277): a, c, t, g, unknown or other
  misc_feature (277)..(277): n is a, c, g, or t
tcagtacagatcgtcacgaccggtgctcgatttagatcgtctgtggttgggttgggggggagaggagcccagcactagaagtcggcggtgtttccattcggtgatcagcactgaacacagaggactcaccatggtagtttgggctgagtcttgggttttcctcgttgcttacgttttaaggaggttgtccagtgtcaggtncagcggtgggggatcggtgggggaggcggtcggtccaggcccgtggggtacgtcccgtgacgcttctccgtgtcgnacgtcgtctggtacttacctacctttgaaggtttagttacgtggactagtcgaccgtaccggttcggggtacccgacccgtagggtccctacccggaggggacccggtaagggggtccgtttagggaggggttcggggtaggaccttaaggggttttcggtggttaggggtactgggtaaagtaagggtaaggttaaaatacgtaaacgtaacgtgtacgggaaacctaacggtaaccgtacgggtaagggtaaccggggtacccttagtttaaccccaacgtacgttacctacccggaaaggaacctaaccttaaacgtaacccggtaaattaaccgttcgttttcggtacccttaagaacgtaaaccgtagaaccgtaccggactgggtaacgcccggaacggtacgaccgtaccggaagttaacttaacggttactttaacgggcggttaacggccggtaaacgggaacggtccgggttaaacggtccggggaaaccccccgttaccccggaacccgggttgtcgggaaacccccggg

SEQ ID NO: 38241 - DNA, 717 bp, Homo sapiens
  misc_feature: GYAE6OF01A3BPJ.35.34.D01.1.454.CMB.1.raw
  modified_base (294)..(294): a, c, t, g, unknown or other
  misc_feature (294)..(294): n is a, c, g, or t
tcagtacagatcgtcacgaccggtgctcgatttagatcgtctgtgttgggtttgggagggctttgttggagaccttgcacttgtactccttgccattcagccagtcctggtgcaggacggtgaggacgctgaccacacggtacgtgcttgttgtactgcctcctcccggttgtttccattcggtgatcagtcactagaacacagacgactcaccagtggtagtttggctgagtcgttgggtttcctcggttcgctttgtttaaggcggttcgtccgtaggttcgtcgtaggtcncgaggtcggttacgggggagtccgggtgggggacggcgtcggtccgaggccgtggggcgtccgtggacgtactccgtcgtggtcgtcgacgtcgttcgtacgtacgttcctaacgttcgtaaggtaggttttacgcgtactacgtcgaccgtaccggtcggtcccgacgtacgccgtacggaagggtacggtagggggtacgtgggtaacgggtgggttacggtagttaacgggtttaagtaggtttcgggtaacttggaacggttacgggtaaagtaaacgtaataaaacggtcgttaaagtcgtaaccgaacgttaacccgtgggtaacgggtaccgcggttacttaaccggacccttaagtaccacgggaagtaacaaccgttaactaaccgaaacgtaacctacggtcgttacgtacgg

SEQ ID NO: 38242 - DNA, 658 bp, Homo sapiens
  misc_feature: GYAE6OF01BVEJ7.35.34.D01.1.454.CMB.1.raw
  modified_base (547)..(547): a, c, t, g, unknown or other
  misc_feature (547)..(547): n is a, c, g, or t
  modified_base (571)..(571): a, c, t, g, unknown or other
  misc_feature (571)..(571): n is a, c, g, or t
  modified_base (604)..(604): a, c, t, g, unknown or other
  misc_feature (604)..(604): n is a, c, g, or t
  modified_base (624)..(624): a, c, t, g, unknown or other
  misc_feature (624)..(624): n is a, c, g, or t
  modified_base (648)..(648): a, c, t, g, unknown or other
  misc_feature (648)..(648): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcttgggttttcctcgttgtcttcttttaagaggtgtccagtgtcaggtgcaggcgtgggggagtcggtggggggagtcggtggtaccaggccgtggggacgtccctgacgacctcctccgtgtcgctaggtcgtcgtggtacttaccacctttcgaaggttagttagtcggactagtcggcctacggtcgggtcccgccgaggcctccggaagggaccggaaaggggtcgtggggacgggttggggtacggtactaaggtttagtagtgggtaactggaagtaggggaaactacaaagtaaacgtatagtacgatacgtaccgtccggaagggtaaccgggaccttatacccaaccgtcttaccgacgaagaactaaccgttaactacccgaaagaaccncgtactatactactagaactaaancgaacgcgtaccgagacgacgacccgagaccgntcgtatagtacgttgacggngactaaggaactaggtagacgtgngtacttaacg

SEQ ID NO: 38243 - DNA, 553 bp, Homo sapiens
  misc_feature: GYAE6OF01BVXAH.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagcgtgggggatcgtgggggagcgtggtccagcctgggaggtccctgagactctctgtgcagcgtctggattcaccttcagttagttatggcatgacacgtcgggtccgcgaggcctccgaggcaaggggctgggagtgggtgcagttatagtggtatgagtggaagtcaataaagactatcgacagaccgtcgtggaagggccgtattccaaccactcctacgagaacgaactaacttaccaaagaaccacgaccttaggtacttacgtagaacaaatacgaaacacgacctgaacgacgccgaacgacgacggtctagtgtattagtggtgacgagaactagagagatggctaacg

SEQ ID NO: 38244 - DNA, 730 bp, Homo sapiens
  misc_feature: GYAE6OF01A7TIQ.35.34.D01.1.454.CMB.1.raw
tcagtacagatcgtcacgaccggtgctcgatttagatcgtctgtgttgggtttggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtgggggatcgtgggggagcgtggtccagccgtgggacgtccctgagcctcgtcctgtgcagcgtctggtacttccaccttcagttagttatggctagtgccgtacgtcggggtcccgccgacggcctaccgaagggcgaaaggggctgggagggtggggtgacgtagttatagttggtatgagtaggaagtacaagtaaacgacttagcgacgaacggtaccgtccggtagggaaccgggtcccgtaacgttacccaacctacgttcccttaaccccgaaggaacgtaaccttaacgttaaccccgaaaacggtaacccccacggttaccttacggttaacttccgtaacggtaacaaaacgttacggaaccgtaacgtcccggtaaaggaaccggaaccggacccggaaccggtacccgacgggttacgttacgggtttacgttaccggtttaaccgttcgggaacgtacccgggaaaggttaaaccgacgggttaaggacggtaacgttaccgggttactaaaccggg

SEQ ID NO: 38245 - DNA, 643 bp, Homo sapiens
  misc_feature: GYAE6OF01BNK8T.35.34.D01.1.454.CMB.1.raw
  modified_base (314)..(314): a, c, t, g, unknown or other
  misc_feature (314)..(314): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtgggggagtcgtgggggagcgtggtccaggccgtggggacgtccctgagacctctcctgtgcagcgtctggtattcacctttcagttagttatggctagtgctacgtcggggtccnccgaggcctccgagggcgaacgggggctgggagtggggtggctaaggttatagtggtatcggagtggaaagtcaagtaaagactagtgacaggtaccgtcggtaggaacggggtcctagttaccgaacctacgtccctaccgaagtaacgaacgtaaacgttaccaaagtaaaccacgtactagtactcgtagaactaaatacgaacagtaccgtaggaacgtacgacccgaacgtaccgacgggtccttaggttacgttacgttacggtcggtacggacggtaaacgaaaccgtacggtaagtaagtcgttaggtacccgttaaacgg

SEQ ID NO: 38246 - DNA, 814 bp, Homo sapiens
  misc_feature: GYAE6OF01D0ZI4.35.34.D01.1.454.CMB.1.raw
  modified_base (160)..(160): a, c, t, g, unknown or other
  misc_feature (160)..(160): n is a, c, g, or t
  modified_base (778)..(778): a, c, t, g, unknown or other
  misc_feature (778)..(778): n is a, c, g, or t
  modified_base (796)..(796): a, c, t, g, unknown or other
  misc_feature (796)..(796): n is a, c, g, or t
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagtcttgggttttccncgttgcttattttaaggaggtgtccagtgtcgaggtgcaggcgtggggactcggtgggggagcgtggtccagccgtggggacgtccctaggacgtaccttcgtcctagtcgacgtacggtccgttcgttcgggtaactttacccgtaaccctttagaaggtttacgtttacgcggtactagttccggaccgtacggtttccggggaccccgacgaaccggggtcctacccgggaagggtacccggtaaaggggggttccctggggtaacgggtttcggggtacgggtacttaaaaggggtttacttacggttagggggttaacttaggtaaacgttaagggaaacgtttaaccgaaagtaaaaacgtcgttaagacgggaaccttaaggggtacccctttaaacggggacgggtaaaaccggggtcccttaaccgtttaccgaaaccccgttacgttacccaaccccgggtaaataaccgggtaaaccttaaaccgtaaccgaaagtaaaaccctccggtagttaacgacgttacgtaacgtaaccgtaaagtacgaaccgtacggtccttaaggaacgaccggtaccgaacggtccgagtctagttactacgttagngtacgaacgtagaacgtnaaggatagcgtactaagg

SEQ ID NO: 38247 - DNA, 820 bp, Homo sapiens
  misc_feature: GYAE6OF01D03PZ.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagtcttgggttttcctcgttgctttcgtttttaaaggaggttcgtccaggttgtcgaggtgcgaggcggtggggggtactcgggtggggggacggcggttcgggtcccaggtccggttagggggaccggttccccgtaggacgtaccttcccgttccgttggtcgccgaggtccggttacgttaggtaactttcccgtaacctttcgtaaggttagtttaaggtcggacgtagtcggtccgtacggttccgggggccccacccggtacgggcctacccgggaacgggaccggaacggggggtcgtagggggtagggttcgggggttagtaccgttaaggttttaagtaggttacggttaagttagggtacgtaagggtaacttacgaaaagttaaacggtacctaaggcgtaacgaacggttaccggtacggaaagggtacggtaccgtactacccgaactacgttccaacgtaacgagtaaactaaccgtacaagtaaccgcgtattacgtactacgataaacaacgaacgtaacgacgggtactacggacggtaccgacccgggtacgaaccggttacgacgtttaggttacgtttacgtttaggtacgggtaacgacccggtaaacgaaaccgtgggttaaggacggttagtaacggttaccgttaaacggg

SEQ ID NO: 38248 - DNA, 169 bp, Homo sapiens
  misc_feature: GYAE6OF01A3XXF.35.34.D01.1.454.CMB.1.raw
  modified_base (166)..(169): a, c, t, g, unknown or other
  misc_feature (166)..(169): n is a, c, g, or t
tcagtacagatcgtcacgaccggtgctcgatttagatcgtctgtgttgggtttggggggtgtggtggtctccactcccgccttgacggggctgctatctgccccctggtcactctgttcccaccctcctcacgatctgtactgagcgggctggcaaggcgcatagnnnn

SEQ ID NO: 38249 - DNA, 176 bp, Homo sapiens
  misc_feature: GYAE6OF01E2UEI.35.34.D01.1.454.CMB.1.raw
  modified_base (173)..(176): a, c, t, g, unknown or other
  misc_feature (173)..(176): n is a, c, g, or t
tcagtacagatcgtcacgaccggtgctcgatttagatcgtctgtgttgggtttgggggaagaggaagactgaccggtccccccaggagttcaggtgctgggcacagcgccctggctgcctggtcaaggactacttccacgatctgtactgagcgggctggcaaggcgcaatgnnnn

SEQ ID NO: 38250 - DNA, 842 bp, Homo sapiens
  misc_feature: GYAE6OF01CMPK4.35.34.D01.1.454.CMB.1.raw
  modified_base (187)..(187): a, c, t, g, unknown or other
  misc_feature (187)..(187): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatgggagtttgggctgagtcgttcgggtttttcctcgttgtcttacgttttaaaggnggttcgtccaggtgtcgagggtgcgaggcggtgggggagtcggtggggggacgcggtcggtcccgaggcccgtggggacggttccctaggacgaccttcctccgtggtcgccgagtccggtcgtcggtacttcctaccgtttagaagttagttatcggctagtcgaccgtcggtccgggtccccgacgacggtcccgtaccggagggaccggaagggggtcgtggggtaggttggggtacgtacgtaaggtttattacggtggttaagtggtaaaggtttacggggtaaacgttactaaaagttaaaaacggtaccgttaaggtccggtaaccgtaaacggttacccgtacccggggttaaagggaacccggggtacccgttaaccgttaacccgtaacccgtaaccgttacccgtaacccgaaacggtaaaccgtaaacccgtaaaaccgttaaacccgaaaccgtaaacccgtaacccgtacgttaacgtacgttacgtaacgtaaacgtaaacgtaacgaaccgtaccgtaccgaggaacggaaccgaccggaacggtaaccggacgtacgttaggttaacgttacgttagtacggttacgggtaacgaacggtaaacgtacgggtaagaggtaacgtggtaacgttaacgg

SEQ ID NO: 38251 - DNA, 718 bp, Homo sapiens
  misc_feature: GYAE6OF01AOKHA.35.34.D01.1.454.CMB.1.raw
  modified_base (308)..(308): a, c, t, g, unknown or other
  misc_feature (308)..(308): n is a, c, g, or t
  modified_base (373)..(373): a, c, t, g, unknown or other
  misc_feature (373)..(373): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggacctcaccatggagtttgggctgagtcttggggttttcctcgttgcttacttttaagaggtcgtccagtgtcaggtgcagcgtgggggatcgtgggggagccgtggtccgagcccgtaggggacgtccctggagcctctcctagtcgcagcgttcgtggtacttccgaccttcaggttattacgnggcgatcgcgtaccgtcgggtccccgaccgaggtcctacgaggcgaaggggctgggacggtgggngacgtagtttaagtgtggtaatcggaagtcggtaaagtactaagtaaacgtntaagtcgagtaccncgtacggtgtaaccgggtcctacgttccaacctagtccgtacgaaggaacgtaactaaacgtacccgaaaacgtaacgtaccgtacttacggtaacttaccgtaacgtaacgtaaacgttaacgaacccgtaaggtccccgtaaggtaacggaccggtaccccggaacggtacccggaggtaccgttacggttacgttaaacggtccgtaggtaacccgacggtaaaccggtaaataacccggtaggaaccgtaagggttaacccgtggtttaaaccgg

SEQ ID NO: 38252 - DNA, 836 bp, Homo sapiens
  misc_feature: GYAE6OF01BB77L.35.34.D01.1.454.CMB.1.raw
tcagtacagatcgtcacgaccggtgctcgatttagatcgtctgtgttgggtttgggaggctttgttggagaccttgcacttgtactccttgccattcagccagtcctggtgcaggacggtgaggacgctgaccacgacggtacgtgtcttgttgtactgccttcccgttcccggttgtttacctagtttcggagtatccgagtaccacgtacgaacacgaggacggacctcaacgagtggtagtttggactggagtcgtttcggtttcctcggttgtacttacgtttaaggcggttcgtaccgtagttcgtacgtaggtcgcgtaggtcggtaggggtacgttcggggtaagggggtcggtccggttacgggtcctacgggtccgggtaggggtaccggttcccggtaggtaccgtacgttccgttcgttcggtacgtcggtacgtcggttaccgtcggttacttaccgtaccgttcgtagtaacggttcgtacgtcgtagtcgtacgtacggtacggtacccgcggaacggtccgtaccgggtaacgggtacgggaacggggtcgttacgggggtacggttcgggtacggtacgttaacggtttagtaacgggttaggtaagtacggtaaggttacgggtaaacgttacggtaaacgttaaacgttacggtaacgttaaccggaggttaaacccggtacggtacgggtaaaccggggtaccgtaacccggtacttaaacccgtaacccgtacgttacccggttaaacgaaacgtaaccgtaaacgtaaacccgttaacggaaacgtaaacgcccgtttaacggacttaaacccgg

SEQ ID NO: 38253 - DNA, 747 bp, Homo sapiens
  misc_feature: GYAE6OF01BGOM7.35.34.D01.1.454.CMB.1.raw
  modified_base (563)..(563): a, c, t, g, unknown or other
  misc_feature (563)..(563): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagtcgttgggttttcctcgttgcttcttttaaggaggtgtccagtgtcgaggtagcaggcgtgggggagtcgtagggggagcgtgtccagccgtgggacgtcccgtagcgactctcctgtgcagccgttcgtggtacttacgtaccttacgtagttagttacgtggcctagtccggacgtaccggtccggggtcccgacccggagtcccgtcgagggacccggaaggggtccgtaggggacgggtggggtcgggactaagggtttaattacggtggtataggtagtagggtaacgtacaaaaggtaaacgtcgtaagtacgacgacggtaccgtcggacgggaacgggtccgtacgttccacctacttcccgtacaaggtaacgtacctaacgtacccgaaacggtacctaaccggtnttacgtaacttcgaacgtaaataacgttacgaacgaccgttacgtaacgaggaacccgaccggtaaccgacggttaacccggtagttaccggggttatttacgttaggtaccgggttcgaacggtaaacccgggtaacggtacggttaaacgggacgttacggtaccgttaagttaaacccggg

SEQ ID NO: 38254 - DNA, 807 bp, Homo sapiens
  misc_feature: GYAE6OF01DXX9Y.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagttttgggctgagtcttgggtttttcctcgtttgcttcttttaaggaggttgtccagtgtcaggtgcagcgtgggggatcgtggggggagcgtggtccaggccgtggggacgtccctggacgtaccttccgtccgtggtcgaccgaggtccgttcgttaggtactttaccgtaccccgtttgaaggttttaggtttaatcgggtaccaagtttcggacccgtaccggtttccgggggtccccgacccgtaaggggtccccttaccggaacgggggaccggaaagggggggttccgtagggggtaacggggttggggtacggacgttaaggttttataaggtttcgggtataggtaagttacgggaaagttcaaaattaaacggcttagtacggtccgaagtaccggttaccggtaaaggggaacccgggttacccgtaactttccgaaccgttactcccgtaaccgaaggaacctaaacttaaccgttaaccaaacgtaacccacggtacgtttacgtaactaccgtacgtaacgtaaacgtaaccgaacgacgtcccgttaagaacggtaccgacggtaaccgacggtaccggtcgttaggttacgtttacttaggtagtaccggagaaccgtaacgtaacggtaagcggtttaagcggttacgttaaacg

SEQ ID NO: 38255 - DNA, 848 bp, Homo sapiens
  misc_feature: GYAE6OF01C1VZ4.35.34.D01.1.454.CMB.1.raw
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (282)..(282): a, c, t, g, unknown or other
  misc_feature (282)..(282): n is a, c, g, or t
  modified_base (410)..(410): a, c, t, g, unknown or other
  misc_feature (410)..(410): n is a, c, g, or t
tcagtacagatcgtcacgaccggtgctcgatttagatcgtctgtgttgggttgggggggagaggagcccagcactagagtcggcggtgttccagttcggtgatcagcactgaacacagaggactcaccatggtagttgggctgagtcgttggttttcctcgttgcttacgttttaaggaggttcgtccaggtgtcgagggtcnaggtcggtagggggattcgggnggggggacgtcggtcgtaccnggtccgtgggaccgtccgtagacgtactccgtccgngtcgactggtccgtgtacggttacttaccgtccttgtaagttagttagtcgactcgtgacctccggtcgggtaccgccgtacggtcctacggacggaacgggtgggtacgtggtagggtcgggtacgnttaacgttagtgtacggtaatggaggtaggaactacgtaaacttaaggcttaggacgacttaacgggtaccttaccggggagggtaacccggtccgttaacgtacccctactaccgtttccgaaccctaaagggaactttaaccgaacggttaaccaaaccgggtaaaccgtccggtaccgtttaactaccgttacgaaccgttaaacgtaaagggtacccttaaccgggaaccggtttccgaacggggttaaacccgaccggggtaaacccgccgggtaaaccggggttaacccggtgggttttaaacggggttaacgtttaacccgtttaccgggggtagttaaacccggtaaaccggggttaaaaccgaccgggtttaaacgggaaaccgttccggttaaacgggttacccggtttaaaccggtttaaaaccggg

SEQ ID NO: 38256 - DNA, 165 bp, Homo sapiens
  misc_feature: GYAE6OF01A7A49.35.34.D01.1.454.CMB.1.raw
  modified_base (125)..(125): a, c, t, g, unknown or other
  misc_feature (125)..(125): n is a, c, g, or t
  modified_base (129)..(129): a, c, t, g, unknown or other
  misc_feature (129)..(129): n is a, c, g, or t
  modified_base (140)..(140): a, c, t, g, unknown or other
  misc_feature (140)..(140): n is a, c, g, or t
  modified_base (142)..(142): a, c, t, g, unknown or other
  misc_feature (142)..(142): n is a, c, g, or t
  modified_base (159)..(159): a, c, t, g, unknown or other
  misc_feature (159)..(159): n is a, c, g, or t
  modified_base (162)..(165): a, c, t, g, unknown or other
  misc_feature (162)..(165): n is a, c, g, or t
tcagtacagatcgtcacgaccggtgctcgatttagatcgtctgtgttgggtttggggggtgtggtggtctccactcccgccttgacggggctgctatctgccccctaggtcactctgttcccgcnctcnagatctgtacngngcggctgacgagcatanagnnnn

SEQ ID NO: 38257 - DNA, 172 bp, Homo sapiens
  misc_feature: GYAE6OF02F7ZEL.35.34.D01.1.454.CMB.1.raw
  modified_base (171)..(172): a, c, t, g, unknown or other
  misc_feature (171)..(172): n is a, c, g, or t
tcagtacagatcgtcacgaccggtgctcgatttagatcgtctgtgttgggtttggggaagaggaagactgacggtccccaggagttcaggtgctgggcacagcggccctgggctgcctggtcaaggactacttccacgatctgtactgagcgggctggcaaggcgcatagnn

SEQ ID NO: 38258 - DNA, 164 bp, Homo sapiens; identical to SEQ ID NO: 38154
  misc_feature: GYAE6OF02I47YX.35.34.D01.1.454.CMB.1.raw
  modified_base (164)..(164): a, c, t, g, unknown or other
  misc_feature (164)..(164): n is a, c, g, or t

SEQ ID NO: 38259 - DNA, 164 bp, Homo sapiens
  misc_feature: GYAE6OF02IDAHP.35.34.D01.1.454.CMB.1.raw
  modified_base (164)..(164): a, c, t, g, unknown or other
  misc_feature (164)..(164): n is a, c, g, or t
tcagtacagatcgtcacgaccggtgctcgatttagatcgtctgtgttgggtttggggtgtggtggtctccactcccgccttgacgggctgctatctgccccctcggtcactctgttcccgccctcctcacgatctgtactgagcgggctggcaaggcgcatagn

SEQ ID NO: 38260 - DNA, 174 bp, Homo sapiens; identical to SEQ ID NO: 38158
  misc_feature: GYAE6OF02INTZY.35.34.D01.1.454.CMB.1.raw
  modified_base (173)..(174): a, c, t, g, unknown or other
  misc_feature (173)..(174): n is a, c, g, or t

SEQ ID NO: 38261 - DNA, 163 bp, Homo sapiens
  misc_feature: GYAE6OF02FX960.35.34.D01.1.454.CMB.1.raw
  modified_base (163)..(163): a, c, t, g, unknown or other
  misc_feature (163)..(163): n is a, c, g, or t
tcagtacagatcgtcacgaccggtgctcgatttagatcgtctgtgttgggtttggggtgtggtggtctccactcccgccttgacgggctgctatctgcccctcggtcactctgttctcgccctcctcacgatctgtactgagcgggctggcaaggcgcatagn

SEQ ID NO: 38262 - DNA, 280 bp, Homo sapiens
  misc_feature: GYAE6OF02F660W.35.34.D01.1.454.CMB.1.raw
  modified_base (246)..(246): a, c, t, g, unknown or other
  misc_feature (246)..(246): n is a, c, g, or t
  modified_base (248)..(280): a, c, t, g, unknown or other
  misc_feature (248)..(280): n is a, c, g, or t
tcagtacagatcgtcacgaccggtgctcgatttagatcgtctgtgttgggtttggggagaggcgggtggcattttgactactggggccagggaaccctggtcaccgtctcctcagcctccaccaagggcccatcggtcttcccctggcgccctgctccaggagcacctccgagagcacagcggccctggctgcctggtcaaggctacttccacgactgtactgagcgggctggcaaggcgcatagnannnnnnnnnnnnnnnnnnnnnnnnnnnnnnnnn

SEQ ID NO: 38263 - DNA, 173 bp, Homo sapiens; identical to SEQ ID NO: 38173
  misc_feature: GYAE6OF02H7JEV.35.34.D01.1.454.CMB.1.raw
  modified_base (173)..(173): a, c, t, g, unknown or other
  misc_feature (173)..(173): n is a, c, g, or t

SEQ ID NO: 38264 - DNA, 163 bp, Homo sapiens
  misc_feature: GYAE6OF02JDY0I.35.34.D01.1.454.CMB.1.raw
  modified_base (163)..(163): a, c, t, g, unknown or other
  misc_feature (163)..(163): n is a, c, g, or t
tcagtacagatcgtcacgaccggtgctcgatttagatcgtctgtgttgggtttggggtgtggtggtctccactcccgccttgacgggctgctatctgcccctcggtcactctgttccaaccctcctcacgatctgtactgagcgggctggcaaggcgcatagn

SEQ ID NO: 38265 - DNA, 164 bp, Homo sapiens
  misc_feature: GYAE6OF02HBJQQ.35.34.D01.1.454.CMB.1.raw
  modified_base (164)..(164): a, c, t, g, unknown or other
  misc_feature (164)..(164): n is a, c, g, or t
tcagtacagatcgtcacgaccggtgctcgatttagatcgtctgtgttgggtttggggtgtggtggtctccactcccgccttgacggggctgctatctgcccctcggtcactctgttcccgccctcctcacgatctgtactgagcgggctggcaaggcgcatagn

SEQ ID NO: 38266 - DNA, 164 bp, Homo sapiens
  misc_feature: GYAE6OF02IMHKJ.35.34.D01.1.454.CMB.1.raw
  modified_base (163)..(164): a, c, t, g, unknown or other
  misc_feature (163)..(164): n is a, c, g, or t
tcagtacagatcgtcacgaccggtgctcgatttagatcgtctgtgttgggtttggggtgtggtggtctccactcccgccttgacgggctgctatctgcccctcggtcactctgttcccgccctcctcacgatctgtactgagcgggctggcaaggcgcatagnn

SEQ ID NO: 38267 - DNA, 163 bp, Homo sapiens; identical to SEQ ID NO: 38149
  misc_feature: GYAE6OF02I8V0T.35.34.D01.1.454.CMB.1.raw
  modified_base (163)..(163): a, c, t, g, unknown or other
  misc_feature (163)..(163): n is a, c, g, or t

SEQ ID NO: 38268 - DNA, 178 bp, Homo sapiens
  misc_feature: GYAE6OF02GQQOY.35.34.D01.1.454.CMB.1.raw
  modified_base (164)..(178): a, c, t, g, unknown or other
  misc_feature (164)..(178): n is a, c, g, or t
tcagtacagatcgtcacgaccggtgctcgatttagatcgtctgtgttgggtttgggggtgtggtggtctccactcccgccttgacgggctgctatctgcccctcggtcactctgttcccaccctcctcacgatctgtactgagcgggctggcaaggcgcatagnnnnnnnnnnnnnnn

SEQ ID NO: 38269 - DNA, 163 bp, Homo sapiens
  misc_feature: GYAE6OF02GV5OO.35.34.D01.1.454.CMB.1.raw
  modified_base (163)..(163): a, c, t, g, unknown or other
  misc_feature (163)..(163): n is a, c, g, or t
tcagtacagatcgtcacgaccggtgctcgatttagatcgtctgtgttgggtttggggtgtggtggtctccactcccgccttgacgggctgctatctgcccctcggtcactctgttcccgccctcctcacgatctgtactgagcgggctggcaaggcgcatagn

SEQ ID NO: 38270 - DNA, 204 bp, Homo sapiens
  misc_feature: GYAE6OF02HB3Z3.35.34.D01.1.454.CMB.1.raw
  modified_base (166)..(204): a, c, t, g, unknown or other
  misc_feature (166)..(204): n is a, c, g, or t
tcagtacagatcgtcacgaccggtgctcgatttagatcgtctgtgttggggtttgggggtgtggtggtctccgactcccgccttgaccgggctgctatctgcccctggtcactctgttcccaccctcctcacgatctgtactgagcgggctggcaaggcgcatagnnnnnnnnnnnnnnnnnnnnnnnnnnnnnnnnnnnnnnn

SEQ ID NO: 38271 - DNA, 159 bp, Homo sapiens
  misc_feature: GYAE6OF02IW5SX.35.34.D01.1.454.CMB.1.raw
  modified_base (155)..(159): a, c, t, g, unknown or other
  misc_feature (155)..(159): n is a, c, g, or t
tcagtacagatcgtcacgaccggtgctcgattagatcgtctgtgttggttggggtgtggtggtcgtcgactccgccttgacgggctgctatctgccctcggtcactctgttccgcctctcacgatctgtactgagcggctggcaaggcgcatagnnnnn

SEQ ID NO: 38272 - DNA, 169 bp, Homo sapiens
  misc_feature: GYAE6OF02I3LN5.35.34.D01.1.454.CMB.1.raw
  modified_base (165)..(169): a, c, t, g, unknown or other
  misc_feature (165)..(169): n is a, c, g, or t
tcagtacagatcgtcacgaccggtgctcgatttagatcgtctgtgttgggtttgggggtgtggtggtctccactcccgccttgacggggctgctatctgcccctcggtcactctgttcccgccctcctcacgatctgtactgagcgggctggcaaggcgcatagnnnnn

SEQ ID NO: 38273 - DNA, 165 bp, Homo sapiens
  misc_feature: GYAE6OF02IZT6T.35.34.D01.1.454.CMB.1.raw
  modified_base (165)..(165): a, c, t, g, unknown or other
  misc_feature (165)..(165): n is a, c, g, or t
tcagtacagatcgtcacgaccggtgctcgatttagatcgtctgtgttgggtttgggggtgtggtggtctccactcccgccttgacggggctgctatctgcccctcggtcactctgttcccgccctcctcacgatctgtactgagcgggctggcaaggcgcatagn

SEQ ID NO: 38274 - DNA, 193 bp, Homo sapiens
  misc_feature: GYAE6OF02FO5SX.35.34.D01.1.454.CMB.1.raw
  modified_base (166)..(193): a, c, t, g, unknown or other
  misc_feature (166)..(193): n is a, c, g, or t
tcagtacagatcgtcacgaccggtgctcgatttagatcgtctgtgttgggtttgggggtgtggtggtctcctactcccgccttgacgggtctgctatctgccccctggtcactctgttcccgccctctcacggatctgtactgagcgggctggcaaggcgcatagnnnnnnnnnnnnnnnnnnnnnnnnnnnn

SEQ ID NO: 38275 - DNA, 181 bp, Homo sapiens
  misc_feature: GYAE6OF02I8YKR.35.34.D01.1.454.CMB.1.raw
  modified_base (165)..(181): a, c, t, g, unknown or other
  misc_feature (165)..(181): n is a, c, g, or t
tcagtacagatcgtcacgaccggtgctcgatttagatcgtctgtgttgggttgggggtgtggtggtctccactcccgccttgacggggctgctatctgccccctcggtcactctgttcccaccctcctcacgatctgtactgagcgggctggcaaggcgcatagnnnnnnnnnnnnnnnnn

SEQ ID NO: 38276 - DNA, 166 bp, Homo sapiens; identical to SEQ ID NO: 38165
  misc_feature: GYAE6OF02JGY0J.35.34.D01.1.454.CMB.1.raw
  modified_base (166)..(166): a, c, t, g, unknown or other
  misc_feature (166)..(166): n is a, c, g, or t

SEQ ID NO: 38277 - DNA, 173 bp, Homo sapiens; identical to SEQ ID NO: 38173
  misc_feature: GYAE6OF02IPDBD.35.34.D01.1.454.CMB.1.raw
  modified_base (173)..(173): a, c, t, g, unknown or other
  misc_feature (173)..(173): n is a, c, g, or t

SEQ ID NO: 38278 - DNA, 200 bp, Homo sapiens
  misc_feature: GYAE6OF02IKQ04.35.34.D01.1.454.CMB.1.raw
  modified_base (169)..(200): a, c, t, g, unknown or other
  misc_feature (169)..(200): n is a, c, g, or t
tcagtacagatcgtcacgaccggtgctcgatttagatcgtctgtgttgggtttggggggtgtggtggtctccactcccgccttgacggggctgctatctgccccctcggtcactctgttcccgcccctcctcacgatctgtactggagcgggctggcaaggcgcatagnnnnnnnnnnnnnnnnnnnnnnnnnnnnnnnn

SEQ ID NO: 38279 - DNA, 247 bp, Homo sapiens
  misc_feature: GYAE6OF02FUZPJ.35.34.D01.1.454.CMB.1.raw
  modified_base (245)..(247): a, c, t, g, unknown or other
  misc_feature (245)..(247): n is a, c, g, or t
tcagtacagatcgtcacgaccggtgctcgatttagatcgtctgtgttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgcctcctcacgatctgtactgagcgggctggcaaggcgcatagnnn

SEQ ID NO: 38280 - DNA, 166 bp, Homo sapiens; identical to SEQ ID NO: 38165
  misc_feature: GYAE6OF02H81ST.35.34.D01.1.454.CMB.1.raw
  modified_base (166)..(166): a, c, t, g, unknown or other
  misc_feature (166)..(166): n is a, c, g, or t

SEQ ID NO: 38281 - DNA, 164 bp, Homo sapiens
  misc_feature: GYAE6OF02F40W9.35.34.D01.1.454.CMB.1.raw
  modified_base (164)..(164): a, c, t, g, unknown or other
  misc_feature (164)..(164): n is a, c, g, or t
tcagtacagatcgtcacgaccggtgctcgatttagatcgtctgtgttgggtttgggggtgtggtggtctccactcccgccttgacgggctgctatctgccccctcggtcactctgttcccgcctcctcacgatctgtactgagcgggctggcaaggcgcatagn

SEQ ID NO: 38282 - DNA, 191 bp, Homo sapiens
  misc_feature: GYAE6OF02I19X6.35.34.D01.1.454.CMB.1.raw
  modified_base (174)..(191): a, c, t, g, unknown or other
  misc_feature (174)..(191): n is a, c, g, or t
tcagtacagatcgtcacgaccggtgctcgatttagatcgtctgtgttgggtttgggggaagaggaagactgacggtccccccaggagttcaggtgctgggcacagcggccctgggctgcctggtcaaggactacttccacgatctgtactgagcgggctggcaaggcgcatagnnnnnnnnnnnnnnnnnn

SEQ ID NO: 38283 - DNA, 166 bp, Homo sapiens; identical to SEQ ID NO: 38153
  misc_feature: GYAE6OF02HNZTQ.35.34.D01.1.454.CMB.1.raw
  modified_base (166)..(166): a, c, t, g, unknown or other
  misc_feature (166)..(166): n is a, c, g, or t

SEQ ID NO: 38284 - DNA, 166 bp, Homo sapiens; identical to SEQ ID NO: 38153
  misc_feature: GYAE6OF02FH28I.35.34.D01.1.454.CMB.1.raw
  modified_base (166)..(166): a, c, t, g, unknown or other
  misc_feature (166)..(166): n is a, c, g, or t

SEQ ID NO: 38285 - DNA, 167 bp, Homo sapiens
  misc_feature: GYAE6OF02GLFDF.35.34.D01.1.454.CMB.1.raw
  modified_base (165)..(167): a, c, t, g, unknown or other
  misc_feature (165)..(167): n is a, c, g, or t
tcagtacagatcgtcacgaccggtgctcgatttagatcgtctgtgttgggtttgggggtgtggtggtctccactcccgccttgacggggctgctatctgcccctcggtcactctgttcccgccctcctcacgatctgtactgagcgggctggcaaggcgcatagnnn

SEQ ID NO: 38286 - DNA, 165 bp, Homo sapiens; identical to SEQ ID NO: 38161
  misc_feature: GYAE6OF02INZ7U.35.34.D01.1.454.CMB.1.raw

SEQ ID NO: 38287 - DNA, 187 bp, Homo sapiens
  misc_feature: GYAE6OF02FYVFB.35.34.D01.1.454.CMB.1.raw
  modified_base (167)..(187): a, c, t, g, unknown or other
  misc_feature (167)..(187): n is a, c, g, or t
tcagtacagatcgtcacgaccggtgctcgatttagatcgtctgtgttgggtttgggggtgtggtggtctcctactcccgccttgacgggtctgctatctgccccctggtcactctgttcccgccctcctcacggatctgtactgagcgggctggcaaggcgcatagnnnnnnnnnnnnnnnnnnnnn

SEQ ID NO: 38288 - DNA, 540 bp, Homo sapiens
  misc_feature: GYAE6OF02JX7RI.35.34.D01.1.454.CMB.1.raw
  modified_base (302)..(302): a, c, t, g, unknown or other
  misc_feature (302)..(302): n is a, c, g, or t
  modified_base (404)..(404): a, c, t, g, unknown or other
  misc_feature (404)..(404): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctctttaagatgtgtccagtgtcaggtgcagcgtgggggagtcgtgggggaggcgtggtccagcctgggaggtccctgagactctcctgtgcagcgtctggattcaccttcagtagttatggcatgcacgtgggtccnccaggcctccgaggcaagggctgggagtggtggctaggttgtgtggtatggatgggaagtaatagatactatgacagacacggtgaagggcgatcaccatcnccagacgacaatacaagactactttcgtcctagacaatgaacacgactagagacgacgaggacacgacgatatacgttacgtgtaggacgtaagaacggcgtaaggtcgggacgaccccgtaccccggagtacggg

SEQ ID NO: 38289 - DNA, 166 bp, Homo sapiens; identical to SEQ ID NO: 38165
  misc_feature: GYAE6OF02FH4I7.35.34.D01.1.454.CMB.1.raw
  modified_base (166)..(166): a, c, t, g, unknown or other
  misc_feature (166)..(166): n is a, c, g, or t

SEQ ID NO: 38290 - DNA, 550 bp, Homo sapiens
  misc_feature: GYAE6OF02HF79K.35.34.D01.1.454.CMB.1.raw
  modified_base (308)..(308): a, c, t, g, unknown or other
  misc_feature (308)..(308): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcgtggtttcctcgttgctcttttaagaggtgtccagtgtcaggtgcagcgtgggggagtcgtgggggaggcgtggtccagccgtgggaggtccctgagactctcctgtgcagcgtctggacttcaccttcgagtagttatggctatgctacgtgggtcccncaggctccgaggcgaaggggctgggagtgggtgctaggttatagtggtatgatggaagtcaataaagctatgacagactcgaggaacggcgtattacactatcctacgagacgactaataccaaacgaacacgctgtatctagacaatagaacacgtctagcgaacgccgaacgaccgacggtactagtcgttaacttcgtagtcgacgaagtacgacgtaagagtactcggtacttaacgg

SEQ ID NO: 38291 - DNA, 500 bp, Homo sapiens
  misc_feature: GYAE6OF02HLCO6.35.34.D01.1.454.CMB.1.raw
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagctgagttttcctcgttgctcttttaagaggtgtccagtgtcaggtgcagctgggggagtcgtgggggagcgtggtccagcctgggagtccctgagactctcctgtgcagcgtctggattcaccttcagtagttatggcatgcactgggtccgccaggctccaggcaaggggctggagtgggtggcagttatatggtatgatggaagtcaataaagactatgacagactccgtgaagggccgattcaccatctcagagacaattccaagaacacgctgtatctgacaaatgaacagcctagagagccgacgacacggctgtgtattacgtgtgcgagacacgtagagagtagtac

SEQ ID NO: 38292 - DNA, 543 bp, Homo sapiens
  misc_feature: GYAE6OF02HF9NO.35.34.D01.1.454.CMB.1.raw
  modified_base (377)..(377): a, c, t, g, unknown or other
  misc_feature (377)..(377): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggggagtcgtgggggaggcgtggtccagcctgggaggtccctgagactctcctgtgcagcgtctggattcaccttcagtagtcactggatgcactgggtccgtcaagttccagggagggctggtgtgggtttcacgtattacgagtgatgggactgacacaatctacgcggactccgngaagggccgattccacccctcagacgacaacgccaagaacacactatatctagacaaatgaaacagtctgagagaccgaggaccacggctgtactattacgtgtgacaaggagggtgactaacgaattcgagtttcggtttgattcgtcggtggggtaccaagggg

SEQ ID NO: 38293 - DNA, 570 bp, Homo sapiens
  misc_feature: GYAE6OF02HW42U.35.34.D01.1.454.CMB.1.raw
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcagggtgcagctgggggatcgtgggggaggcgtggtccagcctgggaggtccctgagactctcctgtgcagcgtctggattcaccttcagtagttatggcatgcactgggtccgccaggctccgaggcaaggggctgggagtggggtgctagttatagtggtatggatggaagtcaataaagactatgcagactccgtagacgggcgatcaccatctcagagacaactaccaagaacacgctagtactctagacaaagtacgaacgacgtaccgtagacggacgacccggaacgaaccgaccggtacgttcggttacggtactttactggtacgtacggagaaaccgtaacggttaacggaaggtaacgttcgggacttaacgg

SEQ ID NO: 38294 - DNA, 166 bp, Homo sapiens; identical to SEQ ID NO: 38165
  misc_feature: GYAE6OF02GUI3K.35.34.D01.1.454.CMB.1.raw
  modified_base (166)..(166): a, c, t, g, unknown or other
  misc_feature (166)..(166): n is a, c, g, or t

SEQ ID NO: 38295 - DNA, 247 bp, Homo sapiens
  misc_feature: GYAE6OF02H29OK.35.34.D01.1.454.CMB.1.raw
  modified_base (247)..(247): a, c, t, g, unknown or other
  misc_feature (247)..(247): n is a, c, g, or t
tcagtacagatcgtcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcaaagcggccctgggctgcctggtcaaggactacttcacgatctgtactgagcgggctggcaaggcgcatagn

SEQ ID NO: 38296 - DNA, 599 bp, Homo sapiens
  misc_feature: GYAE6OF02G7ZMK.35.34.D01.1.454.CMB.1.raw
tcagtacagatcgtcacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataagttgggggataaatatgcttgctggtatcagcagaagccaggcccagtcccctgtgttcggtcatctatcaagatagcaaggccggcctcgaggactcccgtgagtcgattctcgtggtcctacctaacgtcgtacgggaaaccacacgacctactctcgacctactccgacggccgggacccgaggtcctaagtcgggatggacgtcgtacgaacttattacgtcgtcgagggccggttagggactacgacgagaccgtacggtaggttacgggtacggttaccggggacgggtaaccggggtaacccgtaagggtacccgtacgggtaacccggttcccggtaacggttcccgaacgggtaacccccgg

SEQ ID NO: 38297 - DNA, 535 bp, Homo sapiens
  misc_feature: GYAE6OF02FSZQN.35.34.D01.1.454.CMB.1.raw
  modified_base (341)..(341): a, c, t, g, unknown or other
  misc_feature (341)..(341): n is a, c, g, or t
  modified_base (380)..(380): a, c, t, g, unknown or other
  misc_feature (380)..(380): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggggagtctgggggaggcgtggtccagcctgggaggtccctgagactctcctgtgcagcgtctggattcacttcagtagttatggcatgcacgtgggtcccgccaggctccaggcaaggggctgggagtgggtgctagttanatggtatggatggaagtcaataaagctatgcagactcgngaacgggcatcacatctcagagacaatccaagaacacgctagtatctagacaaatacgaacagcctagacgacgacccgaaccgacgacgggcttggtacgttattaccgttaggtcgaccgaaggtaacacggtagaggtatacggacttaacg

SEQ ID NO: 38298 - DNA, 166 bp, Homo sapiens; identical to SEQ ID NO: 38165
  misc_feature: GYAE6OF02FKBQ1.35.34.D01.1.454.CMB.1.raw
  modified_base (166)..(166): a, c, t, g, unknown or other
  misc_feature (166)..(166): n is a, c, g, or t

SEQ ID NO: 38299 - DNA, 179 bp, Homo sapiens
  misc_feature: GYAE6OF02FS7H3.35.34.D01.1.454.CMB.1.raw
  modified_base (165)..(179): a, c, t, g, unknown or other
  misc_feature (165)..(179): n is a, c, g, or t
tcagtacagatcgtcacgaccggtgctcgatttagatcgtctgtgttgggtttgggggtgtggtggtctccactcccgccttgacggggctgctatctgcccccctggtcactctgttcccaccctctcacgatctgtactgagcgggctggcaaggcgcatagnnnnnnnnnnnnnnn

SEQ ID NO: 38300 - DNA, 509 bp, Homo sapiens
  misc_feature: GYAE6OF02FSHRS.35.34.D01.1.454.CMB.1.raw
  modified_base (341)..(341): a, c, t, g, unknown or other
  misc_feature (341)..(341): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggggggagtcgtggggggaggcgtggtccagcctgggaggtccctgagactctcctgtgcagcgtctggattcaccttcagtagttatggcatgcactgggtccgccaggctccaggcaaggggctggagtgggtgcagttanatggtatgatggaagtcaataaagctatgcagacctcgtgaaggggccatcacctatctccagagactaactaccaagaacacgctgtatcagacaaatagaacagacctagacgacgaccgacgacacggctgtntatactgngcgagacagtagagatcgataacg

SEQ ID NO: 38301 - DNA, 587 bp, Homo sapiens
  misc_feature: GYAE6OF02FTJMS.35.34.D01.1.454.CMB.1.raw
  modified_base (177)..(177): a, c, t, g, unknown or other
  misc_feature (177)..(177): n is a, c, g, or t
  modified_base (569)..(569): a, c, t, g, unknown or other
  misc_feature (569)..(569): n is a, c, g, or t
tcagtacagatcgtcacgaccggtgctcgatttagatcgtctgtgttgggtttgggggggagaggagcccagcacctagaagtcggcggtgtttccattcggtgatcagcactgaacacagaggactcaccatggagtttgggctgagcgtggtttcgcgtagctctttaagaggtntccagtgtcaggtgcagcgtgggggagtcgtgggggaggcgtggtccagccgtgggagtccctgagactctcctgtgcagcgtctggattcaccttcagtagttatggcatgcacgtgggtcccgccaggctccgaggcaaggggctgggagtgggtcggctagttatagtggtatggatgggaagtcaataaaagactagtcgacagtaccgtaccggtaggaacggggtccgtaattccaaccgtacttccgtacccaagtacgaacctaaacttacccgaaagaacctacgactgtactctagacaaatcgaacagtcctagaagacgaccgtaacgaccgagcgtagtaggttacttacgtggtcgacgtaacgaacgtacggtaagnggaactggtacgttaacg

SEQ ID NO: 38302 - DNA, 538 bp, Homo sapiens
  misc_feature: GYAE6OF02JNUHV.35.34.D01.1.454.CMB.1.raw
  modified_base (282)..(282): a, c, t, g, unknown or other
  misc_feature (282)..(282): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
  modified_base (409)..(409): a, c, t, g, unknown or other
  misc_feature (409)..(409): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggggatcgtgggggagcgtggtccagcctgggaggtccctgagactctcctgtgcagcgtctggattcaccttcagtagttanggcatgcacgttcgggtccgccaggcctccgagggccaagggggctgggaggtgggtgcagttanagtggtatgatggaatcaataaagctangacagactcgtggaacggctatcacatcacaganacaactccaagacacgctagtactctagacaaagtacaacgacgctagaacgacgaccgaacgacgacgctagtacgtattaacgtggtacgacgtaagactaacggtagaggacgtaggacttaacgg

SEQ ID NO: 38303 - DNA, 790 bp, Homo sapiens
  misc_feature: GYAE6OF02IFX2K.35.34.D01.1.454.CMB.1.raw
  modified_base (152)..(152): a, c, t, g, unknown or other
  misc_feature (152)..(152): n is a, c, g, or t
  modified_base (210)..(210): a, c, t, g, unknown or other
  misc_feature (210)..(210): n is a, c, g, or t
  modified_base (315)..(315): a, c, t, g, unknown or other
  misc_feature (315)..(315): n is a, c, g, or t
tcagtacagatcgtcacgaccggtgctcgatttagatcgtctgtgttgggtttgggggggtaggagggagcccgagcactagaagtcggcggtgtttccattcggtgatcagcactgaacacagaggactcaccatggagtttgggctgagntgggttttcctcgttgctcttttaagaggttgtccagtgtcaggtgcagcgtgggggntcgtgggggaggcgtgggtccagtccgtgggacggtcccgtgagactcgtcctgtgcagcgtctggattcacttcagtagttactggcatgctacgtcgggtccncaggcctccaagggctaagggggcttggggacggtcgggtagggtccaggtttatagtggttaagttggaaacgttggaaaggttaccgtaaattaaaaacggaccgttagtaaggacccgtaaggtaaccggttacccgggtaggtaaacggggtcccctaagtttccaacccgttactccgttacccgaagtaaacggtaccctaaacgtttacccgaaaggtaacctacgggtaccttaggttaaccgtacccgttaaggacccgtaaaattaccggaaaccgaacgggttaccccgtaggaaccgaaccgggtacccccggaaacgggaacccgttaccggggaccgtttaagggtttaccgtttaaacgtttaccggttagggttaccgggtaacccgttaaaggttaaaccccgggtaccgggttaaaggaacggtacgggtttaaccgtaacccggttttaaaccggg

SEQ ID NO: 38304 - DNA, 165 bp, Homo sapiens; identical to SEQ ID NO: 38176
  misc_feature: GYAE6OF02GJO7K.35.34.D01.1.454.CMB.1.raw

SEQ ID NO: 38305 - DNA, 557 bp, Homo sapiens
  misc_feature: GYAE6OF02H0EQ8.35.34.D01.1.454.CMB.1.raw
  modified_base (405)..(405): a, c, t, g, unknown or other
  misc_feature (405)..(405): n is a, c, g, or t
  modified_base (509)..(509): a, c, t, g, unknown or other
  misc_feature (509)..(509): n is a, c, g, or t
  modified_base (531)..(531): a, c, t, g, unknown or other
  misc_feature (531)..(531): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagcgtgggggagtcgtgggggaggcgtggtccagcctgggaggtccctgagactctcctgtgcagcgtctggattcaccttcagtagcactggatgcactgggtccgtcaagttccgaagggaagggctggtgttgggttcacgtattacgagtgatgggactgacacatctacgcggactccgtagacggcgacttcgaccccctcacganacaacgaccaaagaacaacaactaacatcctagacaaatagaaactagtctagagacgaccgaggaccgaacggcctgtactattaactgtagacgaagtaggnggtactacaatcatttaggttntatccgtgtacgggaccgtaaacggg

SEQ ID NO: 38306 - DNA, 166 bp, Homo sapiens; identical to SEQ ID NO: 38165
  misc_feature: GYAE6OF02G2HG8.35.34.D01.1.454.CMB.1.raw
  modified_base (166)..(166): a, c, t, g, unknown or other
  misc_feature (166)..(166): n is a, c, g, or t

SEQ ID NO: 38307 - DNA, 642 bp, Homo sapiens
  misc_feature: GYAE6OF02HA6EH.35.34.D01.1.454.CMB.1.raw
  modified_base (283)..(283): a, c, t, g, unknown or other
  misc_feature (283)..(283): n is a, c, g, or t
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtgggggagtcgtgggggagcgtggtccagccgtgggacgtccctgagactctcctgtgcagcgtctggattcacttcagtagttanggctagtgactacgtcgggtcccgcgacggcctaccgagggcgaagggggctggggaggtggggtgctaaggtttatagtggtatggaagtgggaatctaaagtaaaagactagtcgactagaccgtcggtagggaacgggtccgtagtttaccaaccgtattaccgtacccgaagtaacgtaactaaaccttaccgaaaacgtaaaccgaccggtaccgtaagttaacttcgtagtaaaccaaagtacgaaacgacgtccgtagaacgacgaccgaacgaccgacggtctaggtacgttacgttaacgtcggtacgaccgaagaaactacggtaagacggagttacggtacttaacgg

SEQ ID NO: 38308 - DNA, 213 bp, Homo sapiens
  misc_feature: GYAE6OF02IN0FY.35.34.D01.1.454.CMB.1.raw
  modified_base (213)..(213): a, c, t, g, unknown or other
  misc_feature (213)..(213): n is a, c, g, or t
tcagtacagatcgtcacgaccggtgctcgatttagatcgtctgtgttgggtttggggtgttgggtttggggggaagaggaagactgacggtcccatcggtcttccccctggcaccctcctccaagagcacctctgggggcacagcggccctgggctgcctggtcaaggactacttccacgatctgtactgagcgggctggcaaggcgcatagn

SEQ ID NO: 38309 - DNA, 165 bp, Homo sapiens; identical to SEQ ID NO: 38161
  misc_feature: GYAE6OF02GFB9F.35.34.D01.1.454.CMB.1.raw

SEQ ID NO: 38310 - DNA, 607 bp, Homo sapiens
  misc_feature: GYAE6OF02H5BAJ.35.34.D01.1.454.CMB.1.raw
  modified_base (399)..(399): a, c, t, g, unknown or other
  misc_feature (399)..(399): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagttttgggctgagcttgggttttcctcgttgcttctttttaagaggtgtccagtgtcaggtgcagcgtgggggagtcgtggggggaggcgtggtccagccgtggggaggtccctgagactctccgtgtgcagcgtctggattcaccttcagttagttatggctatgacacgttcgggcccgccaggcctccgagggcgaaggggctagggaggtggggtgctaggttatagtggtatgtagtgggaagtcaagtaaagacttangcagaccgtcggtaggaacggcctacttcacctatctaccagaacgactaacttaccgaaagaaccgtacgtcttagtactactacgacaaagtacgaaccgacgaccgtagacgaacgacccggaaccgacgacggtctaggttacgttaacttaccgtaggtacgacgtaacgtaacgacggtaagacgtagtaccggtattaacg

SEQ ID NO: 38311 - DNA, 167 bp, Homo sapiens; identical to SEQ ID NO: 38155
  misc_feature: GYAE6OF02FR0IB.35.34.D01.1.454.CMB.1.raw
  modified_base (166)..(167): a, c, t, g, unknown or other
  misc_feature (166)..(167): n is a, c, g, or t

SEQ ID NO: 38312 - DNA, 685 bp, Homo sapiens
  misc_feature: GYAE6OF02JTWSA.35.34.D01.1.454.CMB.1.raw
  modified_base (355)..(355): a, c, t, g, unknown or other
  misc_feature (355)..(355): n is a, c, g, or t
tcagtacagatcgtcacgaccggtgctcgatttagatcgtctgtgttgggtttgggggggagaggagcccagcactagaggtcggcggtgtttccattcggtgatcagcactgaacacagaggactcaccatgggagtttgggctgagctgggttttcctcgttgctcttttaagaggtgtccagtgtcaggtgcagcgtgggggagtcgtggggggaggcgtggtccaggccgtgggaggtccctgagctctcctgtgcagcgtcgtggacttccaccttcagagtacttatttcatcgacctggactcccgcagacctccgaaggggaacggactgggtacgtcgggtcctanacacatcagacaagtacgtggacaactcccaagtcgtacctacgcaacgtctacgtggtacggaacgggtcctaacttaccgtaacgttaacgttttaacgggaaccgtaaccggtacccggtaacggggttaccgtacgttacggttacgtacgtacgaactaaacgtacgtaaacgacggtaccgtaggtaacggtacggttaaccggaacgggtaaccgaaccggtaccgtacgttacgttactttaacggtgtacggtaacgtaaggtacgttcgtagggttaaggttcgggtaggtcgtttacgggtttaggttccggtaaccgg

SEQ ID NO: 38313 - DNA, 596 bp, Homo sapiens
  misc_feature: GYAE6OF02FHKFH.35.34.D01.1.454.CMB.1.raw
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (484)..(484): a, c, t, g, unknown or other
  misc_feature (484)..(484): n is a, c, g, or t
  modified_base (511)..(511): a, c, t, g, unknown or other
  misc_feature (511)..(511): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtgggggagtcgtgggggaggcggtggtccagccgtgggacggtccctgagactctctgtgcagcgtctggattccaccttcagtagtttanggcatgcacgtgggtccncgacgctccgaggcgaaggggctggagtggggtgctagttatgtggtatgatggaagtcaataaagatagtgacagacgtaccggtaggaacgggtccgtaattcaaccgacttcctaccgaagtaacgaactaacttaccgaaagtaacctacgacttagtactactacggtaanaaagttacgaacacgtacctaggaacnccggaccgacgtaaccgacgtcgttaggtacgttaattacgtgacgtacgaaggaactacggtagaacgtacgtggacttaacgg

SEQ ID NO: 38314 - DNA, 165 bp, Homo sapiens
  misc_feature: GYAE6OF02H6KPL.35.34.D01.1.454.CMB.1.raw
  modified_base (165)..(165): a, c, t, g, unknown or other
  misc_feature (165)..(165): n is a, c, g, or t
tcagtacagatcgtcacgaccggtgctcgatttagatcgtctgtgttgggtttgggggtgtggtggtctccactcccgccttgacggggctgctatctgcccctcggtcactctgttcccaccctcctcacgatctgtactgagcgggctggcaaggcgcatagn

SEQ ID NO: 38315 - DNA, 174 bp, Homo sapiens
  misc_feature: GYAE6OF02I2ZZO.35.34.D01.1.454.CMB.1.raw
tcagtacagatcgtcacgaccggtgctcgatttagatcgtctgtgttgggtttgggggaagaggaagactgacggtccccccaggagttcaggtgctgggcacagcggccctgggctgccctggtcaaggactacttccacgatctgtactgagcgggctggcaaggcgcatag

SEQ ID NO: 38316 - DNA, 775 bp, Homo sapiens
  misc_feature: GYAE6OF02HC2I2.35.34.D01.1.454.CMB.1.raw
  modified_base (730)..(730): a, c, t, g, unknown or other
  misc_feature (730)..(730): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcacagtggagtttgggctgagtcgttgggttttcctcgttgtcttacgttttaaggaggttcgtacctaggttgtcgagggtgcgaggtcggtgggggtagttcggtggggggagtcggtcggtccgacggtccggtggggtaccggtcccgtaggacgtaccgttccttccgtggtcgacgaggtccgttcgtggtacttccgtaccgtttacgtagttacgttagtggtacctagtcgaccgtaccggtcgggtaccccgccgacggtccgtaccggaggaccggtaaggggtcggtaggggtacggttggggtggtaccgtaaggttagtaggttaggtagtagtaggtaggtaacgtacgtaaaagtaaagtacgttaagacgtacgtacggtaccgtaccggtaagggaaccggtaccgttacgtaccaaccgtacttacccgacgtaaacgtaacgtaaactaaccgtaaccaaaacggtaaccgtactacgtagttactacgtacgtaacgtaaacgttacgaaacgtacgaccgtagggaacgtaccggaaccgaccggaacgtaccggtacgttcggtacgtttagtacgtacgngtaaccggaagtaacgtaggtagacggtagtacgtacgttaaacg

SEQ ID NO: 38317 - DNA, 605 bp, Homo sapiens
  misc_feature: GYAE6OF02FQ0BM.35.34.D01.1.454.CMB.1.raw
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtgggggagtcgtgggggaggcgtggtccagcctggggacggtccctgacgactctcctgtgcagcgtntggattcacttcagtagttanggcatcgcacgttcggggtcccgccgaggcctccgagggccgaagggggctgggaggtggggtggctaggtttatagtggtatggagtgggaatcgaaagtaaaacgacgtatggactaaggtaccgtccggtaggaacgggccgtacttaccaccactcctaccgagacgaacaacttaccaaagaacacgtactagtactactacgaactaaagtcgaaacgacgtaccgtagacgacgaccgaacgaccgacggtctgtacgttaactacgtggtacgacgaacgaaccgtacgtagacgtagtacggactaacg

SEQ ID NO: 38318 - DNA, 656 bp, Homo sapiens
  misc_feature: GYAE6OF02HLQ75.35.34.D01.1.454.CMB.1.raw
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (613)..(613): a, c, t, g, unknown or other
  misc_feature (613)..(613): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcgtggtttcgcgttgctctttaagaggtgtccagtgtcaggtgcagcgtggggagtcgtgggggagcggtggtccagtccgtgggacggtccctggagactctccgtgtgcagcgtctggacttccacctttnagttagtagtcgnatgcacgtgggcccncgaggcctcgaggcgaagggtctgggagtgggtgcgtagtttacagtggtaactggtaactgggaaatcgtaaataaaaccggtcttagtcggacaaacggtccgtaccggttagggaaccggggaccttaacttaccgaacctaacgttcctaccgtaaaggaacgaaactaaacgttaaccgaaacgaaaccgttaaccgcttaagttacctatcggaaacttaaaagcggaaaacctcgtaccgttaacgacgtaaccggcccaaaccgttacgacggtcctaggttccgtaatttaccggngacggtaaccgaagacgtaggtagagtacgtacggtactaacg

SEQ ID NO: 38319 - DNA, 553 bp, Homo sapiens
  misc_feature: GYAE6OF02F7ZTW.35.34.D01.1.454.CMB.1.raw
  modified_base (346)..(346): a, c, t, g, unknown or other
  misc_feature (346)..(346): n is a, c, g, or t
tcagtacagatcgtcacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatccacctgctctggagataaggttggggaataaatatgtcttgttggtatcgagcagaacgccgaggccacgtccccgtgttgttggtcatctatcaagatagcaagccgcctcgaggactcccgtgacgcattcncgtggctacaactctaggaaccacacgcctactcagaccataccgagtccggaacctagacttaggtcgatggacgtctacgaacttattacgtgtccgtaggcgtaggacagtcgagtccaagttcgtaggttacgtccggggacggtacgggaaccctacggtcgtacggcccgttaccgtaggtcccgtaaggcccgtaacggg

SEQ ID NO: 38320 - DNA, 260 bp, Homo sapiens
  misc_feature: GYAE6OF02H00I5.35.34.D01.1.454.CMB.1.raw
  modified_base (242)..(242): a, c, t, g, unknown or other
  misc_feature (242)..(242): n is a, c, g, or t
  modified_base (248)..(260): a, c, t, g, unknown or other
  misc_feature (248)..(260): n is a, c, g, or t
tcagtacagatcgtcacgaccggtgctcgatttagatcgtctgtgttgggtttggggggtgtggtggtctccactcccgccttgacggggctgactattactgtcagtcttatgatggtagcaagtatgtggtcttcggcggaggaccaagctgaccgtcctaggtcagcccaagactcgccccctcggtcactctcgttcccgcctcctcacgatctgtactgagcgggctggcaagggcncatagnnnnnnnnnnnnn

SEQ ID NO: 38321 - DNA, 572 bp, Homo sapiens
  misc_feature: GYAE6OF02HC9O5.35.34.D01.1.454.CMB.1.raw
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtncagctgggggatcgtgggggagcgtggtccagcctgggacgtccctgagactctcctgtgcagcgtctggattcaccttcagtagttanggcatgcacgtgggtccnccaggcctccaggcgaaggggctgggaggtgggtgctagttatatggatgatgggatnaataagctatgacagtctccggtagaacgggccgtatcaccgatcaccagacgactaactccaaagaccacgtctagtactctacgaacaaagtacgaacgacgtccgtaggaacgtaccggaccccggaagaccgaccgggtcttaggttacggttacttacgtgtacgacgaagtaaacccgtaggtaagacggtacggtagtacgttaacg

SEQ ID NO: 38322 - DNA, 626 bp, Homo sapiens
  misc_feature: GYAE6OF02JAL3Y.35.34.D01.1.454.CMB.1.raw
tcagtacagatcgtcacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataagttgggggataaatatgcttgctggtatcagcagaagccaggccacgtcccctgtgttggtcagtctatcaagatagcaagccgcctcgagggactcccgtgacgcgtacttctcgtggcctcctaacgtcgtacgggaacacgacgaccctactctacgacctactccgaacggccgggaaccccagggtaccttaagtacgggtagtacggacggacgttacgacttaacgttaccgttcggtacgacgggtacgggttacgggaacctagggaccaaggtccgaaccgttgggttaccgggttaacggtttaccggggacggggtaaccgggtaccgtaacggtccggttacggtaaccccgttccggttaacggtaccgtaccggtaaccccgg

SEQ ID NO: 38323 - DNA, 742 bp, Homo sapiens
  misc_feature: GYAE6OF02FTR61.35.34.D01.1.454.CMB.1.raw
tcagtacagatcgtcacgaccggtgctcgatttagatcgtctgtgttgggtttgggagggctttgttggagaccttgcacttgtactccttgccattcagccagtcctggtgcaggacggtgaggacgctgaccacacggtacgtgctgttgtactgctcctccggtgtttccattcggtgatcagcactgaacacagaggactcaccatggtagtttgggctgagtcttgggttttcctcgttgcttcttttaaggaggttgtccagtgtcaggtgcagcgtgggggagtggtgggggaggcgtgggtccaggtccgtggggacggtcccgtggacggaccttccgtcccgttggtcgacgacggtccgttcgtcgggtacttccgtaccgtttcgaaggtttaggtttagttcgggactagtcggtcctaaccggttggggtccccgccgtaggggcccttacccggagggtaccgaaagggggtccgtagggggtacgggttgggggtccgggtacgtacggttttaagtacgtttagggttaacgttgggtagttacggggaaagttaccgtaaagtaaaacggtacgttaagttcggaactaacggtaccgttaccgggtaacgggaaacggggtcctaccgttaccgaacccgttaaggtcccttaacccggaaggtaaccgtaaccgttaaacttacccggaaaacgtaaccgtaccggtacttacgggttaacc

SEQ ID NO: 38324 - DNA, 604 bp, Homo sapiens
  misc_feature: GYAE6OF02F43O1.35.34.D01.1.454.CMB.1.raw
  modified_base (208)..(208): a, c, t, g, unknown or other
  misc_feature (208)..(208): n is a, c, g, or t
  modified_base (446)..(446): a, c, t, g, unknown or other
  misc_feature (446)..(446): n is a, c, g, or t
tcagtacagatcgtcacgaccggtgctcgatttagatcgtctgtgttggggtttgggggggagaggagcccagcactagaagtcggcggtgtttccattcggtgatcagcactgaacacagaggactcaccatgggagtttgggctgagctgggttttcctcgttgcttcttttaagaggtgtccagtgtcaggtgcagcgtgggggntcgtagggggaggcgtggtccagccgtgggacggtccctgacgtacctctcctgtgcagcgtctggtacttcgtaccttcaagttagtttatgggcctaagtcgactacggtcgggtcccgccgaggcctccgaggaccggaaggggcttagggaggtggggtcggctagttaatgtggtatgagtgggaatcaataaaagctagtgacacgacgtccggaagacgggctatacgacncgttcactagaacgaactaactaccaaagacacgtacgtatactctagaacaatacgaactagccgtaagacgacgaccgaacgtacgccgatagttacgtacttacggtgtaccgaggaaccgtaacgtacgtaaggaatcggttaagccgttaaag

SEQ ID NO: 38325 - DNA, 552 bp, Homo sapiens
  misc_feature: GYAE6OF02IRWXI.35.34.D01.1.454.CMB.1.raw
  modified_base (261)..(261): a, c, t, g, unknown or other
  misc_feature (261)..(261): n is a, c, g, or t
  modified_base (341)..(341): a, c, t, g, unknown or other
  misc_feature (341)..(341): n is a, c, g, or t
  modified_base (417)..(417): a, c, t, g, unknown or other
  misc_feature (417)..(417): n is a, c, g, or t
tcagtacagatcgtcacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaggttgggggataaatatgcttgctggtatcagnagagcaggccagtccctgtgttggtcatctatcaagatagacaagccggcctacgaggactcccgtggacgcgtatttcncgtcggcctaccaactcgtacgggacacgacgccactctacgaccatcaggccggacccaggctagtgagtgacgntgtactattactgtacgaggcgtaggacgagcgagcgtacgttggttacggtcggttaccgggacgggaacgggtaaccgaaggtcccggtacggtacccggttaccggtacggttaccgaccggtaaccccggg

SEQ ID NO: 38326 - DNA, 585 bp, Homo sapiens
  misc_feature: GYAE6OF02FG31J.35.34.D01.1.454.CMB.1.raw
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (417)..(417): a, c, t, g, unknown or other
  misc_feature (417)..(417): n is a, c, g, or t
  modified_base (443)..(443): a, c, t, g, unknown or other
  misc_feature (443)..(443): n is a, c, g, or t
tcagtacagatcgtcacgaccggtgctcgatttagatcgtctgtgtttgggtttgggggggagaggagcccagcactagaagtcggcggtgtttccattcggtgatcagcactgaacacagaggactcaccatggagtttgggctgagctgggtttttcctcgttgcccttttaagaggtgtccagtgtcaggtgcagcgtgggggagtcgtgggggaggcgtggtccagccgtgggaggtccctgagacctctcctgtgcacgcctctggattcacctttagcactatgcatgagcgtgggtccgcgggctccgaggggagggctggaggtgggtctacgaatgttgagttggtagtgctcanaacactatggtaacnagtacctccggtggacgggggtccgttacacctatccncgagagaacctactccgaacgaaacncgactgtactactaacaaagtgactacgtctgaggtacgaccgaggaccaccggtcctttaagtacttacgttgtacgacgaaagtactaagtactaccgtacgttaattactcgttacgcgtttaccggagtaactttaag

SEQ ID NO: 38327 - DNA, 650 bp, Homo sapiens
  misc_feature: GYAE6OF02JGHWD.35.34.D01.1.454.CMB.1.raw
  modified_base (259)..(259): a, c, t, g, unknown or other
  misc_feature (259)..(259): n is a, c, g, or t
tcagtacagatcgtcacgaccggtgctcgatttagatcgtctgtgttgggtttgggagggctttgttggagaccttgcacttgtactccttgccattcagccagtcctggtgcaggacggtgaggacgctgaccacacggtacgtgctgttgtactgctcctccggtgtttccattcggtgatcagcactgaacacagaggactcaccatggagtttgggctgagtcttgggttttcctcgttgtcttacgttttaagnggtcgtccagtgtcgaggtgcagcggtggggggagtcggtggggggaggcggtggtccgaggtccggtggggacggtcccgtaggacgtacctccgtccgtggcgcaggtccgtcgtggtacttccgtaccttgagttagtttagtcggactagtcgcgtacggttcgggtcccgcgtagggccctaccggagggaccgaagggggtccttaggggtagggttcggggtgacgttaagtttagtaggttggttaagtgagttagggtaagtctaaagtaaacgtctagtcggagtacggtaaccgttcggaggtaacgggtcctattaccgacgttcacggttaccaaggaccgtaactaacgttaccgaaataccgacgtacttaggtac

SEQ ID NO: 38328 - DNA, 980 bp, Homo sapiens
  misc_feature: GYAE6OF02JKA6V.35.34.D01.1.454.CMB.1.raw
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagtctgggttttcctgttgcttcttttaagaggtgtccagtgtcaggtgcagcgtgggggatcgtgggggagcgtggtcccaggccgtggggacggtcccctggacgaccgttcctcctggtcgcgacgtcgttcgtgggtacttccacctttcgaaggttaagttagtcggtacctaattcggcctaaccgttggggtccccgaccgaggggtccctacccgaaggggccgtaaaagggggggtccttaggggggtaacgggtttcggggggttacgggacccgttaaaggggttttaacttacgggttagggggttaaacgttggggtaaaacggtttgggggtaaaaaccggtttaccgtaaaaaggttaaaaaaaaccggggttaccctttaaaaggttccgggtaacccggttaaaacggtaaccccgtttaccccgggggttaaagggaaacccgggggggtaccccgttaaaccgttttaccccgaaaccccgttaacgttaccccgttaaacccgaaagggtaaaccgtaaaacccgttaaaaccgtttaaccccgaaaaaccggtaaaaccgtaccccgggtacgttaacggttaaaccgttaaccgtacggttaaaaccttaaaacggttaacggtaaaacccgtaacgggtaccccggttaaggaaaccggttaaccggaacccggtaaaccggtaaccgtacccggggttacgtttacgggttaggtttaacccgtttaaacggttggtaaccggtaaccggtaacggtaaacccggttaacgggttaagaacggtaacggttaccgggtacctttaaaaccgg

SEQ ID NO: 38329 - DNA, 584 bp, Homo sapiens
  misc_feature: GYAE6OF02GE1XK.35.34.D01.1.454.CMB.1.raw
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (487)..(487): a, c, t, g, unknown or other
  misc_feature (487)..(487): n is a, c, g, or t
tcagtacagatcgtcacgaccggtgctcgatttagatcgtctgtgttggggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtgggggatcgtgggggaggcgtggtccagccgtgggaggtccctgagactcgtcctgtgcagcgtctggattcaccttcagtagttanggcatcgcacgtgggtccnccaggcctccgaggcgaaggggctagggaggtggggtggactaggttatagtggtatgagtaggaagtcaagtaaaagctagtgcaagtacctaccgtaggaacggccgtaactacaccactacctacctaagacgaactaacgttaccaaacgaacacgctagtactctagacaaagtanaacgacgctagacgacgaccgaacgacgtacgcgtaggtagttagtacgttggtacgacgaacgaacgacgtaaggaggtacgtacggtacttaacg

SEQ ID NO: 38330 - DNA, 789 bp, Homo sapiens
  misc_feature: GYAE6OF02GC8LK.35.34.D01.1.454.CMB.1.raw
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
tcagtacagatcgtcacgaccggtgctcgatttagatcgtctgtgtttgggtttgggggggtaggagggagcccgagcactagaagtcggcggtgtttccattcggtgatcagcactgaacacagaggactcaccatggagtttgggctgagcgtgggtttttcctcgttgcttctttttaagaggttgtccagtgcaggtgcagcgtgggggatcgtgggggagcgtggtaccaggccgtgggacgtccctaggagccttctccgtgtgacgagtcgtcgtggacttccgacctttcgagttaagtttncggctagtgcgtacgtcgggtccgccgtaggccttaccgnggtaccgaagggggtctacggggaaggttcggggtaggtccttaaggtttaataagggtggtttaattagggaccgttaggggtaaagtaccgtaaagtttaaaacggaacttaagttcgggaacttaacggggtaacccttttcccgggaaaggggtaaccgggtaccccggtaaatttaccccgaaaccgtaacgttcccgttaacccgaaagttaccggaaaccgttaaacttacccggaaaagaaaccgaccgttacgttaccggttaaactccgtttaggaaacccttaaaaagtcgggaaacctacggttaccgaaggaaccgaacccgggtcgaaaccggacgaaccggttcgttacggttaacgttacgttaaccgtggttaccgaacggtaaacgacgtaacggaagtaccgtaagtggaaccttaacgg

SEQ ID NO: 38331 - DNA, 177 bp, Homo sapiens
  misc_feature: GYAE6OF02G368R.35.34.D01.1.454.CMB.1.raw
  modified_base (174)..(177): a, c, t, g, unknown or other
  misc_feature (174)..(177): n is a, c, g, or t
tcagtacagatcgtcacgaccggtgctcgatttagatcgtctgtgttgggtttggggggaagaggaagactgacggtcccccaggagttcaggtgctgggcacagcggccctgggctgcctggtcaaggactacttccacgatctgtactgagcgggctggcaaggcgcatagnnnn

SEQ ID NO: 38332 - DNA, 677 bp, Homo sapiens
  misc_feature: GYAE6OF02G7JV2.35.34.D01.1.454.CMB.1.raw
  modified_base (272)..(272): a, c, t, g, unknown or other
  misc_feature (272)..(272): n is a, c, g, or t
tcagtacagatcgtcacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtcccccgaggacagacagccagcactcacctgctctggagataagggtggggaataaatagtagtcttgctaggtatcgagngagaacgcctaggaccctagtcccctggtgttgtcctatctagtacaagtatagacaacggccgaccctcggaacggtacctcccgtaggacgtacggtattaccgtcggttcgtacctaacccgtaacgtcccgttaacgggaacctaacgaccgtccctaccgtaccgtaacggaccctacgtaccgacgggtacccgggaacccgtaggtacgttagtaggacgttcgaacggtctaagttaacgttacgttaccgttacggtacgtacgggtacgtaggtaaccgagtacccggacgtacgtacggttggttaccggttacgggacggaccgggggtaacggtaacgacggttaccgtaccggtacccgttacggtacggtacccgtacccggtacccggg

SEQ ID NO: 38333 - DNA, 780 bp, Homo sapiens
  misc_feature: GYAE6OF02FVHBW.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtgcagtcgtgggggcgcgtggtccagccgtgggacgtccctgagactctccgtgtgacgcctcgtggtacttcctccttacaacgtaaacttgtacggctagtcggcctaacggttcggggtcccgaccgacgggtacctcccggagggaccggtaagggggccgtaggggacggttgggggtcggaccgtaagggttggtaaacttagttaccgttaagtttttacgggaagtttaacggggggtaaaatttaaaaacgtttaaaaccgtacggttttaacccggaccgtaaaggttaccccggtccggttaaacgggggtaaccggggtacccgtttaacgttaccccgaaaccgttacttacccgtaaccgaaggtaaccgtaaacttaaaccttaacccggaaacgtaaccctaccgttacgtttacgtaccttccgtacgactaactacgtaacgtaacgtacggttacggtaaccgggtacgtacgggaacgaccggtcggtactacgttccttaagttacgtggtacgacggtaggtacgtaactaaggtaacttcggttacgtacgtacgg

SEQ ID NO: 38334 - DNA, 753 bp, Homo sapiens
  misc_feature: GYAE6OF02JOG61.35.34.D01.1.454.CMB.1.raw
  modified_base (158)..(158): a, c, t, g, unknown or other
  misc_feature (158)..(158): n is a, c, g, or t
  modified_base (178)..(178): a, c, t, g, unknown or other
  misc_feature (178)..(178): n is a, c, g, or t
  modified_base (192)..(192): a, c, t, g, unknown or other
  misc_feature (192)..(192): n is a, c, g, or t
  modified_base (436)..(436): a, c, t, g, unknown or other
  misc_feature (436)..(436): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggtttccncgttgctcttttaagaggtntccagtgtcaggtncagcgtggggatcgtgggggacgcgtcggtccaggccgtagggaactcccgtagagaccttccgtcctggtgacctaggtccgtcgttggtactttacccgtaacctttcgaggttaagtttactggaccaattggaccgtacgttccgggtacccgccaggtccctaccgaagggccgtaaggggtctaggggtacgtgggtcgacgttaagttagtctgggtaatggtaacttaggaacgtntaaacgtaagtaccttagcgaacgtacgacgtcggtaaggaccgtcgtcttacgactacgtaccgtacgaaacggttaacaacgttaacgttaacccgaaaggtacccgtaagtaccgttagtttaactaccgtaaggaaacttaacgtaacggaacccgtacgttaacctacgggaacgtaacccggaccccggttaaaggacccggtaccgggttaacgttcggttaaccgtttaaaccggtttacgtaacggggttacaacggtaaaccgttaaccgaggttaaacgtaacggtacgtaccggtaagtttaacg

SEQ ID NO: 38335 - DNA, 613 bp, Homo sapiens
  misc_feature: GYAE6OF02FPPQS.35.34.D01.1.454.CMB.1.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (388)..(388): a, c, t, g, unknown or other
  misc_feature (388)..(388): n is a, c, g, or t
  modified_base (555)..(555): a, c, t, g, unknown or other
  misc_feature (555)..(555): n is a, c, g, or t
tcagtacagatcgtcacgaccggtgctcgatttagatcgtctgtgttggggtttgggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagcgtgggggagtcgtggggggagcggtggtccagccgtgggacggtccctgagactctcctgtgcagcgtctggtattcaccttcagtagttanggcatgcacgtgggtcccnccgaggtcctaccgaggaccgaacggggtctaggggagtggggtgacgtagttatagtggtatgagttggaactanaagtaaaagtactagtgacgaagtaccgtcggtaaggaacggggcctacttaccgacctaacgtccctaccgaagacggtaactaacttaccgaaacgaacgaccgtcgttatacttctacgaacaaagtacgacgacgtcgtaggacgacgaccgaacgacgcgtntagtacgtagttctggtacacgtacgaacgtcggtaacgagtacgtaggtactaacgg

SEQ ID NO: 38336 - DNA, 254 bp, Homo sapiens
  misc_feature: GYAE6OF02G44YM.35.34.D01.1.454.CMB.1.raw
  modified_base (241)..(241): a, c, t, g, unknown or other
  misc_feature (241)..(241): n is a, c, g, or t
  modified_base (246)..(254): a, c, t, g, unknown or other
  misc_feature (246)..(254): n is a, c, g, or t
tcagtacagatcgtcacgaccggtgctcgatttagatcgtctgtgttgggtttgggagaggcgggtggcattttgactactggggccagggaaccctggtcaccgtctcctcagcctccaccaaggcccatcggtcttcccctggcgccctgctccaggagcacctccgagagcacagcggccctgggctgcctggtcaaggactacttccacgatctgtactgagcgggctggcaaggcnatagnnnnnnnnn

SEQ ID NO: 38337 - DNA, 173 bp, Homo sapiens
  misc_feature: GYAE6OF02F0JJM.35.34.D01.1.454.CMB.1.raw
  modified_base (166)..(173): a, c, t, g, unknown or other
  misc_feature (166)..(173): n is a, c, g, or t
tcagtacagatcgtcacgaccggtgctcgatttagatcgtctgtgttgggtttgggggtgtggtggtctccactcccgccttgacggggctgctatctgccccctcggtcactctgttcccgccctcctcacgatctgtactgagcgggctggcaaggcgcatagnnnnnnnn

SEQ ID NO: 38338 - DNA, 723 bp, Homo sapiens
  misc_feature: GYAE6OF02HD17C.35.34.D01.1.454.CMB.1.raw
  modified_base (261)..(261): a, c, t, g, unknown or other
  misc_feature (261)..(261): n is a, c, g, or t
tcagtacagatcgtcacgaccggtgctcgatttagatcgtctgtgttgggtttgggagggctttgttggagaccttgcacttgtactccttgccattcagccagtcctggtgcaggacggtgaggacgctgaccacacggtacgtgctgttgtactgctcctcccggtgtttccattcggtgatcagcactgaacacagagactcacagtggagtttgggctgagtcttgggttttcctacgttgcttacgttttaaaggnggttgtccgtagtcgtcgaggtcgcgtaggtcggtagggggagttcgggtaggggggacgtcggtcggtaccgacggtccggtagggggaccggttcccgtaggaccgtaccgttcgtccgtggtcgcgtaggtcgttacgtggtaccttaccaccgtttcgaaggtttacgtttagtggtacagttcgacgtacggttcgggaccctacggacggtaccgtaccggacgggtaacggtaagggggtccgttaggggaggttcggggagtacgttaaggtttaacgtggttagtacggtaggtaaggttaacggtaacggtaactaaaggtaaacgtgtaacgtcgacgaacgtcggtacgtaacgggacgtcccgtagtacctaccgtaagttcccgaacgaacgtaaccgtaaccgttaacgttaacccgaaagtacctaacccggtatttagtaacccg

SEQ ID NO: 38339 - DNA, 735 bp, Homo sapiens
  misc_feature: GYAE6OF02G1IR3.35.34.D01.1.454.CMB.1.raw
  modified_base (282)..(282): a, c, t, g, unknown or other
  misc_feature (282)..(282): n is a, c, g, or t
  modified_base (312)..(312): a, c, t, g, unknown or other
  misc_feature (312)..(312): n is a, c, g, or t
  modified_base (351)..(351): a, c, t, g, unknown or other
  misc_feature (351)..(351): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtgggggagtcgtgggggaggcgtggtccagccgtgggacggtccctgacgactctcctgtgcagcgtctggacttccaccttnagttattatgtcatgctacgtcgggtcccnccgaggcctaccgaggcgaaggggtctgggaggtggggnggcgtaggtttgtggtggtatggaagttagggaaagttaagtagtacttaacgtagtcgacgaacggtaccgtaccgggtaggaaccggggtacccgtaactttacccgaaccctacttacccgtaccgtaaacgaacgtaacctaaaccttaacccgtaaaaccgttaaacctttaccgttttacgttacccgtacgtaaacctaaaagttaacgaaaccgtaccgtaccgttaacggaacggtaaccgggaaccggaacggtaacccgaacgggtacgtaattacgttaacgtttaacggtcggtaacggaacggaaggtaacggacgtaacgggtacgggtaacccgtacccccggtaaccccggaggttaccggaaccgg

SEQ ID NO: 38340 - DNA, 744 bp, Homo sapiens
  misc_feature: GYAE6OF02H5FOK.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcgttgggttttcctcgttgcttcttttaagatgtgtccagtgtcaggtgcaggcgtgggggagtcgtgggggaggcgtggtccagccgtggggacgtcctggagactctctgtgcagcgttcgtggtattcctaccttcgaaggttagttagtggctattcggaccaacggttcggggtacccgccaacgggtcctaccggagggaccgtaaggggggccttgggggaaggttcgggggttaggaccgttaaggttaagtaggttaggtaagttagggaacgtagggtaaagtactaaaagtaaaaaggtccttaatcggacctaacgtaccgtaccgggtaggtaacggggacgtaaccgtttaccaaccgtactaccgtacgaacggtaacgtaacgtaaactaaccgtaaacgaaacctacggtacgttagtactaccgtgtaaccaaaacgttgaaaccgacggtacgtacgaaggaaccgtacccgaacgtaccggtacgtccggttaggtacgtttaacgtttaccgtacggttacgaacggtaacggtaaaccggtaaccggtaaggaacggttactacggtaaaccccg

SEQ ID NO: 38341 - DNA, 176 bp, Homo sapiens
  misc_feature: GYAE6OF02F131X.35.34.D01.1.454.CMB.1.raw
  modified_base (168)..(176): a, c, t, g, unknown or other
  misc_feature (168)..(176): n is a, c, g, or t
tcagtacagatcgtcacgaccggtgctcgatttagatcgtctgtgttgggtttggggggtgtggtggtctccactcccgccttgacggggctgctatctgcccccctggtcactctgttccccgccctcctcacgatctgtactgagcgggctggcaaggcgcatagnnnnnnnnn

SEQ ID NO: 38342 - DNA, 755 bp, Homo sapiens
  misc_feature: GYAE6OF02GZR6B.35.34.D01.1.454.CMB.1.raw
  modified_base (180)..(180): a, c, t, g, unknown or other
  misc_feature (180)..(180): n is a, c, g, or t
  modified_base (232)..(232): a, c, t, g, unknown or other
  misc_feature (232)..(232): n is a, c, g, or t
tcagtacagatcgtcacgaccggtgctcgatttagatcgtctgtgttgggtttggggggggacgaggagcccagcactagaagtcggcggtgtttccattcggtgatcagcactgaacacagaggactcaccatggagtttgggctgagctgggttttcctcgttgctctttaagaggtntccagtgtcaggtgcagcgtggggatcgtggggagcgtggtcagccgtgggngtccctgagacctctcctgtgcagcgtctggacttccgaccttcgtaagtagtttacgtcggtcctagtcggacctacggttcgggtaccccaccgtacggccttaccggagggtaccgaacgggggtcgtacggggtacgggttgggggtacgtaccgtaaggttttaagacggttagggttaagtacgggtaacggttacggggaaaccggttactaaaacggtaaaaaggtacccgtttaaggacgtaaccgtaacggtacccgttaccggggttaaggaaccggggtcccgtaacgttaacccgaacgttacttacccgttaacgaacggtaacgtaaccgtaacgttaacccgaaaggtaaccacggtacgttagtaactccggtacgtaacaacggtacaacgctagtacggacgaccggaccgtacgaccgacggttcgtagtacgttaacgttacgtcggtaggaaccgttaagaaccggttacggtaacgtaggtacgtcggtaaccgttaacg

SEQ ID NO: 38343 - DNA, 540 bp, Homo sapiens
  misc_feature: GYAE6OF02JHGSS.35.34.D01.1.454.CMB.1.raw
  modified_base (149)..(149): a, c, t, g, unknown or other
  misc_feature (149)..(149): n is a, c, g, or t
  modified_base (181)..(181): a, c, t, g, unknown or other
  misc_feature (181)..(181): n is a, c, g, or t
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (312)..(312): a, c, t, g, unknown or other
  misc_feature (312)..(312): n is a, c, g, or t
  modified_base (351)..(351): a, c, t, g, unknown or other
  misc_feature (351)..(351): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatgggagtttgggctgagngtggtttacgcgttaggcgtactttagaggtnctagtgtnaggtgnagcgtggggatcgnggggagcgtgtccagccgtgggagtcccngagctncctgtcgcaagccgtntagatccncttanaggttatccgtgctagtcgtcaaccttggggccaaccgnggtcctaccgaggcgtaaggggcctagggtcgtggggtnctagtatgtcgtgtgagtcggagtactagaaagtntncgagngtcgtcggaggaccgctagtcacgtcacgcaagatacaactacgagaaccacgtacgtntacgtnctaagaaacgtacacgcgctagacgcacgactacgngttctagtnttccgtgcagtacgaagtaancgtagagtcngtatcg

SEQ ID NO: 38344 - DNA, 595 bp, Homo sapiens
  misc_feature: GYAE6OF02GDGE8.35.34.D01.1.454.CMB.1.raw
  modified_base (307)..(307): a, c, t, g, unknown or other
  misc_feature (307)..(307): n is a, c, g, or t
tcagtacagatcgtcacgaccggtgctcgatttagatcgtctgtgttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggggagtcgtgggggagcgtggtccagccgtgggagtccctgagactctcctgtgcagcgtctggacttcaccttcagtagttatggcagtcgacacgtcgggtccnccgagggcctccgaggccgaaggggctagggaggtggggtggctagttatagtggtatggagtggaatcaagttaaaagctagtcgacaagtaccgtcgtaaggacgggcctaacttacaccaacttcaccaagacgaactaactaccaaagaacacgtcgtagtacttactacgactaaagacgaacgacgacgtagacgaacgccgaacgacgacggtcttacgtacgtacttaccgtgtacgtacgaacgtaactacggtacggagtaggtacgtacgttaacgg

SEQ ID NO: 38345 - DNA, 851 bp, Homo sapiens
  misc_feature: GYAE6OF02JH10C.35.34.D01.1.454.CMB.1.raw
  modified_base (181)..(181): a, c, t, g, unknown or other
  misc_feature (181)..(181): n is a, c, g, or t
  modified_base (215)..(215): a, c, t, g, unknown or other
  misc_feature (215)..(215): n is a, c, g, or t
tcagtacagatcgtcacgaccggtgctcgatttagatcgtctgtgttgggtttgggggggagaggagcccagcactagaagtcggcggtgttccattcggtgatcagcactgaacacagaggactcaccatggtagtttggctgagtcgttcgggttttcctcgttgcttcgttttaaggnggttcgtccagtgtcgaggtgcagcggtgggggntcggtagggggacgtcggtcggtaccgacgccggtgggtaccggtcccgtggacgtacctccgtccgttgtcgacgacggtcgtcgtaggtacttccgtaccgttacgaggttagttacgtcggtacagtcggaccgtaccggttccgggtacccgtaccggacggtccctcggaacggggaccggtaggggacgtaggggtcgggtaggggtcgtaccgttaaggttagtcggttcggtagtaggtaaggtaacgggaacgtaataaaccggttaaacggtacttaaggacgaaccgttaaccggtaccccggtacgggttaacggaaccggggtaccgttacctacccgaaccgttaacttcccggtaaccacggtaacgtaaccgttaaccgtaaaccgaaaccgttacccgtaacgtccgtaccgttaacgtacgtaacggaaactaacggtaacgtaccgtaaacgtaccggtaaacgaccgggtaaaccgaccggaaaacccggtcggtaaccggttacgtacgggtttaaccgttaaccgggttactttacgggaaccgtaaccggtaaacggttaacccgtaaggttaaccgggaagtttaaccgggaccgtttaacggttaaaccgg

SEQ ID NO: 38346 - DNA, 801 bp, Homo sapiens
  misc_feature: GYAE6OF02GKKTC.35.34.D01.1.454.CMB.1.raw
  modified_base (161)..(161): a, c, t, g, unknown or other
  misc_feature (161)..(161): n is a, c, g, or t
  modified_base (183)..(183): a, c, t, g, unknown or other
  misc_feature (183)..(183): n is a, c, g, or t
  modified_base (188)..(188): a, c, t, g, unknown or other
  misc_feature (188)..(188): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (297)..(297): a, c, t, g, unknown or other
  misc_feature (297)..(297): n is a, c, g, or t
  modified_base (374)..(374): a, c, t, g, unknown or other
  misc_feature (374)..(374): n is a, c, g, or t
tcagtacagatcgtcacgaccggtgctcgatttagatcgtctgtgttgggtttgggggggagaggagcccagcactagaagtcggcggtgtttccattcggtgatcagtcactgaactacagaggactcaccatggagtttgggctgagctgggttttccncgttgctacttttaagacggtntaccngtgtcaggtncgagngtgggggatcgngggggtagcgtggtccaggccgttagggtacggtccctggacgactctctggtacgcgtagcgttctggtacttctaccgtnacggttaagttcaggctagtacgcctacgtcggggtcccacgtacggccgtaccgtacgggcggaacggggttccgnggtaacgggtcgggtacggtacggtagtttaacggacgttacgggtaagttcgggtagtaacgggtaacgtaagtaaacgttaaacggtacgttacgtacggtacgacttaccggttaccgggaaggtaacggggtcccttaagtacccaacgttaacgtccgtacgaaagtaaccgtaacgtaacgttaacccaaaggtaaccgtactaacggttattaccgacgttaaggtaacctaacggtcggtaacccgtaacgccgttaggaaacgggtcccgaaaccccggtaaggttccccgtaacgggttaccgttacggttaaccgtttaccgggttacgtaccggtttaaaccgggacggttaacccgtaaccgggtaaccggtaaagggtccggttaacgttaccccgggttaacgttaaaccgg

SEQ ID NO: 38347 - DNA, 860 bp, Homo sapiens
  misc_feature: GYAE6OF02GL7PY.35.34.D01.1.454.CMB.1.raw
  modified_base (184)..(184): a, c, t, g, unknown or other
  misc_feature (184)..(184): n is a, c, g, or t
  modified_base (365)..(365): a, c, t, g, unknown or other
  misc_feature (365)..(365): n is a, c, g, or t
tcagtacagatcgtcacgaccggtgctcgatttagatcgtctgtgttggggtttgggggggagaggagcccagcactagaagtcggcggtgtttccattcggtgatcagcactgaaccacaggagactcaccatgggtagtttgggctggagtcgttgggtttttcctgttgcttattttaagnggtctccagtgtcaggtgcgagtcggtgggggagtcggtagggggagcggtggtaccaggtccgtggggtaccgtcctaggacgtacttccgtcgtggtacgacggtctactaggaactttcgaacttcttaacgaaattaacgtacgtggacctagttcggcctaacggtcgggtacccncggacggtcctaccggacggacggaacgggtcgtagggtaggtgggtttacggaagtttcggttaggtcggttagggttactaggttagttaagggtaaagttaaagttagtaatttacgtatggaaccaacgggtacccgtacgggtagggtaaccggggtcctaaacgttaccgtaacccgtaacttaccgtaccggtaagaacttaaaccgttaaccgttaacccgaaaacgtttacccgtttacgttttacgttaccctaacgtaaaccgtaaaacgttaacggaaaccgtaccgttaaccggtacgggaacggtaccgggtaaaccggtaacggaaaccggtaaccgtaagtaaccggtttaagttaaccggtttaacggtaggggttaaccgtaaacgggtaacggaaacggttaaccgggggtaaggttcccgggggttaaaccccgtaccccccgggtaaacgggtccgttaacggggaacccgggg

SEQ ID NO: 38348 - DNA, 684 bp, Homo sapiens
  misc_feature: GYAE6OF02IGTHJ.35.34.D01.1.454.CMB.1.raw
  modified_base (351)..(351): a, c, t, g, unknown or other
  misc_feature (351)..(351): n is a, c, g, or t
  modified_base (666)..(666): a, c, t, g, unknown or other
  misc_feature (666)..(666): n is a, c, g, or t
tcagtacagatcgtcacgaccggtgctcgatttagatcgtctgtgttggggtttgggggggagaggagcccagcactagaagtcggcggtgtttccattcggtgatcagcactgaacacagaggactcaccatgggagtttgggctgagcgtggttttcctcgttagctcttttaagaggtgtcagtgtcaggtgcagtcgtgggggatcgtagggggaggcgtggtacagccgtgggacggttcctgacgactccgtcctgtagcacgtgtcgtggacttctacttcagttagtatgctatgtacacgttcggcctacgagcgtcgaggcgagggtctggtacggtgggngactagttatagtggtataggatacgggtagtacgtaagtaaaagtacctagtacgacgtaacgtaccggtacggttaacgggaacggggtaccctaacttaaccgaccctaacgttacccgttacccgaaggtaaccgtaaacctaaacgtttaaccgaaacgtaacccgaacgttcgtaacgttactacccgtagaaacgtaacgttaacaacgtacgtaacctaggaccgtaaacgccggtaaacgacctacggtacgtacggttaagttaccgttacgttaggtacgaacgtacgtaacgtagtacggtanacggtacgtacttaacgg

SEQ ID NO: 38349 - DNA, 854 bp, Homo sapiens
  misc_feature: GYAE6OF02FP6G4.35.34.D01.1.454.CMB.1.raw
  modified_base (313)..(313): a, c, t, g, unknown or other
  misc_feature (313)..(313): n is a, c, g, or t
tcagtacagatcgtcacgaccggtgctcgatttagatcgtctgtgttgggtttgggggggagaggagcccagcactagaagtcggcggtgtttccattcggtgatcagcactgaacacagaggactcaccatggagtttgggctgagcttgggttttcctgttgcttcttttaagaggtgtccagtgtcaggtgcagcgtgggggagtcggtgggggaggcggtcggtccaggtccgtggggacggtccctaggacgtacctcgtccgtgtcgcaggccgttcgtggacttccaccgtttcaagtagtttagnggctagtgcctacgtcgggtcccgccgaggcctaccgaggtaccgaaggggtaccttgggacgttgggttacggactaggttggttacggtggttatagggagttaacgggtaaagttaagtagtaacttaaccgtagtacgaaccgtacggtaaccgaaccggttacgggaaacggggtacccgttaaagttcccgaaacccgttacgttaccccgtaacccggtaacggtaaaccgtaaaccgttaaacccgttacccgaaaaacggtttaaacccttaaccggttttttccgtttaaccccgttaacgaaacccgtttaaaaacgtaaccgggtaaaccgtaacccgggtttacccgtacggggaaaccggggttacccgaaacccggggtaaaccgggaccgttaaccgggggacgttaaaacttcggttaaacctttacgggtaaggttaccgggaacggtaacggtaaacggtccggtaacgggtccggggaacccgtacccccggttaaccccggaggttccggaaacccgggg

SEQ ID NO: 38350 - DNA, 765 bp, Homo sapiens
  misc_feature: GYAE6OF02HIWJG.35.34.D01.1.454.CMB.1.raw
  modified_base (214)..(214): a, c, t, g, unknown or other
  misc_feature (214)..(214): n is a, c, g, or t
  modified_base (328)..(328): a, c, t, g, unknown or other
  misc_feature (328)..(328): n is a, c, g, or t
  modified_base (430)..(430): a, c, t, g, unknown or other
  misc_feature (430)..(430): n is a, c, g, or t
  modified_base (475)..(475): a, c, t, g, unknown or other
  misc_feature (475)..(475): n is a, c, g, or t
  modified_base (545)..(545): a, c, t, g, unknown or other
  misc_feature (545)..(545): n is a, c, g, or t
tcagtacagatcgtcacgaccggtgctcgatttagatcgtctgtgttgggtttggggggagaggagcccagcactagaagtcggcggtgtttccattcggtgatcagcactgaacacagaggactcaccatggagtttgggctgagcttgggttttcctcgttgcttcttttaagaggtgtccagtgtacaggtgcagctggggatcgtggggngcgtggtccagccgtgggacgtcccgtagacgaccttccgtccgtggtacgccgaggtccgttcgtaggtaaccttcctaaccgtttaccggagtttaagtttagtccgggtanagttcgtacctaccggttcggggaccccgacccgtaacgggtacctacccggacgggtacggaacggggtcgtggtaacggggtgggtccggagtaggtttntaaggtggttatggacgtttacggaaagtacgtaaaagttaacgnttacgtacgaccgtaacgtcccggtacgggtaacgggtaccgggtaccgttaccgttacccgtaaccgtntacccgtaccggaagtaaccgtaaacctaaccgttacccgaaacgtaaaccgtaccgttcttacggttaactcggtactaaaccgaaagtacgaaccgtacgtaccgtaagtacccgtacggaaccgtaccgaaccggttccggacgtttaggtccgttaagttaccgtgggttaacacgtaacgacggtaacggtagaccgtagtacgtacgttaacgg

SEQ ID NO: 38351 - DNA, 751 bp, Homo sapiens
  misc_feature: GYAE6OF02IK9DS.35.34.D01.1.454.CMB.1.raw
  modified_base (256)..(256): a, c, t, g, unknown or other
  misc_feature (256)..(256): n is a, c, g, or t
tcagtacagatcgtcacgaccggtgctcgatttagatcgtctgtgttgggtttgggaggctttgttggagaccttgcacttgtactccttgccattcagccagtcctggtgcaggacggtgaggacgctgaccacgacggtacgtgctgttgtactgtctcctcccggtgtttccattcggtgactcagcatgaacacagagactcacagtggtagttggctgagtcgttggtttcctcgttgcttacgtttaggngtgtcagtgttttcgaggtgcaggcggtgggggagtcggtaggggggacggtcggtcggtcccgacggtccggtggggtacgggtcccgtggaaccgtccgttccgtccgtggtagccgacggtcgttacgtcgggtactttccgaacccgtttgtaacggtttacggttaacgttcgggtaacctaggttaccgacccgtacgggttcccggggaccctcccgggtacggtcccgtacccggaacggggacgggtaacgggggtcggtacggggttaggggtcgggtacggtacggttaggtttaagttacggtttagggttagttacggtaaggttacgggaaacgttagtaaataaacggtaccgttaagccgtacgtaacgtcggtacggaacgggtacgtacccggtataccgtaccgtactacccggtaacgtaaggtaccctaacggttaacctaccgaaacggaccctacgtaccgttagttaaccg

SEQ ID NO: 38352 - DNA, 837 bp, Homo sapiens
  misc_feature: GYAE6OF02IUAS4.35.34.D01.1.454.CMB.1.raw
  modified_base (199)..(199): a, c, t, g, unknown or other
  misc_feature (199)..(199): n is a, c, g, or t
tcagtacagatcgtcacgaccggtgctcgatttagatcgtctgtgttgggtttggggggagaggagccagcactagaagtcggcggtgtttccattcggtgatcagcactgaacacagaggactcaccatggagtttgggactgaagtctgggtttcctagttgcttacttttaagaggtgtccagtgtaccgaggtcncaggtcgtaggggaacgtcggtaggggggacgtcggttacggtcctaaggtcccgttagggggtacgttcccgttaggacgtaccgtccgtcccgttgttacgccgtaagtccgttacgttacggacttaccgttaccgtaccggtaaggtttaccgttaagtcgggtacctagttcgggtacctaacggttccgggttacccctacggtaccggtccggtaccggaggtacgaaggggtcctaggggtacgtgggtagacgtaagttagttacgtggtaactagggtacgttaggtaactaggtaaacgtaacgtacgtacgtagaccgacgtttaccgaggtacggtacggtacgtaacctacgaacctacgtacgtacgaataacggtaactaaccgtaacgtaaacgtacccgtaaacgttacgtaacggttacttacgtaacgttaacgaacgttaaccgaacgtacccgtaagtaaccgtaacgtaccgggtacccgtaaaccgtaccgtaaccgttaggttaccgttaacggttaacgttaaccggtaggttaaccgttaaaccggtaacggttaaaccggttaacgggttaccggtaacggtaacggtttacggtaacccggtttaacgg

SEQ ID NO: 38353 - DNA, 230 bp, Homo sapiens
  misc_feature: GYAE6OF02IM8IX.35.34.D01.1.454.CMB.1.raw
  modified_base (213)..(230): a, c, t, g, unknown or other
  misc_feature (213)..(230): n is a, c, g, or t
tcagtacagatcgtcacgaccggtgctcgatttagatcgtctgtgttgggtttggggtgttgggtttgggggaagaggaagactgacggtcccatcggtcttcccctggcaccctcctccaagagcacctcgtggggcacagcggccctgggctgcctggtcaaggactacttccacgatctgtactgaggcgggctggcaaggcgacaatgnnnnnnnnnnnnnnnnnn

SEQ ID NO: 38354 - DNA, 772 bp, Homo sapiens
  misc_feature: GYAE6OF02JTL8L.35.34.D01.1.454.CMB.1.raw
  modified_base (171)..(171): a, c, t, g, unknown or other
  misc_feature (171)..(171): n is a, c, g, or t
  modified_base (186)..(186): a, c, t, g, unknown or other
  misc_feature (186)..(186): n is a, c, g, or t
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
tcagtacagatcgtcacgaccggtgctcgatttagatcgtctgtgttgggtttgggagggctttgttggagaccttgcacttgtactccttgccattcagccagtcctggtgcaggacggtgaggccgctgaccacgacggtacgtgctgttgtactgcctcctcccggtntttaccagttcggtnactcagcactagaacacaggacggacctcacctagtcgggtgtttcgggccgtgtacggtcgtttcgggttttcccgtcggttcgtactttccgttttaaaggcggttcgtccgtaggtcgtcgtagggtcgcgaggtccgggtagggggngttccggggtacggggggngtcggttccggtccgacgccggttggggacgtcccggttagacgttccgtcgtcggttcgtaacggtcgaccgtcggtcttacggtacttccgtaccgttagtaacgttcgtagtggactcgttcgaaccgtccgggtcgggtccctaccggccggttaccgacggacgggtacgggtaacggcccggttaggggtcggttcggggtacgttaacgttacggttaacgtacggttagggtactagggtagtaccggtaagttaacgtaacggtaacgtagtaacgtggaacccgttagaccggtacgtaacggccgttaaccgtccttaaccggtccgaagtttacccgacggtaacgtaccgtaaacccgtaaccgtaaccgtaaacgaccggtttaccggtattcgttaacccg

SEQ ID NO: 38355 - DNA, 760 bp, Homo sapiens
  misc_feature: GYAE6OF02FT8IA.35.34.D01.1.454.CMB.1.raw
  modified_base (160)..(160): a, c, t, g, unknown or other
  misc_feature (160)..(160): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
tcagtacagatcgtcacgaccggtgctcgatttagatcgtctgtgttgggtttgggggggagaggagcccagcactagaagtcggcggtgtttccattccggtgatcagcactgaacacagaggactcaccatggagtttgggctgagctgggttttccncgttgctctttaagagtgtccagtgtcaggtgcagtcgtgggggatcgtgggggagcggtggtaccaggccctgggacggtccctgagacctctccgtgtgccaggccgtctaggacttccaccttcagtagttagtggctagtcgacacgtcggggtacccgcgaggccgtccgaggccgaagggggtcctagggaggttcggggtggacgttaaggtttacgtagttcggggttaataggtaggtacgggaacggtttanaaagttaaaacgntaagtcgacgaacgtaccggtccggtaagggaaccgggtaccgtaacgttcccgaaccgtactcccgttaccgaaaggacgtaaacctaacgtaaccctaaagtaacccgaccgttacgttagtaaccttctaaggaacctaaaacgtaccggtaaaccacgggtaccctaaggaacgtaaccggaacccggtaaccgtaacccggtaacgggtaccttaggtaacgttttaaacgtaccggtttacgggaccggtaaacggtaaccggtaaacggtaacccggttaagggaaccgttaacgggtaccggtactttaaacccggg

SEQ ID NO: 38356 - DNA, 708 bp, Homo sapiens
  misc_feature: GYAE6OF02FTVQL.35.34.D01.1.454.CMB.1.raw
  modified_base (202)..(202): a, c, t, g, unknown or other
  misc_feature (202)..(202): n is a, c, g, or t
  modified_base (540)..(540): a, c, t, g, unknown or other
  misc_feature (540)..(540): n is a, c, g, or t
  modified_base (557)..(557): a, c, t, g, unknown or other
  misc_feature (557)..(557): n is a, c, g, or t
  modified_base (581)..(581): a, c, t, g, unknown or other
  misc_feature (581)..(581): n is a, c, g, or t
tcagtacagatcgtcacgaccggtgctcgatttagatcgtctgtgttgggttggggggagaggagcccagcactagaagtccggcggtgtttccattcggtgatcagcactgaacacagaggactcaccatggagtttgggctgagcttgggttttcctcgttgccttacttttaagaggtcgtccagtgtcaggtgacagnggtggggagtcgtggggagcgtggtcagccgtgggaccgtccgtgacgctccgtcctgtgcgacgtcgtcgtgtcttcccgtacgttacgtagttagttagcggtacagtgcctaggttccggcccgacgcggttccgaccggtacggaccggacggggtcgtaggggtagggttggggttcggacttaaggtttaagtggttacggtaagttggaagtacggtaagttacgaaagtaaacgtactagcgacgttaccgccgtacgggtacggaacggtaccgtctaaccgcctatcccgtaagacgactaacctacgacaagtaccgatccttaacngttacaacgtaacgaanagtaaccgtccgagtaccgggaancccggacgtaccgaaccgtttgacggtttacgaagtttccggtaacgtacgggtaccggaagttaaacccggtaacggtaacggttaaggtaaccgggtcgtttaaccccggttaacgtttaaccgg

SEQ ID NO: 38357 - DNA, 955 bp, Homo sapiens
  misc_feature: GYAE6OF02G1CSA.35.34.D01.1.454.CMB.1.raw
tcagtacagatcgtcacgaccggtgctcgatttagatcgtctgtgttgggtttgggggggagaggagcccagcactagaagtcggcggtgtttccattcggtgatcagcactgaacacagaggactcaccaagtgggtagtttggggctggatcgttcggggtttttcctcggttgtcttacgtttttaaggaggttcgttcctaaggtgttcgaggttcgcgacggcggttggggggtagttccgggtgggggggaacgggtcggttcggttccccgaagggtcccggttagggggtacggttccccgtagggactaccgttccgttccgttggtacgtaccgaggttccgtaccggttacggtacttaccgtaacctttaccgtaaggttacggttagtcggtactaggtcgtaaccgtcgggttacgggtaccccgaccggtaacgggtcccgttaccggacggggtaccgggtaaagggggttctttacgggggagggttcggggtaacggtcgtttaaacggtttagttaacggttagggtttaactaggggttaaccggttaggggtaaaccgtaaccgttttaaaaggaaaaaggttcccgtacgaacgtaccgaaaggggttaccctttacggggtaaggggaaccggtacccgttaaactcccgtaactacgtttacctaaccgacggttaaacggaaccttaaaccgtaaccgaacggtaaacccgtcgtaccgttaaggttacctaaagtccgtaaacgtaaactaacggtaacctacgggtacgtaacggtaaccgacggaacccggtaaccgaaccggtcggttaccgttaacggtttaccgtttaaccggtaccgttacggtacgggttaacgtacggaacggttagggtaccgggaaccggtttacccggggtttacccccggtttaccgggttaccggg

SEQ ID NO: 38358 - DNA, 257 bp, Homo sapiens
  misc_feature: GYAE6OF01DA3AN.18.14.B03.1.454.CMB.1.raw
  modified_base (254)..(257): a, c, t, g, unknown or other
  misc_feature (254)..(257): n is a, c, g, or t
tcagtacgagtatgcacgaccggtgctcgatttagtgtgagtagtttggggagttatcgcaaacggggtactactacgctatggacgtctgggccaagggaccacggtcaccgtctcctcagcctccaccaagggcccatcggtcttcccctggcaccctcctccaagagcacctctggggcacagcggccctgggctgcctggtcaaggactacttcccatactcgtactgagcggctggcaaggcgcatagnnnn

SEQ ID NO: 38359 - DNA, 262 bp, Homo sapiens
  misc_feature: GYAE6OF01C4HH7.18.14.B03.1.454.CMB.1.raw
  modified_base (258)..(262): a, c, t, g, unknown or other
  misc_feature (258)..(262): n is a, c, g, or t
tcagtacgagtatgcacgaccggtgctcgatttagtgtgagtagtttggggagttatcgcaaacgggggtactactacgctatggacgtctggggccaagggaccacggtcaccgtctcctcagcctccaccaagggcccatcggtcttcccctggcaccctcctccaagagcacctctgggggcacagcggccctgggctgcctggtcaaggactacttcccatactcgtactgagcgggctggcaaggcgcatagnnnnn

SEQ ID NO: 38360 - DNA, 268 bp, Homo sapiens
  misc_feature: GYAE6OF01DOG0P.18.14.B03.1.454.CMB.1.raw
  modified_base (243)..(268): a, c, t, g, unknown or other
  misc_feature (243)..(268): n is a, c, g, or t
tcagtacgagtatgcacgaccggtgctcgatttagtgtgagtagtttgggggttacgtactacgctatggacgtctgggccaagggaccacggtcaccgtctccctcagcctccaccaagggcccatcgtcttcccctggcaccctcctccaagagcacctctgggggcacagcggccctgggctgcctggtcaaggctacttcccatactcgtactgaggcgggctggccaaggcgcatagnnnnnnnnnnnnnnnnnnnnnnnnnn

SEQ ID NO: 38361 - DNA, 242 bp, Homo sapiens
  misc_feature: GYAE6OF01BL2M7.18.14.B03.1.454.CMB.1.raw
  modified_base (241)..(242): a, c, t, g, unknown or other
  misc_feature (241)..(242): n is a, c, g, or t
tcagtacgagtatgcacgaccggtgctcgatttagtgtgagtagtttggggggtactactacgctatggacgtctggggccaagggaccacggtcaccgtctcctcagcctccaccaagggcccatcggtcttcccctggcaccctcctccaagagcacctctggggcacagcggccctgggctgcctggtcaaggactacttcccatactcgtactgagcgggctggcaaggcgcatagnn

SEQ ID NO: 38362 - DNA, 259 bp, Homo sapiens
  misc_feature: GYAE6OF01ACRJ8.18.14.B03.1.454.CMB.1.raw
  modified_base (259)..(259): a, c, t, g, unknown or other
  misc_feature (259)..(259): n is a, c, g, or t
tcagtacgagtatgcacgaccggtgctcgatttagtgtgagtagtttggggagttatcgcaaacggggggtactactacgctatggacgtctggggccaagggaccacggtcaccgtctcctcagcctccaccaagggcccatcggtcttcccctggcaccctcctccaggagcacctccgagagcacagcggccctgggctgcctggtcaaggactacttcccatactcgtactgagcgggctggcaaggcgcatagn

SEQ ID NO: 38363 - DNA, 602 bp, Homo sapiens
  misc_feature: GYAE6OF01DBXRH.18.14.B03.1.454.CMB.1.raw
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagccgtggggggtccctgaaactctcctgtgcagcctctgggttcaccttcagtggctctgctatgcactgggtccgccaggcttccgggaaaggctggagtgggttggccgtattagaagcaaagctaacagttacgcgacagcatatgctgcgtcggtgaaaggcaggttcaccgtctccagaaatgattcaaaagacacggctatctgacaaaatgaacagcctagaaaacccgnggacacggccgtagtattacngtactagacaggtgattacagtttggggagttagtcggacgaaacgggggggtactaacgtacgctagtggtacgtcgtacggggaccgaagggaaccgacggtacaccgtccgtcctcacgcctacccaaccgaacgggcccaacgtccggtcccgttcccccgtcggcctacccctccctaccaacgacgacacctcgtcggggcaccg

SEQ ID NO: 38364 - DNA, 583 bp, Homo sapiens
  misc_feature: GYAE6OF01BMPL1.18.14.B03.1.454.CMB.1.raw
  modified_base (544)..(544): a, c, t, g, unknown or other
  misc_feature (544)..(544): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaatgattcaaagaacacggcgtatctgcaaatgaacagcctagaaaaccgaggacacggccgtgtattactgtactagacaggtggattacgtagtttgggggagttagtcggacggaaacgggggggtactacgtacgctagtggacgtcgtgggccgaagggaccacggtcaccgtctcctcacgcctccaccgacggcccacgtccggtccttccccgtcggccncccctccctcccaacgacgccacctccgtggggccaccg

SEQ ID NO: 38365 - DNA, 573 bp, Homo sapiens
  misc_feature: GYAE6OF01CQBVC.18.14.B03.1.454.CMB.1.raw
  modified_base (538)..(538): a, c, t, g, unknown or other
  misc_feature (538)..(538): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagacacggcgtatctgcaaatgaaacagcctagaaaaccgaggacacggccgtgtattactgtaactagacaggtggattacagtttgggggagttagtcgacgaaacggggggtactacgtacgctatggacgtcgtgggccgaagggaccgacggtcaccgtctcctcacgcctccaccacgggcccacgtccggtccttcccctggccnccctccctccaacgacgccacctcgtggggcacgg

SEQ ID NO: 38366 - DNA, 396 bp, Homo sapiens
  misc_feature: GYAE6OF01CKOZM.18.14.B03.1.454.CMB.1.raw
  modified_base (317)..(317): a, c, t, g, unknown or other
  misc_feature (317)..(317): n is a, c, g, or t
  modified_base (319)..(320): a, c, t, g, unknown or other
  misc_feature (319)..(320): n is a, c, g, or t
  modified_base (322)..(396): a, c, t, g, unknown or other
  misc_feature (322)..(396): n is a, c, g, or t
tcagtacgagtatgcacgaccggtgctcgatttagtgtgagtagtttggggtttagggggtttctaatcgcttctctggctccaagtctggcaacacggcctccctggacccatctctgggcctccaggcctgaggaccgaggctgattagttactgcagctcatatacaagcacgcagcactcaagtcttcggaactgggaccaaggtcaccgtcctaggtcagccccaaggcccaaacccctcgtggtccaacttctgttccccaccctcctccattactcgtaactggagcggctggcaaaggcacgatacgancnntnnnnnnnnnnnnnnnnnnnnnnnnnnnnnnnnnnnnnnnnnnnnnnnnnnnnnnnnnnnnnnnnnnnnnnnnnnn

SEQ ID NO: 38367 - DNA, 610 bp, Homo sapiens
  misc_feature: GYAE6OF01C0SBS.18.14.B03.1.454.CMB.1.raw
  modified_base (340)..(340): a, c, t, g, unknown or other
  misc_feature (340)..(340): n is a, c, g, or t
  modified_base (343)..(345): a, c, t, g, unknown or other
  misc_feature (343)..(345): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (378)..(380): a, c, t, g, unknown or other
  misc_feature (378)..(380): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (407)..(408): a, c, t, g, unknown or other
  misc_feature (407)..(408): n is a, c, g, or t
  modified_base (410)..(410): a, c, t, g, unknown or other
  misc_feature (410)..(410): n is a, c, g, or t
  modified_base (412)..(413): a, c, t, g, unknown or other
  misc_feature (412)..(413): n is a, c, g, or t
  modified_base (415)..(415): a, c, t, g, unknown or other
  misc_feature (415)..(415): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
tcagtacgagtatgcacgaccggtgctcgatttagtgtgagtagtttggggaggttatcgcaaacggggggtactactacgctatggacgtctggggccaagggaccacggtcaccgtctcctcagcctcccacccaaggtccgccagtcgttcccttcccggtcgacctaccctcctaccgaaggcacctaccttcgggcgggccaacgcggtcccggtccggtcggtcgtccgtccggttcggtaacgaacggtacctttaccctaccctaacttaccgttaccgttacgtaggacgggtccgggtacgcggaacgaacggccgactaagttggatanacnnnctcngactagntcncnacacncacncntatatnnngtgtcgcgtcgtgtctncnctctcncnncncnngngacacgcgcncncncntcncgcgcgtcgtgtagagngtgtntacgtatatgtcgtcgtctcgtacgtagtacgtagtagtaggtagtacggtacggtacggtacgtacgtacgtacgtacgtacgtacgacgaccgacgtacgtccgtccgtcgtccgtccgtccgtccgtccctcctacctccgtcgtcgtacg

SEQ ID NO: 38368 - DNA, 243 bp, Homo sapiens
  misc_feature: GYAE6OF01DHLNN.18.14.B03.1.454.CMB.1.raw
  modified_base (242)..(243): a, c, t, g, unknown or other
  misc_feature (242)..(243): n is a, c, g, or t
tcagtacgagtatgcacgaccggtgctcgatttagtgtgagtagtttgggggggtactactacgctatggacgtctggggccaagggaccacggtcaccgtctcctcagcctccaccaagggcccatcgtcttcccctggcaccctcctccaagagcacctccgagagcacagcggccctgggctgcctggtcaaggactacttcccatactcgtactgagcgggctggcaaggcgcatagnn

SEQ ID NO: 38369 - DNA, 268 bp, Homo sapiens
  misc_feature: GYAE6OF01BS2U0.18.14.B03.1.454.CMB.1.raw
  modified_base (261)..(268): a, c, t, g, unknown or other
  misc_feature (261)..(268): n is a, c, g, or t
tcagtacgagtatgcacgaccggtgctcgatttagtgtgagtagtttgggggagttatcgcgaaacggggggtactactacgctatggacgtctggggccaagggaccacggtcaccgtctcctcagcctccaccaagggcccatcggtcttcccctggcaccctcctccaagagcacctctgggggcacagcggccctgggctgcctggtcaaggactacttcccatactcgtactgagcgggctggcaaggcgcatagnnnnnnnn

SEQ ID NO: 38370 - DNA, 588 bp, Homo sapiens
  misc_feature: GYAE6OF01BCMCJ.18.14.B03.1.454.CMB.1.raw
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (547)..(547): a, c, t, g, unknown or other
  misc_feature (547)..(547): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgacaaatgaacagcctagaaaaccgnggacacggccgtgtattacngtactagacaggtgattacagtttggggagttagtcggacgaaacgggggggtactacgtacgctagtggacgtcgtgggcgaagggaccgacggtacaccgtctcctcacgcctaccaccgaacggcccacgtccggtccgttcccccgtcggcccncccctcctcccgaacgacgccaccctcgtcggggacaaccg

SEQ ID NO: 38371 - DNA, 594 bp, Homo sapiens
  misc_feature: GYAE6OF01BUYLH.18.14.B03.1.454.CMB.1.raw
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (370)..(370): a, c, t, g, unknown or other
  misc_feature (370)..(370): n is a, c, g, or t
  modified_base (550)..(550): a, c, t, g, unknown or other
  misc_feature (550)..(550): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtccctgaaactctcctgtgcagcctctgggttcaccttcagtggctctgctatgcactgggtccgccaggcttccggggaaagggctggagtgggttggccgtattagaancgggaaanctaacagttacgcgacagcatatgctgcgtcggtgaaaggcaggttcaccgtctccagaaatgattcaaagaacaggcgtatctgcaaatgaacagcctagaaaaccgnggacacggcctgtattactgtaactagacagggtgattacgagtttggggagttagtcggacgaaacggggggtactacgtacgctatggacgtcgtgggccgaagggaccgaacggtcgaccgtctcctcacgcctccgaccgaacgggcccacgtccggtccgttcccccgtcggccncccctccctcccgaacgacgaccgaccctcgtcggggccgaacg

SEQ ID NO: 38372 - DNA, 244 bp, Homo sapiens
  misc_feature: GYAE6OF01CV3EQ.18.14.B03.1.454.CMB.1.raw
  modified_base (241)..(244): a, c, t, g, unknown or other
  misc_feature (241)..(244): n is a, c, g, or t
tcagtacgagtatgcacgaccggtgctcgatttagtgtgagtagtttggggggtactactacgctatggacgtctggggccaagggaccacggtcaccgtctcctcagcctccaccaagggcccatcggtcttcccctggcaccctcctccaagagcacctctgggggcacagcggccctgggctgcctggtcaaggctacttcccatactcgtactgagcgggctggcaaggcgcatagnnnn

SEQ ID NO: 38373 - DNA, 606 bp, Homo sapiens
  misc_feature: GYAE6OF01APXTJ.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaatgattcaaagacacggcgtatctgacaaatgaacagcctagaaaaccgaggacacggcgtgtattactagtactagacaggtagattacgtagtttaggggagttagtacggacggtaaacggggggtactacgtacgtactagtggacgtcgtcggggacgaacgggaccacggtacgtaccgtccgtccgtcacgtcctaccgaccgaacgggcccacgtccggtccgttccccgtcggccctcccctccgtacccaacgtacgaccaccgtcgtcgggcgaccgg

SEQ ID NO: 38374 - DNA, 262 bp, Homo sapiens
  misc_feature: GYAE6OF01C324Z.18.14.B03.1.454.CMB.1.raw
  modified_base (261)..(262): a, c, t, g, unknown or other
  misc_feature (261)..(262): n is a, c, g, or t
tcagtacgagtatgcacgaccggtgctcgatttagtgtgagtagtttgggggagttatcgcaaacgggggggtactactacgctatggacgtctggggccaagggaccacggtcaccgtctcctcagcctccaccaagggcccatcggtcttcccctggcaccctcctccaagagcacctctgggggcacagcggccctgggctgcctggtcaaggactacttcccatactcgtactgagcgggctggcaaggcgcatagnn

SEQ ID NO: 38375 - DNA, 604 bp, Homo sapiens
  misc_feature: GYAE6OF01EUXUS.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaagggctggagtgggttggccgtattagaagcaaagctaacagttacgcgacagcatatgctgcgtcggtagaaaggcaggttcaccgtctccagaatgattcaaagacacggcgtatctagacaaatgaacagcctagaaaaccgaggacacggacgtgtattacgtgtactagacaggtggtattactagtttggggtagttagtcggacggaaacggggggtactacgtacgctagtggacgtcgtcgggccgaagggaccgacggtacaccgtctcctcacgccctccgaccgacggcccacgtccggttaccgttcccccgtcggaccctcccctaccctacccgaacgaccgacctaccgtccgtcggggccaccgg

SEQ ID NO: 38376 - DNA, 599 bp, Homo sapiens
  misc_feature: GYAE6OF01D9PV7.18.14.B03.1.454.CMB.1.raw
tcagtacgagtatgcacgaccggtgctcgatttagtgtgagtagtttgggctgagctgggtttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccggggaaagggctggagtgggttggccgtattagaagcaaagctaacagttacgcgacagcatatgctgcgtcggtagaaaggcaggttcaccgtctccagaaatgattacaaagacacggcgtatctgacaaatgaacagcctaggaaaaacccgaggacacggccgtagtactactgtactagacgaggtggattacgtagtttaggggagttagtacggacggtaacggggggtaactacgtacgtactagtggacgtcgtgggaccgaacgggacgacggtcaccgtctccgtcacgcctccgaccacgggcccacgtccggtccgttccccgtcgcctcccgtccctccgaacgcgaccacctcggtcgggcaaccgg

SEQ ID NO: 38377 - DNA, 289 bp, Homo sapiens
  misc_feature: GYAE6OF01BALB2.18.14.B03.1.454.CMB.1.raw
  modified_base (266)..(289): a, c, t, g, unknown or other
  misc_feature (266)..(289): n is a, c, g, or t
tcagtacgagtatgcacgaccggtgctcgatttagtgtgagtagtttgggggagtttagtcggcaaacgggggggtactactacgctatggacgtctggggccaagggaccacggtcaccgtctcctcagcttccaccaaggcccatcggtcttccccctggcgccctgctccaggagtcacctctgggggcacagcggccctgggctgcctggtcaaggactacttcccgatactcgtactgagcgggctggcaaggcgcatagnnnnnnnnnnnnnnnnnnnnnnnn

SEQ ID NO: 38378 - DNA, 578 bp, Homo sapiens
  misc_feature: GYAE6OF01DBVBC.18.14.B03.1.454.CMB.1.raw
  modified_base (550)..(550): a, c, t, g, unknown or other
  misc_feature (550)..(550): n is a, c, g, or t
tcagtacgagtatgcacgaccggtgctcgatttagtgtgagtagtttgggttcgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtgattacattggggagttatcgcaaacgggggggtactacgtaacgctatggacgtctggggccaaagggaccaacggtcaaccgtctcctcacgcctccacccaacgggcccaagtccggtaccttcccccgtggccacccctcctccaagacgcaacctctcggggcacgacgcggccctggcctgcctcggtcaacggacctacttacccntacctcgtactgacgcggctggcaacgg

SEQ ID NO: 38379 - DNA, 613 bp, Homo sapiens
  misc_feature: GYAE6OF01A4LW3.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaaggctggagtgggttggccgtattagaagcaaagctaacagttacgcgacagcatatgctgcgtcggtgaaaggctaggtcaccgtctccagaatgatacaaagacacggcgtatctagacaaatgaacacgcctaagaaaacgacggacacggcgtagtattactagtactagacaggtagattacgtagtttaggggtagttagtacggacggtaaacggggggtactacgtacgtactagtacggtacgtcgtacgggaccgaacgggaccgacgggtaccaccgtcgtcctcgacgcctacccgaccgaacggccctacgtccgtcccgttccccgtacgccctaccctccctacgaacgacgaccaccgtcgtcggggcacccgg

SEQ ID NO: 38380 - DNA, 623 bp, Homo sapiens
  misc_feature: GYAE6OF01EWH7F.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtgggagtccggggggaggcttggtccagcctggggggtccctgaaactctcctgtgcagcctctgggttcaccttcagtggctctgctatgcactgggtccgccaggcttccggggaaagggctggagtgggttggccgtattagaagcaaagctaacagttacgcgacagcatatgctggcgtcggtgaaaggcaggttcaccgtctccagaaatgattacaaaagaacacggcgtatctgacaaatgaacagcctagaaaccgaggacacggcgtagtattactgtaactagacagggtgtattacgtagtttgggggagttagtcggtacggtaaacgggggggtactacgtacgtcgtagtggtacgtcgtcgggaccgaacgggaccgacggtaccgaccgtcctccgtccacgccctacccaccgaacggacccacgtccgtcccttccccgtcggccctaccccgtccctacccgaacgacgacctaccgtccggtcggggcgaccgg

SEQ ID NO: 38381 - DNA, 605 bp, Homo sapiens
  misc_feature: GYAE6OF01B07FG.18.14.B03.1.454.CMB.1.raw
  modified_base (373)..(373): a, c, t, g, unknown or other
  misc_feature (373)..(373): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccagggcttccggggaaagggctggagtgggttggccgtattagaagcaaagctaacagttacgcgacagcatatgctgcgtcggtgaaaggcaggttcaccgtctccagaaatgattacaaagaacacggcgtatctgacaaatgaacagacctagaaaaccgngacgacggcgtagtattactgtacagacaggtagattacgtagtttgggggagttagtcggacggtaaacggggggtactaacgtacgactagtgggacgtcggtacgggaccgaacgggaccgacggtaccaccgtcctcctcacgccctccgaccgacggcccacgtccggtcccttccccgtcggcccaccctccctaccgaacgacgccaccgtcgtggggcgaccgg

SEQ ID NO: 38382 - DNA, 660 bp, Homo sapiens
  misc_feature: GYAE6OF01CZCDQ.18.14.B03.1.454.CMB.1.raw
  modified_base (530)..(530): a, c, t, g, unknown or other
  misc_feature (530)..(530): n is a, c, g, or t
  modified_base (647)..(647): a, c, t, g, unknown or other
  misc_feature (647)..(647): n is a, c, g, or t
tcagtacgagtatgcacgaccggtgctcgatttagtgtgagtagtttgggtttaggggctttgaccgtcggaacccagtcctcgtcccgtgaactccaacctgcctccgtgtctcgggtctccctggacgaggtccgagtcaccatccttcctggcactggaccagcaagtgacgttcggtggttactaacgttatcgtcgtcctggtaccaacaggcacccaggcaaacgcccccaaaactcaatcgtagtttactgattgtacaggttaactccggccctcgaggggttttcaattcgtcgttctcgttcggtcctcccgaagttcctggactaacgtacggcctccctcgacccgatcgtctgggctccgaggcgtagaggacgaggctacgtaattaattaactgactagcgtacaatactaccgaagcaaccgagcctaactctactacgtcgtcgtaacggaactcgggaacccaaggtccaacccgttccgtaaggtccacgacccgaaaggcccaaacccgngtcgtaccacttccttccgttaccccaccccttacctaccgtacttaccgttacgttaaccgtggaccgtcgggactgggactaacgggtccgactacggttacgctagctacgacngtacgtgcgtacg

SEQ ID NO: 38383 - DNA, 266 bp, Homo sapiens
  misc_feature: GYAE6OF01BOLHI.18.14.B03.1.454.CMB.1.raw
  modified_base (254)..(254): a, c, t, g, unknown or other
  misc_feature (254)..(254): n is a, c, g, or t
  modified_base (260)..(266): a, c, t, g, unknown or other
  misc_feature (260)..(266): n is a, c, g, or t
tcagtacgagtatgcacgaccggtgctcgatttagtgtgagtagtttgggggagttatcgcgaaacggggggtactactacgctatggacgtctggggccaagggaccacggtcaccgtctcctcagcctccaccaagggcccatcggtcttcccctggcaccctcctccaagagcacctctgggggcacagcggccctgggctgcctggtcaaggactacttcccatactcgtactgagcggctggcaaggcncatagnnnnnnn

SEQ ID NO: 38384 - DNA, 594 bp, Homo sapiens
  misc_feature: GYAE6OF01CGHW7.18.14.B03.1.454.CMB.1.raw
  modified_base (477)..(477): a, c, t, g, unknown or other
  misc_feature (477)..(477): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggctccgagggaagggcctggagtggatctcacttatttatagtggtggtaccacatactacacagactccgtgaagggccgattcaccatctcagaagacaattccaggaacacattgtatcttacaaatgaataacctgagagccgaggacacggccatgtattactgtgtggggctatttacttcgacccgtggggcccggggaacctgggtcaccgtctccccaccctcccaccgaacgggcccacgtccggtccttccccncggccgccctgccctcccgacggacgccaccgtcgcgggggccaccgacggccggcccgtggggctcggcccgtcggtacgaacgggtaccttaccttccccacttccgtccgtacg

SEQ ID NO: 38385 - DNA, 557 bp, Homo sapiens
  misc_feature: GYAE6OF01DTZRY.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaaggctggagtgggttggccgtattaaaaccaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctagaaacgcgtacaactactactactacggtatggacctcgtgggccaagggaccacggtcaccgtcctcctcacgccctccaccgaacggcccatccggtcctcccccgtggcccgccctgcctccgacggacgccacctccgagacgccgcgaccgg

SEQ ID NO: 38386 - DNA, 630 bp, Homo sapiens
  misc_feature: GYAE6OF01AX8LW.18.14.B03.1.454.CMB.1.raw
tcagtacgagtatgcacgaccggtgctcgatttagtgtgagtagtttgggttcgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcaaacggggggggtactactacgctatggacgtctggggtccaagggaccacggtcaccgtctcctcagcctccaccaaggcccatccggtcttcccctggccaccctccctccacgagcacctctcgggggcaccgagccggccctacggggcctcggccgtcgggtccgtaaacgggaccctttaacccgtttcccccgaacgtttaacccgtccgttaacccgttcggtaacggccgggggcccgttggggccgtaaaaccggggg

SEQ ID NO: 38387 - DNA, 638 bp, Homo sapiens
  misc_feature: GYAE6OF01CPK6J.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggagcttggtccagcctggggggtccctgaaactctcctgtgcagcctctgggttcaccttcagtggctctgctatgcactgggtccgccaggcttccgggaaagggctggagtgggttggcgtattagaagcaaagctaacagttacgcgacagcatatgctgcgtcggtgaaaggcaggttcaccgtctccagaaatgattacaaagacacggcgtaatctgacaaatgaacagacctagaaaaccgaggacacggcctgtattacgtgtactagacaggtcgtattacgtagtttggggagttagtacggacggtaaacgggggggtaactacgtacgtacgtaagtcggtacgtcgtcggggaccgaaacgggaccgtaacggtaccgtacccgttccgtcccgtacgtacgacccgtaccaacccgaacgggaccccacgttccggtcccgttcccccgtcggcctaccccttaccctacccgaacgacgaccaccgtcgtcggggctaaccgg

SEQ ID NO: 38388 - DNA, 810 bp, Homo sapiens
  misc_feature: GYAE6OF01CSRNN.18.14.B03.1.454.CMB.1.raw
  modified_base (169)..(169): a, c, t, g, unknown or other
  misc_feature (169)..(169): n is a, c, g, or t
  modified_base (197)..(197): a, c, t, g, unknown or other
  misc_feature (197)..(197): n is a, c, g, or t
tcagtacgagtatgcacgaccggtgctcgatttagtgtgagtagtttggctgagctggtttcctgttgctatttaaaggtgtccagtgtgaggtgcagctggtggagtccggggagcttggtccagccgtggggtcctgaactctctgtgcagcctgtggttcaccttnagtgctcgtgctatgctacgtcggtccncgaggtcgttaccggggaaaggcgtaggaggttcgggttcggtaccgttaagttaagaacgacgtaaaagtcctaaacgtgttaccgacgtaacgtaggcctaagtacgtcggtaccgtaggccggttacggttaaggaaaacgggtccttaacgggtttccaacccggttaccgtaacccgtaaaggtaacttcggtaactttaaaccgaaaaggtaaccgacgggttaccgtaagttccgtacgaactaaaaagtccgtaaaccaacggtcccgttaaacgaaaaccggtacggtaaccgtaacggttcccgtagtttaaccgttacgtacggttaacgttaaggacgtagggttacgtacgttaacgtacggtttacggggtacgttacggttacggacggtaacggggtacctacggtacgtacgtacgtacggtacgtcggtacggacgaacgggtaccgtacggtaccgtaccgtccgttaccgtaccgtaccgtacctacccgtaaccggaccggtacccgtacgttcccggtcccgttccccgtacggtacccctacccgtccgtacccgaacgtccgactaccggtcgtcgggtaccgtaccgg

SEQ ID NO: 38389 - DNA, 815 bp, Homo sapiens
  misc_feature: GYAE6OF01CX8AI.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcgagtgctctgctatgcacgtcgggtcccgccgaggtccgttaccggggaaacggtcgtgggtagggttgggggttcggtaccgttaagttaaggaagaacgaaaacggtacctaaacgtaacggttaccggaccgaacgaacggacaattaagtcggctggtccggttacgggtaaggaaacggcgtacgggttacccaacccgttcctaccgaaagtaaacgtagtaacttaaccgaaaagaaccgaccgggtacgttacttccgtacgaactaaaagtacgaaacgacgtaccgtaaacggaaaaaccggacggaacgaccggtaccggtagttaacgttacgtagtaacgtacgaacgtagggttagtaacgtttacgtaagggtttagggggtacgttacgtacgggtaacggggtaaacggggggttaactacggttacgacgttagtcggtacggtcggacgggacggaacggacgaccgtaccgtaccgtcctacctcgaccgccctaccaaccgacggaccctacgtccggttccccttccccggtcggtacccctaccccgttccccgtaaccgaaaccggtacgaccccgtacccggttccgggtcgggggccctaacccggg

SEQ ID NO: 38390 - DNA, 262 bp, Homo sapiens
  misc_feature: GYAE6OF01B5Y1V.18.14.B03.1.454.CMB.1.raw
  modified_base (260)..(262): a, c, t, g, unknown or other
  misc_feature (260)..(262): n is a, c, g, or t
tcagtacgagtatgcacgaccggtgctcgatttagtgtgagtagtttgggggagttatcgcaaacgggggggtactactacgctatggacgtctggggccaagggaccacggtcaccgtctcctcagcctccaccaagggcccatcggtcttcccctggcaccctcctccaagagcacctctgggggcacagcggccctgggctgcctggtcaaggactacttcccatactcgtactgagcggctggcaaggcgcatagnnn

SEQ ID NO: 38391 - DNA, 796 bp, Homo sapiens
  misc_feature: GYAE6OF01CTPFW.18.14.B03.1.454.CMB.1.raw
  modified_base (193)..(193): a, c, t, g, unknown or other
  misc_feature (193)..(193): n is a, c, g, or t
  modified_base (209)..(209): a, c, t, g, unknown or other
  misc_feature (209)..(209): n is a, c, g, or t
tcagtacgagtatgcacgaccggtgctcgatttagtgtgagtagtttgggctgagctgggttttccttgttgctattttaaaaggtgtccagtgtgaggtgcagctggtgggaggtccggggggaggcttggtccagccgtggggggtcctagaactctcctgtgcagcctctgggttcaccttcagtggctntcccccccccccccgntatgcacgtcgggtcccgccgacggcctccggaaggggaagggggcgtggggtagggttgggggttcgggtaccgttaaacttaaaaaaccaaaaacgtagagtagggtagggaacaacagactacgctgcacccgtagaaaggcagattcaccatctacaagagatagtaacttaacaaaaacgacacgtctagtatactagaacaaatacgaacacgacctagaacggaaaccgaacggaaccaacgacgtaccgtagttaacttaacgtacgtaaccaacctaccttaccccgtaggaaacgtccgtaaccaaaaccgttaaccttaacgtaaaccgtacgggtaacgtacgggtaacccttacgggtacggggaacccgaaacggggacccgtaaccgggttaccctaacccgttaccttaccccgtaccgacccgtaccccttacccaacccggtaaccgggcccctaaccggttcccggttacccccttcccccgtacgggtcccccgtaccccttcggacccttacccggaacgggtacccgccccgtaacccgtcccggaaggaccgcccgaacccggg

SEQ ID NO: 38392 - DNA, 710 bp, Homo sapiens
  misc_feature: GYAE6OF01CDSJT.18.14.B03.1.454.CMB.1.raw
  modified_base (439)..(439): a, c, t, g, unknown or other
  misc_feature (439)..(439): n is a, c, g, or t
  modified_base (692)..(692): a, c, t, g, unknown or other
  misc_feature (692)..(692): n is a, c, g, or t
tcagtacgagtatgcacgaccggtgctcgatttagtgtgagtagtttggctgagctggttttccttgttgctattttaaaaggtgtccagtgtgaggtgcagctggtggagtccggggagcttggtccagccgtgggggtccctgaaactctcctgtgcagcctcgtggttcaccttcagtgctctgctatgctacgtgggtcccgccgaggccgttaccggggaaaggcgtggaggttggggttggaccgttaagttaaggaaacgaccgtaaaaggtcctaaacgtaggttacgacgaacaggcaatagtggctggcggttcggagaaaggctaggttccacccggttcaccgaagtaaatgtaacttacgaaaagtaccgacggtcgtaatcgagaacaaaagtgaaaccacgtaccgtaaacggaaaaacccggnggaaccgaccgggtaccgttagttaactttacgtagtaaacgtagaacgtagggttacggtaagttacggtaggtttaggggtaacgttaggtacggaacgggtaaacgggggtaactacgtacgtacgtagtcggtacgtcggtacggacgaacggaccgtacgtccgtaccgtactccgtacacgtacccgtaccgaccgacgtccacgtaccgtcccgttcccgtcgaccctccctccgtaccacgtacncaccgtcgcggctaccgg

SEQ ID NO: 38393 - DNA, 626 bp, Homo sapiens
  misc_feature: GYAE6OF01ETSPQ.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtggtgaaaggcaggttcaccgtctccagaaatgattacaaagaacacggcgtatctgacaaatgaacagcctaagaaaacccgaggacacggccgtgtaacttacgtgtaactagacagggtgtagttacgtagtttagggggtagttatacggtacggtaaacgggggggtactaacgtacgtacgtagtcggtacgtcgtcgggaccgaagggacctacggtacaccgtccgtcctccgacgccctaccgaccgaacgggccctacgtccgttcccgttccccgtcgcccaccccgtccctaccgaacgaccgacacccgtcggtcggggccaccgg

SEQ ID NO: 38394 - DNA, 633 bp, Homo sapiens
  misc_feature: GYAE6OF01A25PQ.18.14.B03.1.454.CMB.1.raw
  modified_base (374)..(374): a, c, t, g, unknown or other
  misc_feature (374)..(374): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccggggaaaggctggagtgggttggccgtattagaagcaaagctaacagttacgcgacagcatatgctgcgtcggagaaaggcaggttcaccgtctaccaagaatgattacaaagaaccacggctatctagacaaatgaacagacctaagaaaaccgnggaacacggccgtagttacttacgtagtaactagacgaggtaggtattacgtaggtttggggtagttagtacggacggtaaacggggggtactacgtacgacgtagtacggacgtcgtacgggacgaacgggaccgaccggtaccaccgtcctacctcacgcctacccaaccgacggaccctacgtccggtcccgttccccgtcgaccctaccctcccgtacccgaacgaccgtaccgaccgtcggtcggggcgaccgg

SEQ ID NO: 38395 - DNA, 830 bp, Homo sapiens
  misc_feature: GYAE6OF01EQLG6.18.14.B03.1.454.CMB.1.raw
tcagtacgagtatgcacgaccggtgctcgatttagtgtgagtagtttggctgagctgggttttccttgttgctattttaaaaggtgtccagtgtgaggtgcagcgtggtggaggtccgggggaggtcttggtccagccgtcgggggtccctagaactctcctgtcgcacgcctcgttcgggttcctacccttcgaggttcggcttcgtgcttagtgactacgttcgggtcccgccgacggtccgttaccggggaaaggtcgtgggtaggttcggggttcggtaccgttaagttaaggaaacgaacgaaacgtaccgttaaacgtacggttaaccggaccgaacgacgactaagttacgtcggtcgttacggtcggttacgggtaaggtaaaacggccggttacggtttcccgacccggttacctaaccgaaagtaaacttacggtaacttaaaccggaaaacggtaacccggtaacggtacgttactaccgtagaaaccgtaaagtacggaacgtaaccgaacgtaaacggaaaaccggacgaccgtaccggtaccgttagtaactttaacgcgttaaacgagtaacgtaggtacgtaacgttaggttaggttagggtacgttacgtacgggaacgggtaacggggtactacggtacgtcgttagtcggtacggtacggtacgggaccgaacggacgtaccgtaccgaccgtcctaccgcctaccgcccgtaccgaccggacgccgtaccgtcccggtcccgtccccgtaccggtccctaccccgaccgaaccgacgtaccgacccgtaccgtcggaccgcgtacccggg

SEQ ID NO: 38396 - DNA, 270 bp, Homo sapiens
  misc_feature: GYAE6OF01EWFY7.18.14.B03.1.454.CMB.1.raw
  modified_base (261)..(270): a, c, t, g, unknown or other
  misc_feature (261)..(270): n is a, c, g, or t
tcagtacgagtatgcacgaccggtgctcgatttagtgtgagtagtttgggggagttagtcgcaaacgggggggtactactacgctatggacgtctgggccaagggaccacggtcaccgtctcctcagcctccaccaagggcccatcggtcttcccctggcaccctcctccaagagcacctctgggggcacagcggccctgggctgcctggtcaaggactacttcccatactcgtactgagcgggctggcaaggcgcatagnnnnnnnnnn

SEQ ID NO: 38397 - DNA, 797 bp, Homo sapiens
  misc_feature: GYAE6OF01EB27N.18.14.B03.1.454.CMB.1.raw
  modified_base (443)..(443): a, c, t, g, unknown or other
  misc_feature (443)..(443): n is a, c, g, or t
tcagtacgagtatgcacgaccggtgctcgatttagtgtgagtagtttgggctgagctgggttttccttgttgctattttaaaaggtgtccagtgtgaggtgcagctggtggagtcgtgggggaggcttggtccagccgtggggggtccctgagactctcctgtgcaggccctgctattcattctttaatagttattggatgctacgtcgggtccgccgaggcggtccggggggaaggggccggaggtcggggtcggaccaaactataatcgacaagtagtagggaactaggaagaaaacgtaactagtggtacgggaaccttcgtaggttacggaaacgggggcccctaatttccaacccttagtccctaccggaaggaacgaaccaaactaacgtaaaacggtaactttaccgtagtactcgtagaactaaaagtcgaaacncgccctagaacggacggtacccggaaggaaccgtcggctttaggtacgtttaagttaccggtggtaccggaacgtaaacgggacgtacggtaacgggtgggtaccggtacgggaactaggtacgggtaccgtcgggtacggggacccgaaccggggaccctaccgggtaccaacccgtctacccgtaccgaccgtaccccgtacccgaacccgaaccgggtcccctaacggttccccggttaccccgttcccccggtcggtaccccggtccccgtcggtacccgtacggaaccggaccgtaccccgtacccggtaccggacggacgcccgaacggccgggcccggttacccggg

SEQ ID NO: 38398 - DNA, 265 bp, Homo sapiens
  misc_feature: GYAE6OF01EH7P6.18.14.B03.1.454.CMB.1.raw
  modified_base (260)..(265): a, c, t, g, unknown or other
  misc_feature (260)..(265): n is a, c, g, or t
tcagtacgagtatgcacgaccggtgctcgatttagtgtgagtagtttggggagttatcgcaaacgggggggtactactacgctatggacgtctggggccaagggaccacggtcaccgtctcctcagcctccaccaagggcccatcggtcttcccctggcaccctcctccaagagcacctctgggggcacagcggccctgggctgcctggtcaaggactacttcccatactcgtactgagcgggctggcaaggcgcatagnnnnnn

SEQ ID NO: 38399 - DNA, 776 bp, Homo sapiens
  misc_feature: GYAE6OF01CFIBV.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggagcttggtccagcctggggggtccctgaaactctcctgtgcagcctctgggttcaccttcagtggctctgctatgcacgtcgggtccgccgagggtccgttaccggggaaagggctgggtaggttggggttggaccgttagttagaaagacaaaagctaaacgagttacgcgacagcaatagtgactggcgtggtaggaaaggtctaggtcaccgtctaccgaagtaaactgaacttacgaaaagacgacggtacgtactcgtagacaaaagtacgaaacgtacgacccgtaaagaaaaacccggaggaccgtaccggtcggttagttaacttacgtagtaactaacggacgagggttaggtaatttacgtaggtttagggggtaagtttaacggtacggtaacggggtaaacggggggttacctaacgtacggtacgtaacggtacggtaccggtcggtacggggaccgtaaaccggggaccgtaacggtacccgtaccggtacctcccgtacgtaccgcccgtacccgaaccggaaccggtcccgtacgttacccggttacccgttcccccggtacggtacccctccccgttacccgtaaccgtaacccgacggtaccctaacccggtccgggtccggggtaccgaacccggg

SEQ ID NO: 38400 - DNA, 654 bp, Homo sapiens
  misc_feature: GYAE6OF01CKRDQ.18.14.B03.1.454.CMB.1.raw
  modified_base (283)..(283): a, c, t, g, unknown or other
  misc_feature (283)..(283): n is a, c, g, or t
  modified_base (346)..(346): a, c, t, g, unknown or other
  misc_feature (346)..(346): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggagcttggtccagcctggggggtccctgaactctcctgtgcagcctctgggttcaccttcagtggctctgctatgcacgtgggtcccgccagggcttccggggaaagggctggagtgggttggccgtattagaagcaaagctaacagttacgcgacagcatangctgccgtggtagaaaggctaggttccaccgtctaccgaagaaatgattacaaagaacacggngtaatctagaccaaatcgaacagacctagaaaccggagacgacggcgtagtatactagtactaaggacgtagggtaggtaattacgtaggtttagggggtagtttacgtacggtaacgggtaaacgggggggttaactacggtacgtacgttagtcggacgtacgtcgggaccgaacgggtacgaccggtacaccgtacgtcctaccgcgtaccctccgaaccgacggcccacgttccggtacccgttccccgtcggaccctcccctccgtacgaacgtaccgactaccgtcggtcgggctaacccgg

SEQ ID NO: 38401 - DNA, 655 bp, Homo sapiens
  misc_feature: GYAE6OF01C1M3F.18.14.B03.1.454.CMB.1.raw
  modified_base (276)..(276): a, c, t, g, unknown or other
  misc_feature (276)..(276): n is a, c, g, or t
  modified_base (381)..(381): a, c, t, g, unknown or other
  misc_feature (381)..(381): n is a, c, g, or t
tcagtacgagtatgcacgaccggtgctcgatttagtgtgagtagtttgggctgagctgggttttccttgttgctatttttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccggggaaagggctggagtgggttggccgtattagaagcaaagctaacagttacgcganagcatatgctgcgtcggtagaaaggcacggttcaccgtctaccaagaatgatacaaagacacggactatctgacaatgaacagcctagaaacgagacacggcgtntacactgtactagacaggtgattagtagtttggggtatagtcgacgtaagggtagggggggtaactacgtacgtacgtagaggtacggtcgtacggggaccgaacgggacccgacggtaccgtacccgtcctccgtcgaaccgtcctacccaacccggtaaccgggacccgtacgtcccggtttccccgttaccccgtaccggtacccctacccccgttaccccgaacccgtaacggtaccgaccgtaacccggtcgggtcccgggggtaaccg

SEQ ID NO: 38402 - DNA, 659 bp, Homo sapiens
  misc_feature: GYAE6OF01DO0H1.18.14.B03.1.454.CMB.1.raw
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (510)..(510): a, c, t, g, unknown or other
  misc_feature (510)..(510): n is a, c, g, or t
  modified_base (561)..(561): a, c, t, g, unknown or other
  misc_feature (561)..(561): n is a, c, g, or t
  modified_base (651)..(651): a, c, t, g, unknown or other
  misc_feature (651)..(651): n is a, c, g, or t
tcagtacgagtatgcacgaccggtgctcgatttagtgtgagtagtttgggttcgggggaggcttggtccagcctgggggtccctgaaactctcctgtgcagcctctggttcaccttcagtggctctgctatgcacgtgggtcccgccagggtccgttacccggggaaagggcttgggaggttggggttggccgtattagaagcaaagctaacagttacgcgacagcatatgctgcgtcggtagaaggctaggttccaccgtctacagaatgatacgaagaacgcggntatctgacaatagaacncgaccgtaacgaaaccggacggaacgacggtccgttagttaacttacgtagtacgtaacgacgtaggtagtacttagtaggtttaggggtatacggcggaacggggtaacgggggttactaccggtacgagtacgtcggtacgtcggtcgggacgacggaccgtacgtccgtactcctcgacctcgcctacccgaacgaccgaccngttcccgttacccgtcccgtaccgcctaccccttacgaccgaacgctaccnccgtacggtcggactacgccgccgtcggtacggtctcgacgtcgacgtaccgtctaccgtcaccgtacgtcgtacgtggaccggcgtcgngcgtacgg

SEQ ID NO: 38403 - DNA, 751 bp, Homo sapiens
  misc_feature: GYAE6OF01CWAHB.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggaggtccggggggaggcttggtccagccgtggggggtccctgaaactctcctgtgcagcctctgggttcaccttcagtggctctgctatgcacgtcggggtcccgccgagggcctcccgaagggggaaggggcctgggagtggatctctacttatttatagtggtgtaccacatactacacagactcgtaggaagggccgattcaaccatcctacaagaacgaacaacttccgaaggaacactattgtaattcttacaaatagaaactaacctgagagcgagacgacggaccatgtattacgtggtggtcggggactagtttacgttaccggaccccggtcgggggcccgggtaacccgtcgggtaccctaacccggttccctacccccgacccctacccgaaccccgaaccgggacccctaacgttccccgggtttaccccttccccccggttccggacccctacccccgttaccctacccgaaacgtaccgcccgtaacccgtccggtacggggggccctaacggccggtcccgggcccggttaccggggtccgttccgggacccggttcgggtacccgtaaacgggtacccctttacccgttaccccgtaacttacccgttccggttacgtaccgggg

SEQ ID NO: 38404 - DNA, 264 bp, Homo sapiens
  misc_feature: GYAE6OF01ESB0I.18.14.B03.1.454.CMB.1.raw
  modified_base (262)..(264): a, c, t, g, unknown or other
  misc_feature (262)..(264): n is a, c, g, or t
tcagtacgagtatgcacgaccggtgctcgatttagtgtgagtagtttgggggagttatcgcaaacgggggggtactactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttcccatactcgtactgagcgggctggcaaggcgcatagnnn

SEQ ID NO: 38405 - DNA, 893 bp, Homo sapiens
  misc_feature: GYAE6OF01ALNQZ.18.14.B03.1.454.CMB.1.raw
tcagtacgagtatgcacgaccggtgctcgatttagtgtgagtagtttgggctgagctgggttttccttgttgctaattttaaaaggtgtccagtgtgaggtgcagctggtggaggtccggggggaggcttggtccagccgtggggggtccctgaaactctcctgtgcacgtcctcgtgggttccaccttcaggtggctctgctatgcacgtcgggtccgccgaggtccgttaccggggaaaggcgtgggaggttggggttcggccgttaattaaggaagacaaagtctaacgtaggttacgcgacagacattagtcgcgtggtaccggtacgggaaggtaaacgggccgttacggttccccaacccgttcctaaccgaaagtaaacgtacgtaacgttaaccaaaaacggaccgtaaccgggtacgttaacgttccgtaacgaaacgtaaaagttacggaaaaccgtaaccggtaacccggtaaaacgggaaaaacccgggacgggtaaacccggtaccgggtaccgtttaagttaaccgtttaacggttacggtaaacgtaacggtacgggtaagggttacggttaagttaacggttagggtttaacgggggtaagttacggtacgggtaacggggtaaccgggggttactacgtacgtcgtaggtacgggtacggtcggtacggggaccgaacgggtacccgtaccggtaccctaccgtaccctccgtaccgtacccgacccctaccggaaacccggtaccggtacccgtaccgttccccggttacccccgttccccggtacccggtaccccttacccccgtacccgttaaccccgaaacggtaccccgacccgtacccggttacggggtcccgggaccctaaccccgggg

SEQ ID NO: 38406 - DNA, 247 bp, Homo sapiens
  misc_feature: GYAE6OF01EEWHF.18.14.B03.1.454.CMB.1.raw
  modified_base (243)..(247): a, c, t, g, unknown or other
  misc_feature (243)..(247): n is a, c, g, or t
tcagtacgagtatgcacgaccggtgctcgatttagtgtgagtagtttgggggggtactactacgctatggacgtctggggccaagggaccacggtcaccgtctcctcagcctccaccaagggcccatcggtcttccccctggcaccctcctccaagagcacctctgggggcacagcggccctgggctgcctggttaagactacttcccatactcgtactgagcgggctggcaaggcgcatagnnnnn

SEQ ID NO: 38407 - DNA, 949 bp, Homo sapiens
  misc_feature: GYAE6OF01BOC6G.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagccgtcggggggtccctgaaactctcctgcgcagcctcgttgggttcaccttcagtggctctgctatgctacgtcgggtccgccgagggtccgttaccggggaaaggtcgtgggtaggttggggttcggtacccgttaagttaaggaacgacgtaaaacgacctaaacgtaacggttaccgacggaacgtacggtacaagttacgtcggtccgttacggtccggttacggggtaaggtaaaacggggtccgtaacgggtttaccccgacccggttacctaacccgtaaaggtaaaacgttcggtaaactttaaccggaaaaaccggtaccgtaacggggttacctaaggttccgttaacggtaaacctaaaggttaccaaacggaccgttaacccgtaaacgggaaaaacccggacggtaacccgtaccgggtaccgtttaaggttaacgtttaccgtaacgttaacggtaaacgtacggtaggggttacggttaagtttacggtaagggttttgggggtaacgtttacggtaccgggtaaaccggggttaaaccgggggttaacctaacgttaccgtaacgttaaggtaccgggtacggtccgggtacgggggaacccgtaaccgggtaaccgtaccgggtaccgtacccgttaccgtaccccgtacggtaccgccccgtaccgaacccgggaccggtacccgtaccggttcccggtttaccccgttccccggtaccgtacccgtcccccgttacccaacggtaacccggtcccgacccgtacccgggtacccggttcgggaccctaacccgggg

SEQ ID NO: 38408 - DNA, 622 bp, Homo sapiens
  misc_feature: GYAE6OF01EM46N.18.14.B03.1.454.CMB.1.raw
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggagaaaggctaggttcaccgtctccaagaatgattacaaagacacggactatctagacaaatcgaacacgcctaagaaaaccgnggacacggccgtgtattacgngtacagacgaggtagattacgtagttggggagttagtcgacggaacgggggtactacgtacgacgtagtcggtacgtcgtcgggaccgaacgggaccgaccggtaccgtaccgtcctacctaccgacgtccctaccgaccgaacgggacccgacgtccgttcccgttccccgtcgccctacccctaccctacccaacgtacgacctacccgtcggtcggggcaccgg

SEQ ID NO: 38409 - DNA, 829 bp, Homo sapiens
  misc_feature: GYAE6OF01DW31I.18.14.B03.1.454.CMB.1.raw
tcagtacgagtatgcacgaccggtgctcgatttagtgtgagtagtttgggctgagctgggtttccttgttgcttattttaaaaggtgtccagtgtgaggtgcagcgtggtggaggtccgggggagtcgttggtccaggccggtgggggtccctagaaactcctcctgtcgcacgccttcgtgggttacctaccgttcgaggtcggctctgtctatcgctacggtcgggtacccgccgaggtccggttaccggggaagggcgttaggggtaggttggggttcgtaccgttaagttaacggaaacgaacgaaacgtctaaacgtaacggttacgaccggaacacgtactaataggtcggtccgtggtccggtaggtaaggaacggtcgtacggttccgaccgttacgacgaaagtaagtctaaaccgttaaacgaaacgtaaccggtacggtacgttactaggtaacgaaactaaaggtacgaaaccgaacggttaccgaaaacggaaaacccggtaggaccccgttaggtacccgtttaagttaacgttacggtacggtagaacccggggtaaatcggtacgtagggtaccggtacggtaacgggtaacgtacgggtacgggtaccggtacggggtaaccgggaaccggaaccgggtacccgtaaccggttcccgtaaccgtcccgaccgtcgacccgtccgaacccgtaacgcccggtaccgtccgttcccggttccacccgtcggtacccgccgttccgaccgccgaacgtcccgtactacccggagccgacgaccgtaccggcgacccgtcggtgcccgtaaccggg

SEQ ID NO: 38410 - DNA, 766 bp, Homo sapiens
  misc_feature: GYAE6OF01EPRL0.18.14.B03.1.454.CMB.1.raw
  modified_base (360)..(360): a, c, t, g, unknown or other
  misc_feature (360)..(360): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcacgtgggtccgccgaggccgttaccggggaaagggcgtgggaggttggggttggaccgtagttagaagacaaagctaacgagttacgcgacagcatatgctgcgtcggtagaaaggcaggttcaccgtctaccagaatgattacaaagacgacggtcgtatntgacaaagtgaacacgtaccgtaaggaaaaccgaggtaaccacgggtaccgttagttaactttaacgtaggttaacgtaaggtaaccggtaaggggttacgggttaacgtttaaccggttaaggggtttttaggggggtaagttttaacgggtaccgggtaaaccgggggtaaacgggggggttaacctaaccggtaacgtacgttacgtacgggtacggtcggtacggggacccgaacgggacccgacggtaccgtacccgtccgttaccgttaccgacgtacccgtacccgaacccgtaaccgggacccgtacgttcccggtccccgttcccccgtacgtccctacccctacccgtaccgaaacggtccacccgtacccgtccgggtcggggtaccaacccggg

SEQ ID NO: 38411 - DNA, 673 bp, Homo sapiens
  misc_feature: GYAE6OF01A54M8.18.14.B03.1.454.CMB.1.raw
  modified_base (381)..(381): a, c, t, g, unknown or other
  misc_feature (381)..(381): n is a, c, g, or t
tcagtacgagtatgcacgaccggtgctcgatttagtgtgagtagtttgggctgagctgggtttccttgttgctattttaaaaggtgtccagtgtgaggtgcagctggtggagtccgggggagcttggtccagccgtgggggtccctgaaactctcctgtgcagcctctgggttcaccttcagtggctctgctatgctacgtgggtcccgccgaggccgttaccggggaaagggtcgtagggtaggttggggttcggtccgttaattaaggaagtacaaaagtctaaacgtagttacgcgacagcaatagtgctggacgtcggtagaaacggtcgtaggttccaccgtcaccgaagtaatgtattacgaaagacgtacggtntactcgtagaactaactcgaactacgaccgtaacggaaacgcgacgacggtctagttaactacgtagtaacgtagacgtacgggtagtagttacgtagggttagggtagttacggtacggacgggtaacgggggtactacgtacgacgttagcggtagtcggcggacgacggcgtacgtcctaccgtctccgacgcgaccgaccgaccgacggcccgtcgtcccgttacccgtcccgtaccgccctccctacctaccgaacgtccaccgtaccgtcgtcgggacctaccggg

SEQ ID NO: 38412 - DNA, 792 bp, Homo sapiens
  misc_feature: GYAE6OF01EO0ZP.18.14.B03.1.454.CMB.1.raw
  modified_base (163)..(163): a, c, t, g, unknown or other
  misc_feature (163)..(163): n is a, c, g, or t
tcagtacgagtatgcacgaccggtgctcgatttagtgtgagtagtttgggctgagctggtttccttgttgctatttaaaggtgtccagtgtgaggtgcagctggtggagtccggggaggcttggtccagccgtgggggtccctgaaactctctgtgcagcctntggtacaccttcagtcgctctgctatgcctacgtcgggtcccgaccgaggtccgttaccggggaaaggtcgtgggtaggtggggttacgaccggttaattaagaacgacgaaacgtacctaacgtagttaccgacgaaccgagtcaagttagtcgctcggtacggtacgggtaagaaacggtccgtacggttaccaccggttccacgaagtaagtgtaactaacgaaacgacgtacgtacgtatacgacgactaatacgaacacgaccgtaaacgaacggagaccgtacggtactagtacttaccgtagtaacgtacgaacgtaggttacgtaacgttaggtttacggttaggggtaacttaacggtacgggtaaaccgggtaaacggggttacctaaccgttaacggtcgtaaacggtccggtacggtaccgggtacggggaaccgtaaacgggaccccggtaacggttacccgtaccgttaccctaccggtaccgtccgtacccgtaaccccggtaaccggaacccgggtaccctaccgggttccccgttaccccggtcccctggtacccctaccggtccctaaacgccgtaaaccgcccgtaaccggcgggtaccgcggtaacccg

SEQ ID NO: 38413 - DNA, 659 bp, Homo sapiens
  misc_feature: GYAE6OF01AIE4C.18.14.B03.1.454.CMB.1.raw
  modified_base (321)..(321): a, c, t, g, unknown or other
  misc_feature (321)..(321): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccggggggaggcttggtccagcctggggggtcccttagactcccctgtacagcctctggattcactttcagtaaggcctggatgaactgggtccgcaggctccgaggggaagggctggagtggggttggaccgtaattaaaaccaaaatgatgggtgggacaacagactacgctgcacccgtgaaaggcagattcacatcacaaganatgatacaaaagcacgctgtatctagacaaatcgaacacgcctaggaacgaaccgaggaaccacgacgccgtagtaacttactacgtaacccactactaccccgtagaacgtcgtacaacttactaactacgtaacgtatacggaccgtcgtcggggaccgaacgggacccgtacggtccctaccgtctacccgtacacgaccctaccgaacccgtaacggccctacgttcccggtcccttacccccgtcggacccgtccccgtcgtcccgtacccgaggaccgaccctacccggtcgaacgtaccggaccaacggccggcccgggtcccgtccgggg

SEQ ID NO: 38414 - DNA, 681 bp, Homo sapiens
  misc_feature: GYAE6OF01EGGJ7.18.14.B03.1.454.CMB.1.raw
  modified_base (209)..(209): a, c, t, g, unknown or other
  misc_feature (209)..(209): n is a, c, g, or t
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
tcagtacgagtatgcacgaccggtgctcgatttagtgtgagtagtttgggctgagctgggttttccttgttgctattttaaaggtgtccagtgtgaggtgcagctggtggagtccgggggagcttggtccagcctgggggtccctgaaactctcctgtgcagcctctgggttcaccttcagtggctctgctatcgcacgtcgggtcccnccaggccgttccggggaaagggctgggacggtggggttcggccgttattagaagacaaagctaacagttacgcgacagcatatgctgcgtacggtagaaggctaggttcaccgtctaccagaatgattacaagacacggctatctagacaatgaacgcgacctagaaacccgnggacgacggctgtatacngtactagacgaggtgtattacgtagttaggggtagttacgtacggacgggaaacgggggtactacgtacggacgtacgtaggacgtacggtacgggaccgaacgggaccgacggtaccgaccggttcctcccgtaccgaccgtcccgtacccgaccgtaaccgggtccctaccggttcccggttaccccgttccccccgtcggaccccgttacccccgttcccgtaacccgaaccggtacccgtaccgtaaccccggttcgggtccggggcctaacccggg

SEQ ID NO: 38415 - DNA, 688 bp, Homo sapiens
  misc_feature: GYAE6OF01BIFXK.18.14.B03.1.454.CMB.1.raw
  modified_base (208)..(208): a, c, t, g, unknown or other
  misc_feature (208)..(208): n is a, c, g, or t
  modified_base (280)..(280): a, c, t, g, unknown or other
  misc_feature (280)..(280): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggagcttggtccagccgtgggggtccctgaaactctcctgtgcagcctctgggttcaccttcagtggctctgctatgcacgtgggtccnccaggcttccggggaaaggctggagtgggttggcgtattagaagcaaagctaacagttacgcgacagcatangctaggcgtcggtagaaaggctaggttcaccgtctccaagaaatgattacaaagacacggngtanctagactaaatgaacagcctaaggaaaaccgaggaccacgggtcctagtaacttacgtagtaccgtaagactagggtaggtattacgtagtttcggggtagttacgtacggacggtaacggggggtactacgtacgacgtaagtcggtacgtcgtcgggtaccgaacgggaccgaccggtaccgtacccgtccgtcccgtacgtacgaccctacccgaaccgaccgggtaccctaacggtacccggttaccccgttccccccgtaccgggacccctcccccgttacccgacccgaaacgtaccgtaccctacccggttccggtaccgggggtaccaacccggg

SEQ ID NO: 38416 - DNA, 736 bp, Homo sapiens
  misc_feature: GYAE6OF01AVEUP.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccggggggaggcttggtccagcctggggggtccctgaaactctcctgtgcagcctctgggttcaccttcagtggctctgctatgcacgtgggtccgccaggccgttaccggggaaagggctggaggtggggttggccgtattagaagacaaagctaacagttacgcgacagcatatgctggcgtcggtagaaaggcaggttccaccgtctaccaagaaatgattacgaaaagaccacggtcgtatcgtagactaaatgaacagacctaacggaaaaccgaggaaccgacggtaccgttagtaacttacgtacgtaactaacggacgtagggtaggtaagttaacgtaggtttagggggtaagttacggtacgggtaacggggtaaacgggggggttacctaacgtacgtacgttagtacgggtacggtacggtacggggaccgaacgggaaccgtaccggtaccgtacccgtccgtacccgtccgaccgtccccgtacccgacccggaaccgggtaccctacggtacccggttcccgttcccccgtaccggtacccctaccccgtccccgtacccgaacgtacccgacccgtacccggtccgggtccggggcgtaacccggg

SEQ ID NO: 38417 - DNA, 958 bp, Homo sapiens
  misc_feature: GYAE6OF01CC9AW.18.14.B03.1.454.CMB.1.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (923)..(923): a, c, t, g, unknown or other
  misc_feature (923)..(923): n is a, c, g, or t
  modified_base (958)..(958): a, c, t, g, unknown or other
  misc_feature (958)..(958): n is a, c, g, or t
tcagtacgagtatgcacgaccggtgctcgatttagtgtgagtagtttagggtttgggggctttgcctgggcccagtctgccctgacgtcagcctgcctccgtgtcctgggtctcctggaccagtcgatcaccatctcctgcactcgggaacccagctaggtgacggttggtggttaataactatcgtccgtcctggtaccaacgacgccacccgaggacaaaccgcccctaaactcgatgtagttaangagtntactactaacgtccggtcccgttgttacggggttactaagtccggtcttactccgtggtacctaccgaacgttcgtacgggactaaaccgtaccgggtccccttaccccgttaggaaaccctcgttccggtacgtccggggtacccctaccgggtacggtccggtaaggaccgggtaaccggtgggtaccgttaggtaacttttaaacctttcggacgtacccgtaacggttcgtaactaatttaacccgaaacgttaccgggaccctaaccggaaaggtccctaacccggtttacgttaccgtttaggttaccggtttaccggtaaccgggggttaaacccgttcgggggtaaaaccccgttaccgggggttaacccccttaaacccgggttaccggtttaaaacggggttaaccccggaaaccccctaacccgggtaaaccccccgaaacccccggttgtttaaccccggtacccgttacccgtttaccccccggggttaacccgttttccccccccgggtaaccccgtttaccccggtaacggtttaccccccggttaaaccgggttcccgttaaaacccgggggttcggtaaacccggggtcccgggaccggtttaaccggggaccgtaaacccgggggtcccctaaagggttaccgccgggtaanccggtacttccaaacgcccttccctatccccggtn

SEQ ID NO: 38418 - DNA, 798 bp, Homo sapiens
  misc_feature: GYAE6OF01AEQYO.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagccgtggggggtccctgaaactctcctgtgcagcctcgtgggttcaccttcagtggctctgctatgctacgtcgggtcccgccgaggtcgttaccggggaaagggcgtgggaggttgggttggtccgtaagtagaagacaaagtctaacgagttacgcgacagacatatgacgtggacggtcggtagaaacggtcgtacggttccacccggtctaccgaagtaatagtaataacgaaaacgacgacggtacgtatactagaactaaagtcgaaccgacgtaacctaaacgggaaaaccggacggtaaccgtccgggtacgttagttaacgttactacggtaacgtaagacggtaggttacgtaattacggtaggtttaggggtacgttacgacgggtaaccggggtaacgggggtacctacgtacgtagtacggtcggtaccgtgggtacgggaaccggtaacgggcccgtaaccggtaccgtacccggtccctaccgtccgaccgtaccccgtaaccgggaacccgtaaccgggtccccgtacccggttcccggttcccccgttacccccggtacccgttcccccgtacccccgttaccccgtaacccggaaccggtacccgtacccgtacccgggtccggggtaccgggccgtaaccccgggg

SEQ ID NO: 38419 - DNA, 574 bp, Homo sapiens
  misc_feature: GYAE6OF01E38TW.18.14.B03.1.454.CMB.1.raw
  modified_base (285)..(285): a, c, t, g, unknown or other
  misc_feature (285)..(285): n is a, c, g, or t
  modified_base (384)..(384): a, c, t, g, unknown or other
  misc_feature (384)..(384): n is a, c, g, or t
  modified_base (452)..(452): a, c, t, g, unknown or other
  misc_feature (452)..(452): n is a, c, g, or t
  modified_base (538)..(538): a, c, t, g, unknown or other
  misc_feature (538)..(538): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccggggggaggcttggtccagcctggggggtccctgaaactctcctgtgcagcctctgggttcaccttcagtggctctgctatgcactgggtccgccaggcttccggggaaagggctggagtgggttggccgtattagaagcaaaagctaaacagttacgcgacagcatangctgcgtcggtgaaaggcaggttcaccgtctccagaaatgattcaaaagaacacggctatctagcaaatgaacagcctagaaaaccgaggacacggctntatactgtactagacaggtgatacagttggggagttagtacgacgaaacggggggtactaacgtacgntatggacgtcgtgggaccgaagggaccgacgtccaccgtctcctcacgcctaccaccgaacggccatccggtcctccccgtgcccnccctcctacccaagacgacaccgtcgtggggcgacg

SEQ ID NO: 38420 - DNA, 784 bp, Homo sapiens
  misc_feature: GYAE6OF01CFX0T.18.14.B03.1.454.CMB.1.raw
  modified_base (267)..(267): a, c, t, g, unknown or other
  misc_feature (267)..(267): n is a, c, g, or t
tcagtacgagtatgcacgaccggtgctcgatttagtgtgagtagtttgggttcgggggaggcttggtccagcctggggggtccctgaaactctcctgtgcagcctctgggttcaccttcagtggctctgctatgcacgtgggtccgccaggcgttccgggaaagggctggagtgggttggccgtattagaagcaaagctaaacagttacgcgacagcatatgctgcgtcggtagaaaggctaggttcaccgtactcagaaatgatanaaaacgacacgcgtatactgacaatagaacacgacgtacgaaacgaggacgacggcgtagtatactagtacagacgaggtgagttagtagtttgggagttagtacggacggtaaacggggggtactacgtacgtacgtagtcggtacgtacggtacggggaccggtaaacgggacccggtaaccggttaccgtacccgttccgttacccgtaccgaccgtaccccgtacccgaaaccccggtaaccgggtaccccgtaacgttccccgggtttaccccgttcccccgttccgggtacccctaaccccgttacccgtacccgtaaacggacccgaccgtaacccggttaccggtacccggggtacccgaaccgtaccgggccccggtcccgggttccggggccttaccgggcccgttacgggtaacccgtaaccgggtaaccttacccttaaccccgtactttaacccgtacgttacgttacgggacccggtcgggaccgtcgggtccggtaaacggg

SEQ ID NO: 38421 - DNA, 986 bp, Homo sapiens
  misc_feature: GYAE6OF01AEJGI.18.14.B03.1.454.CMB.1.raw
  modified_base (796)..(796): a, c, t, g, unknown or other
  misc_feature (796)..(796): n is a, c, g, or t
tcagtacgagtatgcacgaccggtgctcgatttagtgtgagtagtttgggctgagctgggttttccttgttgcttaattttaaaaggtgtccagtgtgaggtgcagtcgtgggtgggacgggtccgggggaggtcgttcggtccaggccggtcgggggtccctagaaacctccttccgtgtcgctacgtccgttcggttcggttacctaccgttcgaggtcgtctcgtcgtactagtcgtcgtacggtcgggtacccgccggtacgggtaccggttaaccggggaaacgggtcgttagggtacgggttcggggttaccggtaccgttaagttaacggaacgaaccgtaaaacgtaccgtaaaaccgttaccggtaaccggaccgaacgtacgtacgtaacgttacgtcggtccggttacgggttaaccgggttacggggtaaacggtaaaccggtccggttaaccggttaccccgtaacccggttaccgtaaaccggtaaagtaacgttacgtaaaccgttaaacggaaaaccggtaccggtacggtactacttacgaacgtaaacgtaacgacggtaaaccgtaacgtaaccggaaaaccggtaacccggacggtaccggtaaccggttacgttacggttaaccttacggtactaacggtaacggtacggtacggttaacgggttaagtacggtttaacgggggttacgggttaacgtaccgggtaaccggggttaaaccgggggtaacggttactaaacggttcgggtaacttaacggggtccgggttaaccgnggggtaacccggtaccggaaacccggtccggtacttaccccggttaccgtcgtaaccccggttaccacccggtaccccgtaaggcccggtaaccgtccggttaccccgtcccggttaccccggttcgacccgtcccgttacgacggtaccccgtacggacccaccccgttagggcccctaggaccgtccg

SEQ ID NO: 38422 - DNA, 852 bp, Homo sapiens
  misc_feature: GYAE6OF01A6BNY.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtccctgaaactctcctgtgcagcctctgggttccaccttcagtggctctgctatgcacgtgggtccgccagggccgtttacccggggaaagggtcgtgggaggttcggggttcggccgttaattaggaagacaaagtctaacgacgttacgcgacagcatatgctgcggtcggtgaaacggcgtacggttcacccgtctaccgaagtaaagtgaacttagaaaacgaaccacgggaccgttaactcgttagaacctaaaagttacggaaaccgtaacgacccgttaaacgggaaaaacccgggaagggtaaacccggtacccgggtacccgggttagtttaaacgtttacccgtaagggtttaaacccgttaacggaacccgttaagggggttacggttaacgtttaaccgttaaggggttttacggggggtaaggttttacgggtaacgggtaaccggggtaaaccgggggggttaaccttaacccggtacgtacgttagtaccgggtaacggttccggtacggggacccgtaacgggaacccgaccggttaccgtacccgttaccgtacctcgtacgtcccctaccggacccgaaccgggccctaccggttccggtacccgtttcccccgtcgtccccgtaccccctacccgtaccgaaaccggtaccgtacccgtacccgttccgggccggggtacccgtacccggg

SEQ ID NO: 38423 - DNA, 686 bp, Homo sapiens
  misc_feature: GYAE6OF01EZIQS.18.14.B03.1.454.CMB.1.raw
  modified_base (390)..(390): a, c, t, g, unknown or other
  misc_feature (390)..(390): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcacgtggggtccgccgaggccgttaccggggaaaagggcgtgggaggttggggtttcggccgttagtttaaggaagacaaaagctaaacagtttaccgcgaacagcaatagtgctggcgtcggtagaaaaggcaggttcacccgttctaccaagtaaatgaattaccgaaaagaaccgacggtcgtaatctanacgaaaatcggaaacacgacccgtaagaaaacccggaggaaccgaccgggccgtagttaactttacgtgtaactaaggacgtaggtgtaagttacgtaggtttgggggtagttagtacggtacggtaaacggggggtactacgtacgtagtagtggtacgtcggtcgggacgaagggaccgacggtccaccgtcgtacctcgacgccctaccgaccgacgggccctacgtcccggttccctccccgtcggaccctccctccctaccgacgtacgacaccgtcggtcgggcgaccgg

SEQ ID NO: 38424 - DNA, 287 bp, Homo sapiens
  misc_feature: GYAE6OF01B2CLE.18.14.B03.1.454.CMB.1.raw
  modified_base (270)..(287): a, c, t, g, unknown or other
  misc_feature (270)..(287): n is a, c, g, or t
tcagtacgagtatgcacgaccggtgctcgatttagtgtgagtagtttgggggagttatcgcaaacggggggggtactactacgctatggacgtctgggggccaagggaccacggtcaccgtctcctcagcctccaccaaggggcccatcggtccttccccctggcaccctcctccaagagcacctctgggggcacgagccggccctgggctgcctggtcaaggactacttcccatactcgtactgagcgggctggcgaaggcgacatagnnnnnnnnnnnnnnnnnn

SEQ ID NO: 38425 - DNA, 335 bp, Homo sapiens
  misc_feature: GYAE6OF01B10VL.18.14.B03.1.454.CMB.1.raw
  modified_base (305)..(335): a, c, t, g, unknown or other
  misc_feature (305)..(335): n is a, c, g, or t
tcagtacgagtatgcacgaccggtgctcgatttagtgtgagtagtttgggggagttagtcgcgaaacgggggggtactactacgctatggacgtctggggccaaagggaccacggtcaccgtctccctcacgcctccaccaagggtccccatcggtcccttccccgtggaccacccctcctaccaaagagccaccttcggcgggggacaacgaggcccggtcccgtggggctcggcctgggtaccaaggtaccttacttcccattaccgtcgtactggagccgggtctggacaagggcatagagnnnnnnnnnnnnnnnnnnnnnnnnnnnnnnn

SEQ ID NO: 38426 - DNA, 902 bp, Homo sapiens
  misc_feature: GYAE6OF01B8M8Y.18.14.B03.1.454.CMB.1.raw
  modified_base (212)..(212): a, c, t, g, unknown or other
  misc_feature (212)..(212): n is a, c, g, or t
tcagtacgagtatgcacgaccggtgctcgatttagtgtgagtagtttgggctgagctgggtttccttgttgctattttaaaaggtgtccagtgtgaggtgcagctggtggagtccgggggagcttggtccagcctggggggtccctgaaactctcctgtgcagcctcgtgggttcaccttcagtggctctgctatgctacgtcggggtcccnccgagggccgttacccgggggaaaagggcgtagggaggttggggttcggaccgttaattaaggaaagaccaaaagtacctaacgaaggttaccgacgaacgagtacaataagtcgcgtcggtacggtacgggtaggaaaacggtcgtacgggtttaccacccggttactaccgtaaaaggtaaacttaggtaaactttaaaccgaaaaaaccggtaacggtaaccgggtacgtttaacgtacgttaacgaaaccgtaaaaagtcggaaaacctacggtaacccgttaaagggaaaaaaccccggaggacccgaaaccgggttccgttaaggttaaacttaacgtaacgttaacgaaaggtacgtaaagggttagttaaacgttacggttaagggttttacgggggtaacgtttaacgggtaccgggtaaacggggtaaacggggggttaaccttaacggtacggtaacgttaaggtacggggacgttacggtacggggaaccgtaacgggaaccggtaaccggtaccgtacccggtctacccgtacgaccgtaccctaccgaaccggaccggtaccccgtaccgttcccggttccccgttcccccgtccgggtacccctaacccccgttcctaaccggaaccgtaccggtaccccgacccggttcgggaccggggacccgtaaacccggg

SEQ ID NO: 38427 - DNA, 859 bp, Homo sapiens
  misc_feature: GYAE6OF01BKTR4.18.14.B03.1.454.CMB.1.raw
  modified_base (311)..(311): a, c, t, g, unknown or other
  misc_feature (311)..(311): n is a, c, g, or t
  modified_base (829)..(829): a, c, t, g, unknown or other
  misc_feature (829)..(829): n is a, c, g, or t
tcagtacgagtatgcacgaccggtgctcgatttagtgtgagtagtttgggctgagctgggttttccttgttgctaattttaaaaggtgtccagtgtgaggtgcagctgggtggacggtccgggggagtcgttggtccaggccgtgggggtccctgaaactctcctgtgcagccttcgttggttccacctttcaggtcgtctctgtactatgccgtacgtcggtccgcgacggtcgtaccggggaaggtcgtggtaggtgggttacggacgttagtaggaagacgaaacgtactaagacgttacgaccgaancgtataagtatcggcgttacgggtccgtaggggaagaaacggtacgtacggttaccctacccgttacctaacgtaaagtaaaacgtagtaacttaaacggaaaacgtaaccgtaccggtacgtacgttacgttagaaacaaaacgtacggaaaccggaacgaacccggtaaaacgggaaaaacccgggacggtaaccggtcccgggttaacttaggttaacgtttaaccgtagttaaccgaaggaacggtttacggttaaggttacggttaaggtttacggggtttaggggttaacgtaccgggttaacgggaaaccgggggtaaacgggggttaaccacggttaacgtaggttacggtcggaacggttcggaacgggaccggtaaccgggaccgtaaccgtaccgtcccgttacgtacccgtacggcctacccgaacgtaccggaacccggttcctaccgtttaccccgggttccctcccggttacaccccggtcccctaagtaacccgacgtaccncgtaaccgtcgggtaaccggcgtaaccggg

SEQ ID NO: 38428 - DNA, 689 bp, Homo sapiens
  misc_feature: GYAE6OF01AUCLB.18.14.B03.1.454.CMB.1.raw
tcagtacgagtatgcacgaccggtgctcgatttagtgtgagtagtttgggctgagctgggtttttccttgttgctattttaaaaggtgtccagtgtgaggtgcagctggtggagtccgggggaggcttggtccagcctggggggtccctgaaactctcctgtgcagcctctgggttcaccttcagtggctctgctatgcacgtgggtcccgccgagggcgttaccggggaaagggcgtgggaggttgggttcggccgtattagaagcaaagctaacagttacgcgacagcatatgctgcgtcggtagaaaggcgtaggttccaccgtctaccgaagtaaatgattacgaaagaacgacggtcgtaatcgtagaactaaagcgaaacgacgaccgtaaacggaaaacccgacggaaccgacggtccgtagttaacttacgtacgtaacgtagaacgtagggtagttaagttacgttagggtttaggggtaagttacggtacggaacggggtaaacgggggtactacgtacgtacgtagtcggacgtcggacgggaccgaacggccgacgtaccgccgtctccgtacgacgcccaccgaccgacggccctcgtccggttcccgtccccgtcggcccctacccctccctaccgaacgtccgtacccgtaccgtccgggcgggcgtacccggg

SEQ ID NO: 38429 - DNA, 911 bp, Homo sapiens
  misc_feature: GYAE6OF01B2X2Z.18.14.B03.1.454.CMB.1.raw
tcagtacgagtatgcacgaccggtgctcgatttagtgtgagtagtttgggctgagctgggttttccttgttgctatttaaaaggtgtccagtgtgaggtgcagctggtggaggtccgggggagcttgggtaaaggccgggggggtccttagacctcccctgtacagcctctggattcactttgagtaaggcctggatgaacgtcgggtccgccgaggcctccggaggggaacggggcgtgggaggttggggttacggaccgttaaaacttaaaaaaccgaaaacgttggtaacgtggggtaacgggaacctaaaaccgaacggtaacttaccggacgttacggaacccgttaaccccggttaaggaaaacgggacctaagggtaactttcccgaaacccgtacgttacctaacgaaaggtacgtaagttacggtaaacttaaaccgaaaaacggcctaaccggtaccttaggtaacgtccgtaggaacctaaagtagaaacctcggtactacggaacggaaaccgacgtaacgaccgtacggtaccgttaacgtttaacgttaccgtacgtaacccgtacgtaacccgttccccgaaaggtaaacggtcccgttaactaaacccttaacccgttacctaaaccgggttacggttaacgtaccgggtacccgttacggggtaaccgggaacccggaaccggggtacccgaaccgggttccccgtaaccgttcccgaccgttaccgaccgtaccctaaacccccggaaccgtaccgggtccctaaccggttcccgttccccgtacccgtcccggtaccctacccggtccgcccgttacgaccggtccgaccccgtaccggtacccgctacccggaccgtaccgaccgggtcccggccgggttgccggtaccgg

SEQ ID NO: 38430 - DNA, 869 bp, Homo sapiens
  misc_feature: GYAE6OF01CCILG.18.14.B03.1.454.CMB.1.raw
tcagtacgagtatgcacgaccggtgctcgatttagtgtgagtagtttgggctgagctgggttttccttgttgcttaattttaaaaggtgtccagtgtgaggtgcagctggtggaggtccgggggagtcttggtccagccgtggggggtccctagaaactctcctgtgcagccttcgtggttctaccttcgagtggctcgtgctagtgcctacggtcgggtcccgcgacgggccggtaccggggggaacgggccggtaggtgggtacgaccaaagtataatcgacaaggtagtacggaactagaacgaaagtaactagtcggtagtaccttaggtggtacggaacgggtcctacttaccgaacctactcgtaaccgaagaacgtaacctaaactaaacgtaaacgtaacctttagtagttaactcgtaacgtaaactaaaagtacgaaaccgtaccgtacgtaacgaaacggtccgggaaccgaagggacccgttaacggcgttttagtaacgtttaaccgtttaggtacggttacgggaaacggtaaggaagttaccggtaacgggttcgggacccggttaaaggtacgtaccgggtacgggttaaccgggtacgggtaccccgggggtaaaacgtaaccgggaaacccggtttccgtacccggtaaccccgtttcgttccccgtaaacgcccccgggttaacccctaacccccggggaaaccgttaacccggggccctttaaccggttcccccggttaccccgttaccccggtcggaccctttcccggtaccgacggtcccgaacggacctaccccggtaccgtaacggacgccgtaacccgaacgggccggtccccggtcggtcggg

SEQ ID NO: 38431 - DNA, 975 bp, Homo sapiens
  misc_feature: GYAE6OF01B0Q74.18.14.B03.1.454.CMB.1.raw
  modified_base (896)..(896): a, c, t, g, unknown or other
  misc_feature (896)..(896): n is a, c, g, or t
tcagtacgagtatgcacgaccggtgctcgatttagtgtgagtagtttgggctgagctgggttttccttgttgcttattttaaaaggtgtccagtgtgaggtgcagctgggtgggaggtccggggggaggcttggtccagccgtggggggtccctagaaactctcctggtgcagcctcttgggttcaccttcagtggctctgctagtgctacgtcgggtcccgccgacgggtccgttacccgggggaaaagggcgttaggggtagggttggggtttcgggcccggtttaaattaagggaaacgtaaccgaaaaaggtaccttaaaccgtaacgggtttaaccggaccgaaaccgagacgtaacgttagtacgggaccttcgggtccgggtaccggggttaacgggaaaagggtccgttaaccggggttttaccccgtaccccggttaccgttaacccggtaaaagtaaaaagtccggttaaacgttaaccgaaaaaacggaaaccggtaaaccgggttaccgtttaacgttcgaacgtaaacgaaaaacgttacggaaaacgaccggtaaaccgtaaaaccgggaaaaacccggggtacgaaccggtacccgggtcgttaacgttaactttaacgtacggttaacgaaacggtaaacggtaggtaacggttaaacgtttacggtaaggggtttaggggtaacgttacggtaacccgggtaacgggtaacgggggttactaaccgtacgtcgtaagtccggtacgtcgggacggtaccggaacggaccgtacggtaccgtacccgttccgtaccgtacctacccggtacctacccggaaccgtaacccgggtccctccggttaccccggttccccgttaccccggtcccgtaaccccncccccgtttacccgaaaccccggttacggaacccgttcccgttaacccggtccggggtaaccgggaccctaccccgggg

SEQ ID NO: 38432 - DNA, 885 bp, Homo sapiens
  misc_feature: GYAE6OF01CQIB3.18.14.B03.1.454.CMB.1.raw
tcagtacgagtatgcacgaccggtgctcgatttagtgtgagtagtttgggctgagctgggtttccttgttgctattttaaaaggtgtccagtgtgaggtgcagctggtggagtccgggggagcttggtccagccgtgggggtccctagaactcgtcctgtgcagcctcgtgggttccaccttcgagtggtctctgtctatcgcacgtcgggtcccgaccaggtccgttaccggggaaaggtcgtagggaggttggggttcggtaccgttaagttacggaaagtacgaaacgtactaaacgtacggttaccggaccgaacgtagtaccgtaagttagtcggtccgtacggtccgggtacgggttaaggaaacggtcggtacgggttaccctaccggttaccgtaacccgaaagttaaaacgtcgtaaacgttaaaccgaaaacgggtaaaccggtacggtaccgttaacgtaccgttaacgaacgttaaaacggacgtaaaccgaccggaacccgtaaaaccggaaaaccggaccggtaacggtacccggtacgtaacgttaactacgtagtaacgtagacgtaggtacgtacttaggtaggttagggtactacggtaacggtaacggggtaacggggtaacctacggtacgtaggtacgtcggtaccgtacggtacgggaccggtaaccgggtacgtaccggtaccgtaccgtccgtacgtacgtaaccccgccgtaccgaaacccgggtcccgtaccgtaccggttccccgttacccccgttaccccggtaccggttacccccgtaccccgtacccggtaacccgtaaccggtaccccgtaccccgttaccggtaccggggtcccggacccgggtaaccccggg

SEQ ID NO: 38433 - DNA, 1024 bp, Homo sapiens
  misc_feature: GYAE6OF01B5G9U.18.14.B03.1.454.CMB.1.raw
tcagtacgagtatgcacgaccggtgctcgatttagtgtgagtagtttgggttcgggggaggcttggtccagcctggggggtccctgaaactctcctgtgcagcctcgtgggttccaccttcagtggctctgctatgctacgtcgggtccgccgaggtccgttaccggggaaagggcgtagggtaggttggggttcggaccgttaagttaggaagacaaaagtaccgtaaacgtacggttaccggacgaacagacctaagttaacgtcgtcgtcggtaccggttacgggtaaaggaaaacgggtccgtaaccgggttacccgaacccggttaccgtaaccgtaaaaggtaaaacgtttggtaaacttaaaccggaaaaaaccgtaaccggtaacggtacgttaacgtacgtaacgtaaacgtaaaacgtaacgtaaaccgaacggtaaccggtaaaaccggaaaaccggaaccggtaaccggtacggttaccgttaagttaacgttaacgttaacgttaacggtaacggtaacggtaacgggttaacgttaacgtttaacggttagggttagggttaacgttacgggtaaccggggtaaacggggttaaacggggttaacttaacggtacggtacgtaacggtacggtaaccggttacggggaacgggtaaaccggtaaccgggtaacccgtaccggtacccgtacccgttacccgtaccgtaccggtacccgtacccgtaacccggaacccggtaacccggtacccgtaccggttaccccggttacccccgtaccccggttacccgtacccccgtaaccccgtacccgtaaccgtaacccggtacccgtacccgtaccgggtaccgggtacccggaccgaccgggtacccggtacccggtaccggtacggtcccggtaccggtacccgtacggtaaaccgtaaccgttacccgttaacccgtacccgttacgtaccgttacggtacgtacggtacggacccgggtacggtacccggacggtacg

SEQ ID NO: 38434 - DNA, 1200 bp, Homo sapiens
  misc_feature: GYAE6OF01BACU9.18.14.B03.1.454.CMB.1.raw
tcagtacgagtatgcacgaccggtgctcgatttagtgtgagtagtttgggctgagctgggttttccttgttgctaattttaaaaggtgtccagtgtgaggtgcagctggtggagggtccggggggaggcgtttggtcccagccgttcgggggggtccctgaaaactctcctggtcgcagtcctcgttgggttcacccttcgagtggcctctgactagtgctacgtcgggtcccgccgtaacgggccgttaccgggggaaagggtcgttggggtagggttcgggggtttacgggtcccggttaagtttaaaggaaagaccgaaaacggtacctaaccgttaaggttaccgccggaactaaggaccgtaattacggttacggtccgttacgggtaccggggtttccggggtaaacggtaaaacggggttacccggttaaggggttttacccccgtaaacccccggtttacccgtaacccgttaaaagggtaaaaaacttacggtaaaacgtttaaacccggtaaaaaaaccgggaaaacccggttaacccgggttaccggtttaaacttaccggttaacgtaaaaaccgttaaaacggaaacccggtaaaaccggtaacccggttaacccccggaaaaaacccggggttaaaaaaaccccggggaccgggttaaaacccggtaaccccgggggggttaacccgttttaacggttttaaaacccggttttacggtttaaacccggtttaaaccggtaaaccgggtaaacgggttaacgggggttaacggtttaaccggtttaacgggttttaagggggttttaacgggggggtaacgttttaaacgggtaccccgggggttaaacgggggggtaaaacccggggggggttactttacccggttaaacggttccgtttaagggggttaacccgggttccgggtaacccgggggttaaccgggggaaccccgtaaacggggtaaccccggttacccgggtacccggttaccccggtttaacccgtaccccgtaaccgtttaccccgggaccccctaacccggggtaaccccggtaaaccggggtacccccttccccggtttaccccggttcccccggtttaccccggccccgggtaaccccctccccccgttacccgaacccggtaacccgtcccggaacccggtttcccgggacgggtcgggga

SEQ ID NO: 38435 - DNA, 1091 bp, Homo sapiens
  misc_feature: GYAE6OF01DAXDZ.18.14.B03.1.454.CMB.1.raw
  modified_base (402)..(402): a, c, t, g, unknown or other
  misc_feature (402)..(402): n is a, c, g, or t
tcagtacgagtatgcacgaccggtgctcgatttagtgtgagtagtttgggctgagcttgggttttccttgttgcttaagttttaaaaggtgtccagtgtgaggtgcagcgtggtggacggtccggggagtcttggtccagccggtcgggggtcctagaactctccgtgtcgcgacgtcccgttcgttcgggttacctaccgttcgtacggtcggtccttcgtcgacttacgtacggtaccgtacggtccggggtcccggacccggtacggggtacccggttaccggggggaaaacgggtcggtaggggtaggggttcggggttcggtaaccggttaaagtttaaagaaacggtaacgtaaaacggtaaccgttaaacgttacggtacccggcgaaacgtacncgtaattcggtcgtaccggttcggacggggttaccggtaaaggtaacggtaccggtaccggttaccgttacccgttaacgaccgttaaagtaaacgttaggtaaaccgttaaaccaaaacggtaaccggtacgggtaccgtttaacggtaccgtaacgaaacgtaaaacgtacgaaacgtaacccggtaaaaccggtaaaccggaaaaacccgggtacggaaccccggttaccgggtaccgtttaacggttaaacgttcccgtttaacggtaaaccgtttaacggaaacgggttcggggttaaagttaacggtttaacggggtttaacgggggtttaacggggtttaacgggtttaaacggggtaaccgggggtaaaccgggggttaaacccggggggttaaacctttaacccggttaacccggttacgggttaacggtccggggttaccgggttaacccgggtaccgggggtaaaccccggaccggggttaccccggtaacccggttaccccggtacccgtttcccggtaacccgtaccgtacccgtaccccggtaccccggaaccggtaaccccgtcccggtaccccgttacccggttccccgtcccgtaccccggtccctaaccccgtaccgtaaccggaccgtcccacccgggtaccggttacccggccggtaccggtacccggg

SEQ ID NO: 38436 - DNA, 794 bp, Homo sapiens
  misc_feature: GYAE6OF01CE8C1.18.14.B03.1.454.CMB.1.raw
  modified_base (416)..(416): a, c, t, g, unknown or other
  misc_feature (416)..(416): n is a, c, g, or t
  modified_base (460)..(460): a, c, t, g, unknown or other
  misc_feature (460)..(460): n is a, c, g, or t
  modified_base (734)..(734): a, c, t, g, unknown or other
  misc_feature (734)..(734): n is a, c, g, or t
  modified_base (767)..(767): a, c, t, g, unknown or other
  misc_feature (767)..(767): n is a, c, g, or t
tcagtacgagtatgcacgaccggtgctcgatttagtgtgagtagtttgggctgagcttgggttttccttgttgcttattttaaaaggtgtccagtgtgaggtgcagcgtggtggacggtccgggggagtcgttcggtaccaggccggtcgggggtccctagtaaacctccgtccgtgtcgcacgtccttcgttcggttcctaccttcgaggtcggtctcgtcgtctagtcgacgtcggtcggtacccgacgacggtaccggttacggggaaggtcgtggggtaggttcgggttcggtaccgttaagtagaacgactaagtaccgtaagtacgtacgacgaactacgatatacggtcgtcgtggttaccgggtacggtaagaaccggtcggttacggttaccccaccgtaccgtaanaaaggttatacgttaactaacgaaacgtaccgcggttaacgtcngtaaacgataaacgtcgaaccgtcgtaaaccgaaaacgggaaccgagtacccggtacgttgttacgttaactacgtaacgtagaagtacggtgggttaacgttacgttaggtagggttacggtagtacggtacgggtaacgggtaacggtacgtacgtacgtacgtaggtcgtacggtcggtaaccgggaccggaccgtacgtccgtaccgtaccgtccgtacgccgacccttacccggacgtaccggtcccgtaccgtccgtcccgttccccncccgtaccgaccccttcccgaaccgtccgaccncgtacccgtcgccgggtgccgaccggg

SEQ ID NO: 38437 - DNA, 916 bp, Homo sapiens
  misc_feature: GYAE6OF01CAJ0V.18.14.B03.1.454.CMB.1.raw
  modified_base (572)..(572): a, c, t, g, unknown or other
  misc_feature (572)..(572): n is a, c, g, or t
tcagtacgagtatgcacgaccggtgctcgatttagtgtgagtagtttgggctgagcttgggttttccttgttgcttaattttaaaggtgtccagtgtgaggtgcagcgtgggtgggagggtccggggggaggtcgttggtcccgacggcccgggtcgggggggttccctacgtaaaacctccttccgttgtggccgacggcccctgactattacatttacttttaagttagtttagttggatcgccgtacgtcgggcccgaccgacgggtccgggaccggggggaaggggccgggtagggtcgggacggaaccaaagtaataacgtacggaacaaggacgtaggtaagagaaagaaagtaacttaagtggtacgtctacgtaggtacgacgggactactaccgactactccgacaagaacgaacctaacaaacgtaaacgttaccttatacgtattaccgagaaactaaatacgaacgacgtacctacggaacgacggacccggaaggaaccgtacggttagttacggttaacttaacgttaccgggtaggttaaacggaagaaacgggtanagggtaagggtaccgtaccgggaagggtacctaagggttcggtaaccggggttacgggaccggggaaccgaaacgggtaccccgttaacggtacctaacccccggtctaaccccggtacgtaacccgacccccgtaaccgaaacccggggaccccgttaaacccgtccgggttttacccccgttaccccgttacccccggggcccgtaaaccccggttccccgttacccggaaccccggaacccgggtaaacccggtcccgtaaccccgggttaccccaaaccggggacacccggtaccgggtaaacgggcccccgggttacggccccggttaccgggtacccg

SEQ ID NO: 38438 - DNA, 259 bp, Homo sapiens
  misc_feature: GYAE6OF02IOXAU.18.14.B03.1.454.CMB.1.raw
  modified_base (254)..(259): a, c, t, g, unknown or other
  misc_feature (254)..(259): n is a, c, g, or t
tcagtacgagtatgcacgaccggtgctcgatttagtgtgagtagtttgggagttatcgcaaacggggtactactacgctatggacgtctgggccaagggaccacggtcaccgtctcctcagcctccaccaagggcccatcggtcttcccctggcaccctcctccaagagcacctctggggcacagcggccctgggctgcctggtcaaggactacttcccatactcgtactgagcgggctggcaaggcgcatagnnnnnn

SEQ ID NO: 38439 - DNA, 240 bp, Homo sapiens
  misc_feature: GYAE6OF02GAQZ8.18.14.B03.1.454.CMB.1.raw
  modified_base (239)..(240): a, c, t, g, unknown or other
  misc_feature (239)..(240): n is a, c, g, or t
tcagtacgagtatgcacgaccggtgctcgatttagtgtgagtagtttgggggtactactacgctatggacgtctgggccaagggaccacggtcaccgtctcctcagcctccaccaagggcccatcggtcttcccctggcaccctcctccaagagcacctctggggcacagcggccctgggctgcctggtcaaggactacttcccatactcgtactgagcgggctggcaaggcgcatagnn

SEQ ID NO: 38440 - DNA, 584 bp, Homo sapiens
  misc_feature: GYAE6OF02JBBY9.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaaacagacctagaaaaccgaggacacggccgtgtattactgtactagacaggtggattacagtttggggagttagtcggcgaaacgggggggtactacgtacgcgtagtggacgtcgtggggccgaacgggaccgacggtcaccgtctcctcacgcctccaccgacggcccacgtccggtccttccccgtcggcctaccctccctccaacgacgccaccctcgtcggggcaccg

SEQ ID NO: 38441 - DNA, 612 bp, Homo sapiens
  misc_feature: GYAE6OF02GU2YK.18.14.B03.1.454.CMB.1.raw
tcagtacgagtatgcacgaccggtgctcgatttagtgtgagtagtttgggctgagcgtggtttccttgttgctattttaaaaggtgtccagtgtgaggtgcagctggtggagtccgggggaggcttggtccagcctggggggtccctgaaactctcctgtgcagcctctgggtccaccttcagtggctctgctatgcactgggtccgccaggcttccgggaaagggctggagtgggtgcgtatagagcaaagctaacagtacgcgacagcatatgctgcgtcggtgaaaggcaggttcaccgtctccagaaatgattcaaagacacggctaatctgacaaatgaacagccaagaaaaccgaggaccacggccgtagtattactgtactagacaggtggattactagtttaggggtagttagtacggtacggaaacgggggggtactacgtacgtcgtagtggacgtcgtcggggaccgaagggaccgacggtacctaccgtctcctcacgcctaccgaaccgaacggccctacgtccggttcccgttccccctcggaccctaccccgtaccctccgaacgacggaccacccgtcggtacggggaccaaccgg

SEQ ID NO: 38442 - DNA, 573 bp, Homo sapiens
  misc_feature: GYAE6OF02IV6F8.18.14.B03.1.454.CMB.1.raw
  modified_base (367)..(367): a, c, t, g, unknown or other
  misc_feature (367)..(367): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaaccgnggacacggccgtgtattactgtactagacaggtggattacatttgggggagttagtcgcgaaacgggggggtactacgtacgctatggacgtcgtggggccaagggaccgacggtcaccgtctcctcacgcctccaccaacggcccagtcggtccgttcccctcggccaccctcctaccaacgacgccacctcgtcgggggcaccg

SEQ ID NO: 38443 - DNA, 567 bp, Homo sapiens
  misc_feature: GYAE6OF02I32OF.18.14.B03.1.454.CMB.1.raw
  modified_base (367)..(367): a, c, t, g, unknown or other
  misc_feature (367)..(367): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctagaaaaccgnggacacggccgtgtattactgtactagacaggtggattacatttggggagttatcgcgaaacggggggtactacgtacgctatggacgtcgtggggccaagggaccgacggtcaccgtctcctcacgcctccaccgaaggcccatccggtccttcccctcggccaccctcctccgaacgcgccacctcgtcggggcaccg

SEQ ID NO: 38444 - DNA, 246 bp, Homo sapiens
  misc_feature: GYAE6OF02FVZHX.18.14.B03.1.454.CMB.1.raw
  modified_base (242)..(246): a, c, t, g, unknown or other
  misc_feature (242)..(246): n is a, c, g, or t
tcagtacgagtatgcacgaccggtgctcgatttagtgtgagtagtttggggggtactactacgctatggacgtctggggccaagggaccacggtcaccgtctcctcagcctccaccaagggcccatcggtcttcccctggcaccctcctccaagagcacctctgggggcacagcggccctgggctgcctggtcaaggactacttcccatactcgtactgagcgggctggcaaggcgcatagnnnnn

SEQ ID NO: 38445 - DNA, 568 bp, Homo sapiens
  misc_feature: GYAE6OF02GIHS3.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttggggagttagtcgcgaaacgggggggtactacgtacgctatggacgtctggggccaagggaccacggtcaccgtctcctcagcctccaccaacggcccatccggtccgttccccctggccaccctccctccaacgacgccacctcgtcggggcaccg

SEQ ID NO: 38446 - DNA, 244 bp, Homo sapiens
  misc_feature: GYAE6OF02ICCDN.18.14.B03.1.454.CMB.1.raw
  modified_base (241)..(244): a, c, t, g, unknown or other
  misc_feature (241)..(244): n is a, c, g, or t
tcagtacgagtatgcacgaccggtgctcgatttagtgtgagtagtttggggggtactactacgctatggacgtctggggccaagggaccacggtcaccgtctcctcagcctccaccaagggcccatcggtcttcccctggcaccctcctccaagagcacctctggggcacagcggccctgggctgcctggtcaaggactacttcccatactcgtactgagcgggctggcaaggcgcatagnnnn

SEQ ID NO: 38447 - DNA, 585 bp, Homo sapiens
  misc_feature: GYAE6OF02GTFT2.18.14.B03.1.454.CMB.1.raw
tcagtacgagtatgcacgaccggtgctcgatttagtgtgagtagtttgggctgaagctgggttttccttgttgctattttaaaaggtgtccagtgtgaggtgcagctggtggagtccgggggaggcttggtccagcctgggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagacacggcgtatctgcaaatgaacagcctagaaaaccgaggacacggccgtgtatactgtactagacaggtgattacagtttggggagttagtcgacgaaacgggggggtactacgtacgcgtagtggacgtcgtgggacaagggaccgacggtcaccgtctccgtcacgcctccaccgaacgggcccagtccggtccgttccccgtcggtcctaccctcctaccgaacgacgccgaccgtcgtcggggcctaccgg

SEQ ID NO: 38448 - DNA, 587 bp, Homo sapiens
  misc_feature: GYAE6OF02IRG2Z.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagacacggcgtatctgcaaatgaacagacctagaaaaccgaggacacggccgtagtattactgtactagacaggtggattactagtttgggggagttagtcgacgaaacggggggtactacgtacgcgtagtggtacgtcgtcgggaccgaacgggacacggtacaccgtctccgtcacgcctaccaccgacggccagtccggtccttccccgtcggccaccctccctaccacgacgccgtaccgtcgtcggggcaccgg

SEQ ID NO: 38449 - DNA, 602 bp, Homo sapiens
  misc_feature: GYAE6OF02G074A.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctcagaaatgattacaaagaacacggcgtatctgacaaatgaacagcctagaaaaccgaggacacggccgtagtatactgtactagacaggtgattacgtagtttaggggtagttagtcgacggaaacggggggtactacgtacgtctagtggacgtcgtggggaccgaacgggaccgacggtaccgaccgtcctcctcacgcctccaccgacggcccacgtccggtccgttcccccgtcggccacccctccctaccgaacgacgccgacccgtccggtcggggaccaccgg

SEQ ID NO: 38450 - DNA, 618 bp, Homo sapiens
  misc_feature: GYAE6OF02HS1TD.18.14.B03.1.454.CMB.1.raw
  modified_base (370)..(370): a, c, t, g, unknown or other
  misc_feature (370)..(370): n is a, c, g, or t
tcagtacgagtatgcacgaccggtgctcgatttagtgtgagtagtttgggctgagctgggttttccttgttgctattttaaaaggtgtccagtgtgaggtacagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaaagctaacagttacgcgacagcatatgctgcgtcggtgaaaggcaggttcaccgtctccagaaatgattcaaagaacacggcgtatctgacaaatgaacagcctagaaaaccgnggacacggccgtagtattactgtactagacagggtgattacgagtttaggggagttagtacggacgaaacgggggggtactacgtacgctagtaggacgtcgtggggaccgaagggaccacgggtccaccgtcctccctcacgcctcccaaccgaacgggacccacgtccggtaccttcccccgtcggccctaccccgtccctacccgaacgaccgaccgacccgtccggtcggggtccaccgaccgg

SEQ ID NO: 38451 - DNA, 586 bp, Homo sapiens
  misc_feature: GYAE6OF02I7KYE.18.14.B03.1.454.CMB.1.raw
  modified_base (346)..(346): a, c, t, g, unknown or other
  misc_feature (346)..(346): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcagtttcagtgcctactggatgcactggatccgccaagttccagggaagagactggtgtgggtctcacgtattaaagatgatgggggtgccacatcctacgcggactccgtgaggggccgcttcaccatctcccgagacaacaccaagaacacgctgtatctgcaaatgancagtctgggatcgaggacacggctgtctattactgtgcaagaggggactacggtgcctacggaggggttggtcgaccccgtggggccgacgggaacccgtggtccaccgtcctcctccacgccctccaccgaacgggcccacgtccggtacctttcccccgtcggccaccccttccctcccaacgacgccacccgtcgtcggggccaccgacggccggcccgtcgggctcgccgtacggg

SEQ ID NO: 38452 - DNA, 592 bp, Homo sapiens
  misc_feature: GYAE6OF02GODVZ.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaaagacacggcgtatctgacaaatgaaacagcctaggaaaaccgaggacacggccgtgtaattactgtactagacaggtggattacagtttggggagttagtcggacggaaacgggggggtactacgtacgctagtggacgtcgtggggaccgaagggaccgacggtcaccgtctcctcacgcctaccaccgacggcccacgtccggtccgttccccgtcggccctaccctccctaccgaacgacgccaccgtcgtcggggcaccg

SEQ ID NO: 38453 - DNA, 271 bp, Homo sapiens
  misc_feature: GYAE6OF02F23YW.18.14.B03.1.454.CMB.1.raw
  modified_base (267)..(271): a, c, t, g, unknown or other
  misc_feature (267)..(271): n is a, c, g, or t
tcagtacgagtatgcacgaccggtgctcgatttagtgtgagtagtttgggggagttatcgcaaacgggggggtactactacgctatggacgtcgtgggccaagggaccacggtcaccgtctcctcagcctccaccaacgggcccatcggtccttcccctggccaccctcctccaagagcacctcgtgggggcacagccggccctgggctgcctggtcaaggactaccttcccatactcgtactgagcgggctggcaaggcgcatagnnnnn

SEQ ID NO: 38454 - DNA, 242 bp, Homo sapiens
  misc_feature: GYAE6OF02HSH5L.18.14.B03.1.454.CMB.1.raw
  modified_base (242)..(242): a, c, t, g, unknown or other
  misc_feature (242)..(242): n is a, c, g, or t
tcagtacgagtatgcacgaccggtgctcgatttagtgtgagtagtttggggggtactactacgctatggacgtctggggccaagggaccacggtcaccgtctcctcagcctccaccaagggcccatcggtcttcccctggcaccctcctccaagagcacctctgggggcacagcggccctgggctgcctggtcaaggactacttcccatactcgtactgagcgggctggcaaggcgcatagn

SEQ ID NO: 38455 - DNA, 578 bp, Homo sapiens
  misc_feature: GYAE6OF02GGD1Y.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctagaaaaccgaggacacggccgtgtattactgtactagacaggtggattacagtttggggagttagtcgacgaaacgggggggtactacgtacgctatggacgtcgtgggccaagggaccacggtcaccgtctcctcacgcctccaccaacgggccctacgtccggtccgttccccgtcggccaccctccctccaacgacgccgacctcgtcggggcaccg

SEQ ID NO: 38456 - DNA, 669 bp, Homo sapiens
  misc_feature: GYAE6OF02I193U.18.14.B03.1.454.CMB.1.raw
  modified_base (368)..(368): a, c, t, g, unknown or other
  misc_feature (368)..(368): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaatgattcaaagaacacggcgtatctgacaaatgaacagcctagaaaaccgnggaacacgggccgtagtactaactacgtactacgagacgtagggtagttaactagttaggggttagggtattacgtacggaacggggggtaacggggtactacgtacgtataggtcggtacgtcgggcggaaccggaacgggacccgtacggtaccgtaccgttccctccgtacgacccgtccctacccgaacgggacccggaccctacggttcccgtttcccccgttcccggtaccgtacccctaccccgttcccaaccgaacggacccgacccgtacccggttcggggccggtaacccg

SEQ ID NO: 38457 - DNA, 636 bp, Homo sapiens
  misc_feature: GYAE6OF02GRAGA.18.14.B03.1.454.CMB.1.raw
  modified_base (369)..(369): a, c, t, g, unknown or other
  misc_feature (369)..(369): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtcccgtgaaactctcctgtgcagcctctgggttcaccttcagtggctctgctatgcactgggtccgccaggcttccgggaaaggctggagtgggttggccgtattagaagcaaagctaacagttacgcgacagcatatgctgcgtcggtgaaaggcaggttcaccgtctccagaaatgattcaaagaacacggcgtatctgacaaatgaaacagcctagaaaaccgnggacacggccgtagtattactgtaactagacagggtggatactagtttggggagttatacggacggaaacgggggggtactaacgtacgacgtagtggtacgtacgtggggaccgaacgggaccgacgggtaccacccgtctcccgtaccacgaccctaccgaaccgtaaccgggacccgtacgtcccggtcccgtttcccccgtcgggtccctacccccgtccctacccgaacgacgaccgtacccgtccggcgggggactaccgg

SEQ ID NO: 38458 - DNA, 600 bp, Homo sapiens
  misc_feature: GYAE6OF02IVAR1.18.14.B03.1.454.CMB.1.raw
  modified_base (313)..(313): a, c, t, g, unknown or other
  misc_feature (313)..(313): n is a, c, g, or t
  modified_base (371)..(371): a, c, t, g, unknown or other
  misc_feature (371)..(371): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtagaaaggcaggttcaccgtcnccagaaatgattacaaagacacggcgtatctgacaaatgaacagacctagaaaaccgnggacacggccgtgtattactgtactagacgaggtggattacgtagtttggggtagttagtcggtacggtaaacggggggtactacgtacgctagtggacgtcgtcgggccgaacgggaccgaccggtccgtaccgtctcctcgacgcctccaaccgaacggcccacgtccgtcccgttcccctacggccaccctcctaccgaacgcgccgacccgtcggtcgggacacg

SEQ ID NO: 38459 - DNA, 836 bp, Homo sapiens
  misc_feature: GYAE6OF02GVUGA.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtccctgaaactctcctgtgcgacgcctcgttggttacctaccttcgaggtcggtccttcgtgtacttagtcgacctacggttcgggtcccgaccgacggtccggttaaccgggggaaacgggtcgtagggtagggtttgggggttcgggtaccgttaagttaaggaacgaacgaaacgtacctaaacgtacggttaccgacgaacacgcaatagtcgctcggcggttcgggtaaggaaacggcgtacggttaccaccgttcctaccgaaagtaaagtgtaacttaacgaaaaacgtaaccgacgggtacgttaacttcgtaggaaactaaaagtacgaaaacgacgtacccgtaaaacggaaaaacccggaggaaccgaccgggtccgttagttaacttacgtacgtaacgtaagacgtagggtaggtaacttaacgttagggtttagggggtaagtttacgtcggaaaccggggtaaaccggggggttaaccttaacgtacgtacgttagtacggtacgtcggtcgggaccgaacgggaccgtacggtaccgtaccgtcctccgtacgacgccctaccaaccgaaccgggaccctacggtccggttccccgttccccggtcggtacccctaccccgttcccgtaaccgtaacggaccgtaccctacccgtcgggttcggggacccaacccggg

SEQ ID NO: 38460 - DNA, 599 bp, Homo sapiens
  misc_feature: GYAE6OF02JC24I.18.14.B03.1.454.CMB.1.raw
tcagtacgagtatgcacgaccggtgctcgatttagtgtgagtagtttgtgtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagccgtggggggtccctgaactctcctgtgcagcctctgggttcaccttcagtggctctgctatgcacgtgggtcccgccgagggtccgttacccggggaaagggccgtgggacggttggggttgggccgtagttagaagcaaagctaacagttacgcgacagcatatgctgcgtcggtaggaaggcgaggttcaccgtctccagaaatgtatacaaagaacgacggacgtatctgacaaagtagaacacgacctaaggaaaccgaggaacgaccggaccgtagtattacgtagtacgtaagactaggtaggtagttacgtaggtttggggtagtttacgtacggtacgggtaacggggggttaaccg

SEQ ID NO: 38461 - DNA, 607 bp, Homo sapiens
  misc_feature: GYAE6OF02GD7TU.18.14.B03.1.454.CMB.1.raw
  modified_base (336)..(336): a, c, t, g, unknown or other
  misc_feature (336)..(336): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaatgattcaaagaacacggngtatctgacaaatgaacagacctagaaaaccgaggaaccacggccgtagtacttactgtactagacagggtgtattacgtagtttggggtagttagtcggacggtaaacgggggggtactacgtacgtcgtagtggtacgtcggtcgggaccgaagggaccgacggtacgaccgtcgtcctcgacgcctccaccgacggcccagtccggtccttccccgtcggccctcccgtcctaccgacgacgacctacccgtccggtcgggacaccgg

SEQ ID NO: 38462 - DNA, 599 bp, Homo sapiens
  misc_feature: GYAE6OF02FF9Y6.18.14.B03.1.454.CMB.1.raw
  modified_base (370)..(370): a, c, t, g, unknown or other
  misc_feature (370)..(370): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtcccgccaggcttccggggaaagggctggagtgggttggccgtattagaagcaaagctaacagttacgcgacagcatatgctgcgtcggtgaaaggcaggttcaccgtctccagaaatgattacaaagacacggctatctgacaaatgaacagcctagaaaaccgnggacacggctgtattactgtactagacagggtggtattacagtttggggtagttagtcggacggaaacggggggtactacgtacgtcgtagtggacgtcgtgggaccgaacgggaccgacggtcaccgtctcctcacgcctaccgaccgaacgggcccacgtccgtcccgttccccgtcggccctaccctccctaccgaacgacgaccacccgtcggtcggggcaccgg

SEQ ID NO: 38463 - DNA, 597 bp, Homo sapiens
  misc_feature: GYAE6OF02GN3LQ.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccggggaaagggctggaggttgggttggccgtattagaagcaaagctaacagttacgcgacagcatatgctgcgtcggtagaaaggcaggttcaccgtctccagaatgattcaaagacacggctatctgacaaatgaacagcctagaaaccgaggacacggcgtgtattactgtactagacaggtgtattacgtagtttaggggtagttagtcggacgggtaacggggggtactacgtacgtctagtggacgtcgtcgggacgaacgggaccgacggtcacgtcctctcgacgcctccaccgacggccacgtccggtccttccccgtcggccctacccctccgtaccgaacgaccgtaccgaccgtcggtcgggccaccgg

SEQ ID NO: 38464 - DNA, 606 bp, Homo sapiens
  misc_feature: GYAE6OF02HOO3S.18.14.B03.1.454.CMB.1.raw
  modified_base (369)..(369): a, c, t, g, unknown or other
  misc_feature (369)..(369): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgacaaatgaacagcctagaaaaccgnggacacggcgtagtattactgtaactagacaggtaggattacgtagtttggggtagttagtcggacggaaacgggggggtactacgtacgacgtagtggacgtcgtgggaccgaacgggaccgacggtcaccgtctcctcacgcctaccaccgaacggcccacgtccggtcccgttccccgtcggcctacccctcccgtacccgaacgacgccacccgtccggtacggggccaccgg

SEQ ID NO: 38465 - DNA, 267 bp, Homo sapiens
  misc_feature: GYAE6OF02HB0TU.18.14.B03.1.454.CMB.1.raw
  modified_base (262)..(267): a, c, t, g, unknown or other
  misc_feature (262)..(267): n is a, c, g, or t
tcagtacgagtatgcacgaccggtgctcgatttagtgtgagtagtttgggggagttatcgcaaacgggggggtactactacgctatggacgtctggggccaagggaccacggtcaccgtctcctcagcctccgccaagggcccatcggtcttccccctggcaccctcctccaagagcacctctgggggcacagcggccctgggctgcctggtcaaggactacttcccatactcgtactgagcgggctggcaaggcgcatagnnnnnn

SEQ ID NO: 38466 - DNA, 592 bp, Homo sapiens
  misc_feature: GYAE6OF02HTY69.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctagaaaaccgaggacacggccgtgtattactgtactagacgaggtggattactagtttgggggagttagtcggcgaaacgggggggtacgtaacgtacgcttagtggacgtcgtggggccgaagggaccgacggtcaccgtctcctcacgcctccaccgaacgggcccacgtccggtccgtccccctcggccacccctccctcccaacgacgaccacccgtcgtcggggcaccgg

SEQ ID NO: 38467 - DNA, 688 bp, Homo sapiens
  misc_feature: GYAE6OF02I3Q1Z.18.14.B03.1.454.CMB.1.raw
tcagtacgagtatgcacgaccggtgctcgatttagtgtgagtagtttgggttcgggggaggcttggtccagcctgggggtccctgaaactctcctgtgcagcctctgggttcaccttcagtggctctgctatgcactgggtccgccaggcttccgggaaaggctggagtgggttgccgtattagaagcaaagctaacagttacgcgacagcatatgctgcgtcggtgaaaggcaggttcaccgtctccagaaatgattacaaagacacgcgtatctgcaaatgaacagctgaaaaccgaggacacggccgtgtattactagtactagacaggtgattacagtttaggggagttagtcgacggtaaacgggggggtactaactacgacgtatggaacgtcgtagggccgaacgggacgacggtacgtaaccgtcgtccctacgaacgtcccgtaccaccgtaaacggcccacgtaccggtcctttacccccgtcggtacccgaccccttcccgttacccgaacgaaccgacccgtaacccgttccgtccgggggacctaccggaaccgccgggtaccccgtcgggaccgttccggcccgttacggtaccgtaacggtaaccttaccgtacccgtaacgttaccgttaccgtaacgtcggaccgtacgggtccgtacggtacgaaccggg

SEQ ID NO: 38468 - DNA, 592 bp, Homo sapiens
  misc_feature: GYAE6OF02H0JSA.18.14.B03.1.454.CMB.1.raw
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
  modified_base (380)..(380): a, c, t, g, unknown or other
  misc_feature (380)..(380): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggagcttagttcagcctgggggtccctgagactctcctgtgcagcctctggattcagtttcagtgcctactggatgcactggatccgccaagttccagggaagagactggtgtgggtctcacgtattaaagatgatgggggtnccacatcctacgcggactccgtgaggggccncttcaccatcctccgagacaacaccaagaacacgctgtactctgacaaatgacgcagtctgggatcgagacaggctgtactattacngtgacgaaggagggactacggtcgaccgtacggtaggggttcggtccggaccccggtgggaccgacgggaacccgttcggtaccgacccgtcctcctcgacgccctaccgaccgaacggacccacgttccggtacccttccccgtcgaccctacccgtcctaccgaacgacgcctaccgtccgtcgggccacgacgccggccgtcggctcgg

SEQ ID NO: 38469 - DNA, 584 bp, Homo sapiens
  misc_feature: GYAE6OF02G26K5.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagacacggcgtatctgcaaatgaacagacctagaaaaccgaggacacggccgtgtattactgtactagacaggtgattactagtttggggagttagtcggacggaaacggggggtactacgtacgctagtggacgtcgtcgggcgaagggaccgacggtcaccgtctccgtcacgcctaccaccgaacggcccacgtccgtccgttccccgtcgcctaccctcctccaacggacgccaccgtcgtcggggccaccgg

SEQ ID NO: 38470 - DNA, 597 bp, Homo sapiens
  misc_feature: GYAE6OF02I79RI.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagacacggcgtatctagacaaatgaacagacctagaaaaccgagacacggccgtagtattactgtactagacaggtgattacagtttaggggagttagtcgacggaaacggggggtactacgtacgctagtggacgtcgtgggaccgaacgggaccgacggtccgaccgtcgtcctcacgcctaccgaccgaacggcccacgtccggtccgttcccctcggccctaccctacccgtacccgaacgacgaccaccgtcgtacggggccacg

SEQ ID NO: 38471 - DNA, 588 bp, Homo sapiens
  misc_feature: GYAE6OF02G5ZO3.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaaacagttacgcgacagcatatgctgcgtcggtgaaaggcaggttcaccgtctccagaatgattcaaagaacacggcgtatctgcaaatgaacagcctagaaaaccgaggacacggccgtagtattactgtactagacaggtgattacagtttggggagttagtcgacgaaacggggggtactacgtacgcgtagtggacgtcgtgggaccgaagggaccgaacggtacaccgtctccgtcacgcctccaaccgacggcccacgtccggtccttccccgtcggccacccctccctaccaacgacgaccacccgtcgtcggggcaccgg

SEQ ID NO: 38472 - DNA, 616 bp, Homo sapiens
  misc_feature: GYAE6OF02GK1BC.18.14.B03.1.454.CMB.1.raw
  modified_base (340)..(340): a, c, t, g, unknown or other
  misc_feature (340)..(340): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggattccgggaaagggctggagtgggttggtcgtattagaagcaaagctaacagttacgcgaacagcatatgctgcgtcggtgaaaggcaggttcaccgtctccagaaatgattcaaagacaggcgtanctgacaaatgaacagcctagaaaaccgaggaccacggccgtgtaattactgtaactagaccagggtggattacgagtttaggggagttagtcggacggaaacgggggggtactacgtacgacgtagtaggacggtcgtcggggaccgaacgggaccgacgggtccaccgtcctccgtcgacgccctaccgaccgaacgggccctacgtccggttccgttccccgtcggcctacccctcctaccgaacgacgacctaccgtcggtcggggccaccgg

SEQ ID NO: 38473 - DNA, 755 bp, Homo sapiens
  misc_feature: GYAE6OF02F6OUD.18.14.B03.1.454.CMB.1.raw
tcagtacgagtatgcacgaccggtgctcgatttagtgtgagtagtttgggctgagcgtggtttcgtgtagctatttaaaagtgtcagtgtgaggtgcagctggtggagtccgggggaggcttggtccagcctggggggtccctgaaactctcctgtgcagcctctgggttcaccttcagtggctctgctatgcactgggtccgccaggcttccggggaaagggctggagtgggttggccgtattagaagcaaagctaacagttacgcgacagcatatgctgcgtcggtagaaagcgtaggttcaccgtctcagaatgattacaaagaacgacggcgtaatctagactaaatgaaactacgacctaacggaaaaccggacggaacgtaccgggaccggttagttaacgtttacgttacggtaactaaggaccgtaagggttacggtagttaacgtaggtttaggggtagtttacgtacgggtacggggtaaacggggggggtactaaccgtacgtacgttacggtacggtaccggttacgggtaccggggtaccggtaaacggggtacccgtaccgggttacccgtacccggttcccgttacccgtcgtaaccgtcccgtacccgaaacccggtaacccgggtccctacggttacccggtcccgtttcccccggttacggacccctaccccgtacccgttacccgaacgtacccggaaccgtaccccggtaccgggtccggggtacctaacccggg

SEQ ID NO: 38474 - DNA, 588 bp, Homo sapiens
  misc_feature: GYAE6OF02JE1BN.18.14.B03.1.454.CMB.1.raw
  modified_base (207)..(207): a, c, t, g, unknown or other
  misc_feature (207)..(207): n is a, c, g, or t
  modified_base (367)..(367): a, c, t, g, unknown or other
  misc_feature (367)..(367): n is a, c, g, or t
  modified_base (502)..(502): a, c, t, g, unknown or other
  misc_feature (502)..(502): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtccctgaaactctcctgtgcagcctctgggttcaccttcagtggctctgctatgcactgggtccnccaggcttccgggaaaggctggagtgggttgccgtattagaagcaaagctaacagttacgcgacagcatatgctgcgtcggtagaaaggcaggttcaccgtctaccagaaatgatacaaagacaggctatctgacaaatcgaacacgcctagaaaaccgnggacacggcgtgtattactgtactagactaggtgattactagtttggggtagttagtcgacggaaacggggggtactacgtacgtctagtggacgtcgcgggaccgaacgggacacggtcaccgtctcctaccgngccctccaccgaggcccagtccgtccgttccccgtcggccctacccgtccctaccgaacgaccaccgaccgtcgtcgggacaccgg

SEQ ID NO: 38475 - DNA, 666 bp, Homo sapiens
  misc_feature: GYAE6OF02IAMR6.18.14.B03.1.454.CMB.1.raw
  modified_base (323)..(323): a, c, t, g, unknown or other
  misc_feature (323)..(323): n is a, c, g, or t
  modified_base (389)..(389): a, c, t, g, unknown or other
  misc_feature (389)..(389): n is a, c, g, or t
tcagtacgagtatgcacgaccggtgctcgatttagtgtgagtagtttgggctgagctgggttttccttgttgctattttaaaaggtgtccagtgtgaggtgcagctggtgggaggtccggggggaggcttggtccagcctggggggtccctgaaactctcctgtgcagcctctgggttcaccttcagtggctctgctatgcacgtggggtcccgccaggcttccgggggaaagggctgggagtggggttggccgtattagaagcaaaagctaaacagttacgcgacagcatatgctgcgtcggagaaaggcaggttcacgtcncaagaatgattacaaaagacacggtacgtatctagacaaatgaaacagaccctaaggaaaaccggnggaaccgacggtaccgttagttacttaactagtaactaaggaacgtagggttagtaattacgtaggtttagggggtagttacgtacggtacgggtaaacggggggtactacgtacgcgtagtcggacggtcgtacggggaccgaacgggaccgaacggtaccgaccgtctccgtacgacgcccaccaccgaccggccacgtccggttcccgtcccgtccggcccaccccgttaccaccgaacgaccgaccgtaccggtacggtccggggctaaccgg

SEQ ID NO: 38476 - DNA, 619 bp, Homo sapiens
  misc_feature: GYAE6OF02IGQNB.18.14.B03.1.454.CMB.1.raw
  modified_base (211)..(211): a, c, t, g, unknown or other
  misc_feature (211)..(211): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
  modified_base (518)..(518): a, c, t, g, unknown or other
  misc_feature (518)..(518): n is a, c, g, or t
tcagtacgagtatgcacgaccggtgctcgatttagtgtgagtagtttgggcgtgagctgggttttccttgttgctattttaaaaggtgtccagtgtgaggtgcagctggtggaggtccgggggaggcttggtccagccgtggggggtccctgaaactctcctgtgcagcctctgggttcaccttcagtggctctgctatgcactgggtccnccaggcttaccggggaaagggctggagtgggttggccgtattagaagcaaagtctaacagttacgcgacagcatatgctgcgtacggtagaaaggcaaggttcaccgtctacaagaaatgattacaaaagaacacggtacgtatctgacaaaagtgaaacagcctaagaaaaccgngacacggtctagtaattacngtaactagacaggtgatactagttaggggagttatcggacggtaaacgggggggtaactacgtacgactagtaggacgtcgtgggaccgaagggaccacggacaccgtccncctacacgcctccaaccgaacgggcccacgtcgtcccgttcccctcggtaccacccctcctacccgaacacggacctaccgtccggtcggggaccaaccgg

SEQ ID NO: 38477 - DNA, 633 bp, Homo sapiens
  misc_feature: GYAE6OF02FNAEH.18.14.B03.1.454.CMB.1.raw
tcagtacgagtatgcacgaccggtgctcgatttagtgtgagtagtttgggttcgggggaggcttggtccagcctggggggtccctgaaactctcttgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagacacggcgtatctgcaaatgaacagcctagaaaccgaggacacggccgtgtattactgtactagacaggtgattacactttgggggagttagtcgcgaaacgggggggtactaacgtacgctagtggacgtcgtggggcaagggaccacggtcaccgtctcctcacgcctcccaccgaacgggcccaacgtccggtaccttacccccgtggcccaccctcccgtaccaagacgcacctcgtcggggccacgacgccggcccgtagggcctcgccgttacggtaccgtaacggtaaccttaccgttacccaacgttaacccgttcggtaacctcggtaccgggccgggtctccgggtacgaaccgggg

SEQ ID NO: 38478 - DNA, 596 bp, Homo sapiens
  misc_feature: GYAE6OF02HLFE2.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaaagacacggcgtatctgacaaatgaaacagcctagaaaaccgagacacggccgtgtaacttactagtacagacgaggtagtattacgtagtttggggagtagtcgacggaaacggggggtactacgtacgcgtagtggacgtcgtgggaccgaagggaccgacggtaccaccgtctcctcacgcctaccaccgacggcccgacgtccggtcccgttccccgtcggccctaccctcccaccgaacgacgaccacccgtcgtcgggcaccgg

SEQ ID NO: 38479 - DNA, 265 bp, Homo sapiens
  misc_feature: GYAE6OF02F9PA5.18.14.B03.1.454.CMB.1.raw
  modified_base (261)..(265): a, c, t, g, unknown or other
  misc_feature (261)..(265): n is a, c, g, or t
tcagtacgagtatgcacgaccggtgctcgatttagtgtgagtagtttgggggagttatcgcaaacggggggtactactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttcccatactcgtactgagcgggctggcaaggcgcatagnnnnn

SEQ ID NO: 38480 - DNA, 628 bp, Homo sapiens
  misc_feature: GYAE6OF02HBT33.18.14.B03.1.454.CMB.1.raw
  modified_base (372)..(372): a, c, t, g, unknown or other
  misc_feature (372)..(372): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccggggaaaggctggagtgggttggccgtattagaagcaaagctaacagttacgcgacagcatatgctgcgtcggtgaaaggcaggttcaccgtctccagaaatgattacaaaagacacggcgtatctagacaaaatgaacagcctagaaaaccgnggacacggccgtagtaattactgtaactagacagggtaggattacgtagtttaggggtagttagtacggacggaaacgggggggtaactaacgtacgtacgtagtaggacgtcgtacgggaccgaacgggaccgacggtaccgaccgtcctaccgtccacgccctaccgaccgaacggacccgtacgtccggtccgttccccgtcggccctaccctccctaccgaacgacgaccacccgtcggtacgggcctacgg

SEQ ID NO: 38481 - DNA, 250 bp, Homo sapiens
  misc_feature: GYAE6OF02IB0WA.18.14.B03.1.454.CMB.1.raw
  modified_base (244)..(250): a, c, t, g, unknown or other
  misc_feature (244)..(250): n is a, c, g, or t
tcagtacgagtatgcacgaccggtgctcgatttagtgtgagtagtttgggggggtactactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttcccatactcgtactgagcgggctggcaaggcgcatagnnnnnnn

SEQ ID NO: 38482 - DNA, 828 bp, Homo sapiens
  misc_feature: GYAE6OF02HLOD0.18.14.B03.1.454.CMB.1.raw
tcagtacgagtatgcacgaccggtgctcgatttagtgtgagtagtttgggctgagctggttttccttgttgcttaattttaaaaggtgtccagtgtgaggtgcagctggtggaggtccgggggaggcttggtccagccgtcgggggtccctagaaactctcctgtgcagcctcgtggttccaccttcgagtggctctgctatgctacgtcgggtcccgccgaggtccgttaccggggaaaggcgtagggaggttgggttcggaccgttaagttaagaaacgacaaaaggtaccttaaacgtaggttaccgacgaacgagcaatagtgcgtggcggtcggtaagaaacggcgtaggttaccaccgtctaccgaagtaaagtgattaacaaaagaccgacggtactatacgtagaactaaagtacgaaacacggtaccgtaaacgaaaaccggaggaaccgaaccggtccgttaagttaactttaacgtacgttaaacgtaacggaacgtagggttaacgtaacgtttaacggttaagggtttacggggtaagtttaacggtaccgggtaaacggggtaaaccggggggttaacttaacggtacggtacgttaacggtcgggtaaccggttcggtacgggaaccgaacgggaacccgtaccggtacccgtacccgtcccgtaccgtaccgaccgtaccccgtacccgaaccggaaccggtacccgtaccgttacccggttcccccgttaccccggtccgaccccgtaccccgttacccgtaacccgaacgtaccgacccgtacccggtcggtaccgggaccgtaacccgg

SEQ ID NO: 38483 - DNA, 712 bp, Homo sapiens
  misc_feature: GYAE6OF02IT1IC.18.14.B03.1.454.CMB.1.raw
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaagggctggagtgggttggccgtattagaagcaaagctaacagttacgcgacagcatatgctgcgtcggtgaaaggcaggttccaccgtntccgagaaactgaattcaaagaacacggctatctgacaatgaacagcctagaaaaccgnggaacacgggaccgttagttaattacgtactaacgtacgaacgaggttggaacgtttaacgtaggtttagggggtaagtttagtacggaaccgggtaaacggggggggtacctaacggtaacgtacgttaagttacgggacggttaccgtcgggggaccgaaacggggtaccaaccgggttccgtacccgtaccgttcccgtacgaccgtacccttacccgaacccgtaacgggtccccgtaccgttccggttacccgtttcccccgtacggtccctaaccccgttcccgtaaccgaacggtaccgacccgtacccggtccggtacggggaccaacccgggg

SEQ ID NO: 38484 - DNA, 623 bp, Homo sapiens
  misc_feature: GYAE6OF02F6884.18.14.B03.1.454.CMB.1.raw
  modified_base (392)..(392): a, c, t, g, unknown or other
  misc_feature (392)..(392): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggctccggggaaggggccggagtggggtggccaacataatgcaagatggaactgagaagaactatgtggactctgtagaagggccgattcaccatctccagagacaaacactaagaacttactgtaatctgaccaaaatgaaacagcctacagagccgaaggacacggctgtagtattacngtgacgaagagcaggtggctggggacagtcgggacgtcgtcggggaccaaggggaccctacgggtccacccgttcctcccttcgacgccctcccaacccgaaacgggcccctaagttccggttacccttcccccgtcgggcccgtccccgtggcccgttcccgaagggaccgtacccgacccgtcccgaacggaccggtccaaccgaccgggcccgggccccgtacggggg

SEQ ID NO: 38485 - DNA, 733 bp, Homo sapiens
  misc_feature: GYAE6OF02IBPE0.18.14.B03.1.454.CMB.1.raw
  modified_base (255)..(255): a, c, t, g, unknown or other
  misc_feature (255)..(255): n is a, c, g, or t
tcagtacgagtatgcacgaccggtgctcgattttagtgtgagtagtttagggtttggggggggggtctcgggaggaggacagcgctctcgggacgtcgtccaccatcggcctggggccttcgtgctatcctcaccctcctcactcacggcacagggtcctgggcccaggtctgccctgactcgaacctgcctcgtgtctgggtcctccgtggtacaggtcgactccgaacctatcctcctgccacgtcggaaccngcaggtacgacggttggtaggttaactaacgtgttcgttactcgttacggtaacctaacgtacgaccaaccgacggaaccaaaccggaaccccctaaactaccgaattacgtaactttacgtacgtacgtcgtacgtaagttacgtccggtaccgttacggtacgggttctaacgtccgtacttctcgtcggtcctacgtaagtccgtacggactaaccgaccggtcctccgtacggtacctacgtcccttacggtcggtcccgtacgacgggtccgtacggaacggtaaccggtggaccgttaagtacgttttacgttaacgttggaccttacgacttactaagtaactacggtaacacgtaagacgtaacggtctaacgtcggaacgttaccggtacggacgtacggacggtaacgtccgtaaccgtcggtaccgtacgaccgtaccgtaacgccctaacgtctccgtaccttccg

SEQ ID NO: 38486 - DNA, 617 bp, Homo sapiens
  misc_feature: GYAE6OF02IRVI8.18.14.B03.1.454.CMB.1.raw
  modified_base (404)..(404): a, c, t, g, unknown or other
  misc_feature (404)..(404): n is a, c, g, or t
tcagtacgagtatgcacgaccggtgctcgatttagtgtgagtagtttgggctgagctgggttttccttgtttctattttaaaaggtgtccagtgtgaggtgcagctggtggagtccggggggaggcttggtccagcctggggggtccctgaaactctcctgtgcagcctctgggttcaccttcagtggctctgctatgcactgggtccgccaggcttccgggaaggctggagtgggttggcgtattagaagcaaagctaacagttacgcgacagcatatgctgcgtcggtgaaaggctaggttcaccgtctaccagaatgattacgaaagaacacggcgtatctagacaaatgaacagacctagaaaaccgaggaccacggcctgtacttactgtaactagacngggtgattacgtagtttaggggagttagtcggacggtaaacggggggtactacgtacgacgtagtggacgtcgtcgggaccgaacgggaccgtacggtcgaccgtcgtcctacgacgccctccgaccgaacggcccacgtccggtcccttccccggtcgaccctaccctcccgtaccacgacgccgtaccgtcggtcgggtaccgacgaccgg

SEQ ID NO: 38487 - DNA, 680 bp, Homo sapiens
  misc_feature: GYAE6OF02IMHRF.18.14.B03.1.454.CMB.1.raw
tcagtacgagtatgcacgaccggtgctcgatttagtgtgagtagtttgggctgagcgtggttttcttgttgctatttaaaaggtgtccagtgtgaggtgcagctggtggagtccggggggaggcttggtccagcctgggggtccctgaaactctcctgtgcagcctctgggttcaccttcagtggctctgctatgcacgtggtccgccaggcttccgggaaagggctggagtggttgccgtattagaagcaaagctaacagtacgcgacagcatatgctgcgtcggtagaaaggcaggttcacgtctccagaatgattcaaagacacgcgtactctagacaaagtgaaacagaccctaagaaaaaccgaggacgtaacggccgtagttaattaccgtagttaactacgaacgtagggttaggtaatttacggtaagtttagggggtagttaacgtacggtaacggtaaacgggggggtaacctaacgtaacgtacgttaagtcggtaacgttcggtacgggtaccgaacgggacccgaacggtaccgtaacccggttcctacccgtacgaccgtccgtacccaacccgtaacgggaccctacgtccggtcccttccccgtccggaccctcccgtacccgtacctaacgacgtacccgacccgtcggtcgggtacaaccgg

SEQ ID NO: 38488 - DNA, 701 bp, Homo sapiens
  misc_feature: GYAE6OF02HSRF8.18.14.B03.1.454.CMB.1.raw
  modified_base (337)..(337): a, c, t, g, unknown or other
  misc_feature (337)..(337): n is a, c, g, or t
  modified_base (590)..(590): a, c, t, g, unknown or other
  misc_feature (590)..(590): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggagcttggtccagcctgggggtccctgaaactctcctgtgcagcctctggttcaccttcagtgctctgctatgcacgtgggtcccgccacgggtccttacccgggggaaagggccgttgggaggttggggtttcggaccgttaatttaggaaagccaaaagctaacagttacgcgacagcatatgctgcgtcggtgaaaggcgtaggtccaccgtcnccgaagaactgtattacaaagaaccgacgggcttaatctagactaaaagtcgaaacgagtcctaaggaaaacccgaggtaaccacggtcgtagttaattacctagtaacctaggacgtagggttagtaagttacgtaggtttaggggtaagttacggtacggaacgggtaaacggggggtacctacgtacgtacgtagttcggacgttcgtacggggaccgaaccgggaccgacggtacgacccgttcgtccncgaccgccaccgacgaaccggtcccacgttcccggtcccgttaccccgcgaccctaccccgttccgtaccgacgtaaccgccgacccggtccgggtacgggacctaaccgg

SEQ ID NO: 38489 - DNA, 794 bp, Homo sapiens
  misc_feature: GYAE6OF02HW3T7.18.14.B03.1.454.CMB.1.raw
tcagtacgagtatgcacgaccggtgctcgatttagtgtgagtagtttgggcgtgagctggttttccttgttgcctattttaaaaggtgtccagtgtcgaggtgcagctggtggacgtccggggagcttggtccagcctcgggggtcctgaaactctcctgtgcagcctcgtggttccaccttcagtcgctctgctatggacacgtcggtcccgccaggccgttaccgggaaagggcctagggagtgggttcggaccgttagttaacgaacgacaaagctaaacgacgttaaccgcgaacacggaccataacgtcgaccgttggccgttccgggtaggaaaacggtccgtaagggttttacccacccggttacttacccaaaggaaaaattcgggaactttaaccgaaaaggaacccgtaaccgggccgttaattaccgttcggaaacctaaaagttccggaaaaccgtaaggtccccgttaaacgggaaaaaacccggtaggaacctacccgggtacccgtagttaactttaaccgtagtaaccttagaacgtagggtacggtaacgttaacgtaaggtttaggggtaagtttagttccgtaacgggtaaacggggggttacttaacgtacgtacgtagtacggacgtccgtagggaccggtaacgggccgtaccggtaccgtaccgtcctccgtcgacgcccgtacgaccgacgaccgacgtccgtaccgttccccgtcgaccctacccgtacccgtaccacgacgtcctacccgtacggtcggtactaccgg

SEQ ID NO: 38490 - DNA, 726 bp, Homo sapiens
  misc_feature: GYAE6OF02I76OG.18.14.B03.1.454.CMB.1.raw
  modified_base (197)..(197): a, c, t, g, unknown or other
  misc_feature (197)..(197): n is a, c, g, or t
tcagtacgagtatgcacgaccggtgctcgatttagtgtgagtagtttggctgagctggtttccttgttgctatttaaagtgtccagtgtgagtgcagctggtggagtccgggagcttggtccagcctggggtccctgaaactctcctgtgcagcctgtgggtcaccttcgagtggctcgtgctatgcacgtggtccnccgaggccgtacggaaaggctaggagttgggttgccgtagtagacgacgaagtccgtaacagttacgcgacagctaatgtcgctcggccgtcggtagaaacggtccgaggttccacgttctaccgagtaaactgtacgtaccgaaaagtacgacggtacgttactcggtacgtacgtaaaagtcgaaaccgtcggtaccgtaaacggtaaaccgaccggtaacgtaccggtaccggttagttaacgttaccgtacgtaaccgtacgacgtaggtccgtaagttacgttaggttcgggtaacgttagtacccggtacgggtaaacgggtactaacgtacggttaccgtaagttacggtaccggtccgtacgggacgttaaccgggccgtaacggtaccgtaccgtccgttaccgtacgaccgttcccgacgttaaccgaccggttacccgacgtccggttacccgttcccgaggtacccctccgtaccgaccgttagacccgtaccgtacgttcggacggtacctaccgg

SEQ ID NO: 38491 - DNA, 650 bp, Homo sapiens
  misc_feature: GYAE6OF02FPL72.18.14.B03.1.454.CMB.1.raw
  modified_base (332)..(332): a, c, t, g, unknown or other
  misc_feature (332)..(332): n is a, c, g, or t
  modified_base (395)..(395): a, c, t, g, unknown or other
  misc_feature (395)..(395): n is a, c, g, or t
tcagtacgagtatgcacgaccggtgctcgatttagtgtgagtagtttgggctgagctgggttttccttgttgctatttaaaaggtgtccagtgtgaggtgcagctggtggaggtccggggtaggcttgggtccagccgtgggggttccctgaaactctcctgtgcagcctctggttcacctcagtgctctgctatgcactgggtccgccagggcgttccggggaaagggctggacggttgggttgccggttattaggaagcaaagctaaccaggttacgcgacagcatatgctgacggtcgggtgaaaacggcaggttccaccgtctccganaaactgaattacaaagaaccgacggtcgtaatcctgacaaatgaacacgcctaggaaacccgnggacacggccgtagtattaacgtgtactagacaggtggaattacgagttagggtagttacgtcggacggtaaacggggggttactaccgtacgcttagtcggtacgtcgtcggggcccgaacgggaccgacggtctaccgtctaccctcacgccctaccgaccgacgggtcccacgtccggtcccgtccccgtcggccctacccctcccaccgaacgaccgaccgtacccgtaccggtcggggtacctaacccgg

SEQ ID NO: 38492 - DNA, 643 bp, Homo sapiens
  misc_feature: GYAE6OF02F1SGW.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtagaaaggcaggttcaccgtctccagaaatgattacaaagaacacggcgtatctagacaaatgaaacacgacctaagaaaaccgaggaaccacgggaccgttagtaacttacgtgtaactagacaggtgtattagtagtttggggagttagtcggacggtaaacggggggtactacgtacgacgttagtcggtacgtcggtcgggaccgaacggggaaccgtacggtaccgtaccgtcgtacctcgacgccgtaccaccgaacggccacgtccgtccgtccccgtcggtaccctaccccgtcccgtacccgaacggaccgaccgtacccgtcggtaccggggcgtaacccgg

SEQ ID NO: 38493 - DNA, 708 bp, Homo sapiens
  misc_feature: GYAE6OF02GR9AK.18.14.B03.1.454.CMB.1.raw
  modified_base (376)..(376): a, c, t, g, unknown or other
  misc_feature (376)..(376): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcacgtgggtccgccaggcttccgggaaagggctggaggtgggttggccgtattagaagcaaagctaacagttacgcgacagcatatgctgcgtcggtagaaaggcaggttcaccgtctcagaatgattacaaagacacggctatctagacaaatcgaacacgacctaacggaaaaccgnggaaccacggcccgttagtaactttacgtacgtaacgtaaggaccgtaagggtcggtaagtttaacgtaaggttttagggggtaagtttaacggtacggtaaccgggtaaaaccggggggggttaactaaccggtacggtacgttaagtacgggtacggttccggtacggggaccgaacgggacccgtaccgggtaccgacccgtcctaccgtccgacgccctaccgaaccgaccggaccctacgtacccggttcccgttccccgtacgccctaccccgtacccgtacccgaaccggaccgacccgtaccgtccgggtcgggaccaacccgg

SEQ ID NO: 38494 - DNA, 625 bp, Homo sapiens
  misc_feature: GYAE6OF02JDMYY.18.14.B03.1.454.CMB.1.raw
  modified_base (208)..(208): a, c, t, g, unknown or other
  misc_feature (208)..(208): n is a, c, g, or t
  modified_base (272)..(272): a, c, t, g, unknown or other
  misc_feature (272)..(272): n is a, c, g, or t
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccnccaggcttccgggaaggctggagtgggttgccgtattagaagcaaagctaacagttacgcgacngcatatgctgcgtcggtgaaaggcaggttcaccgtctccagaatgattacaaagaacacggctatctagcaaatgaacngacctagaaaaccgnggaacacggccgtagtattactagtacctagacaggtgattactagtttggggagttagtcggtaggaaacggggggtactacgtacgacgtagtaggtacgtcgtcgggaccgaacgggaccgacggtccgtaccgtctccgtacacgccctacccgaccgacgggtcccacgttccggtcccgttcccccgtacggtccctacccgttcccgtacccgaacgccgtacccgtaccgtcggtaccggggcctaaccgg

SEQ ID NO: 38495 - DNA, 760 bp, Homo sapiens
  misc_feature: GYAE6OF02G9QE9.18.14.B03.1.454.CMB.1.raw
  modified_base (297)..(297): a, c, t, g, unknown or other
  misc_feature (297)..(297): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaaggctggagtgggtggccgtatagaagcaaagctaacagttacgcgacagcatatgctgcgtcggtagaaaggnaggttcaccgtctaccagaatgattacaaagacacggcgtatcgtgacaaagtgaaacagaccgtaagaaaaccggaggaacctaaccgggccgtagttaactttacgtacgttaacgttaacggaacctaggggttaggtaacgtttaacgtaaggttttaggggggtaaacgtttaaggttaccgggtaaccgggtaaaacgggggggggttaacctaaccggttaaccggtacgttaacggtacgggtaaccggttaccgggtacgggggaacccggtaaaccggggtacccgtaacccgggtacccgtacccgggttaccctcccgttaccgtaccgtccccgtacccaacccggaacccggcccgtacgttcccggttcccgttccccgtccggaccctaccccgtcccctacccgaacgaccgacccgtacctcccgggtacgggccctaacccggg

SEQ ID NO: 38496 - DNA, 570 bp, Homo sapiens
  misc_feature: GYAE6OF02HP22J.18.14.B03.1.454.CMB.1.raw
  modified_base (223)..(223): a, c, t, g, unknown or other
  misc_feature (223)..(223): n is a, c, g, or t
  modified_base (266)..(266): a, c, t, g, unknown or other
  misc_feature (266)..(266): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (569)..(570): a, c, t, g, unknown or other
  misc_feature (569)..(570): n is a, c, g, or t
tcagtacgagtatgcacgaccggtgctcgatttagtgtgagtagtttgggtttgtgggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttangatgtcactaatccggccctcgaggggtttctaatcgctttcnctggctcaagtctggcaacacggcctcctgaccatctcgtagggctccgaggctggaggacgaggctgattattacngcngctnatatacaagcacagcactctctatcgtcgttaccgaacgtcgggaacctaggtcctaccgtccgtagtccgacgacccgtaaacggccccaaacccgtcttacggtacctaaccgttcccgttaccgttaccccctacccgttcctacccgtattacccgttcctaacgtcggacgccggtactcgggacaacgggccataacgtcgntnatgatgacnn

SEQ ID NO: 38497 - DNA, 665 bp, Homo sapiens
  misc_feature: GYAE6OF02HQYPY.18.14.B03.1.454.CMB.1.raw
  modified_base (314)..(314): a, c, t, g, unknown or other
  misc_feature (314)..(314): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtagaaaggcaggttccaccgtcnccagaatgattacaaagacacggctatctagacaaatgaacagacctagaaaaccgaggacgacggcgtagtattactgtaactagacgaggtggtattacgtagtttagggggtagttacgtcggaacgggtaaacgggggggtactaacggtacgtacgtacgtcgggtacggttcgtacgggggaccgaaacggggaccctacgggtaccacccggtcctccctacgacgtcccgtcccaaccggaaccggacccacggttcccggtcccgttcccccgtccggtacccgtccccttaccctacccgaacgaccgtaccctacccgtaccggtacggggcctaaccgg

SEQ ID NO: 38498 - DNA, 626 bp, Homo sapiens
  misc_feature: GYAE6OF02HYQCS.18.14.B03.1.454.CMB.1.raw
  modified_base (338)..(338): a, c, t, g, unknown or other
  misc_feature (338)..(338): n is a, c, g, or t
tcagtacgagtatgcacgaccggtgctcgatttagtgtgagtagtttgggctgagctgggttttccttgttgctatttttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaaggctggagtgggttggccgtattagaagcaaagctaacagttacgcgacagcatatgctgcgtcggtgaaaggcaggttcaccgtctccagaaatgattacaaagaacacggntatctgacaaatgaaacagacctagaaaaccgaggacacggtcgtagtattacgtagtactagacagggtaggattaacgtagtttgggggtaagttagtacggacggtaaacgggggggtactacgtacgctagtggacgtcgtggggaccgaacgggaccgaacgggtcaccgtctccgtcacgtcctccaaccgaacgggacccacgtccggttaccgttccccgtaccggccctacccgtaccctaccgaacgacgacctacccgtcggtcggggacctaccgg

SEQ ID NO: 38499 - DNA, 623 bp, Homo sapiens
  misc_feature: GYAE6OF02GLGAQ.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaatgattacaaagaacacggcgtatctgacaaatgaacagcctagaaaaccgaggacacggccgtagtacttactgtactagacgaggtggtattacgtagtttggggaagttagtacggtacggaaacgggggggtactacgtacgcgtagtggacgtcgtggggaccgaagggaccgacggtacgtacccgtactccgtccgacgcccgtacccgaccgaacggcccgacgtccggttcccgttccccgtcggccctacccgtccctaccgaacgacgaccacccgtcggtcggggacctaccgg

SEQ ID NO: 38500 - DNA, 773 bp, Homo sapiens
  misc_feature: GYAE6OF02HDBHF.18.14.B03.1.454.CMB.1.raw
  modified_base (117)..(117): a, c, t, g, unknown or other
  misc_feature (117)..(117): n is a, c, g, or t
  modified_base (128)..(128): a, c, t, g, unknown or other
  misc_feature (128)..(128): n is a, c, g, or t
  modified_base (141)..(141): a, c, t, g, unknown or other
  misc_feature (141)..(141): n is a, c, g, or t
  modified_base (161)..(161): a, c, t, g, unknown or other
  misc_feature (161)..(161): n is a, c, g, or t
  modified_base (186)..(186): a, c, t, g, unknown or other
  misc_feature (186)..(186): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (225)..(225): a, c, t, g, unknown or other
  misc_feature (225)..(225): n is a, c, g, or t
  modified_base (764)..(764): a, c, t, g, unknown or other
  misc_feature (764)..(764): n is a, c, g, or t
tcagtacgagtatgcacgaccggtgctcgatttagtgtgagtagtttgggttcgggggaggcttggtccagcctgggggtccctgaaactctcctgtgcagccctgtggtctcctcngtgctctgctntgcagtcggtccncgagtcgtacgggagcgtgnggtggtcgctatagagacagacaanagtcgcganagcatngcngcgtggagagcgtacgttccncgtcacaagtatgtatacgaaagaccgacggtactactcgtcgaactaagtacgaacgacgtaccgtaaacggaaaacccggacggaaccggaccgggtaccgttagttacttacgttacgtacgtaacggtaacgtagggtagtaacttaacgttagggtttagggggtaagttacgtccggaaacgggggttaaacggggggttacctaaccggtcgtacgtttagtacgggtaccgttcgggtacgggaccggtaaaccgggacccgtaccgggtaccgtacccgttccgtacccgtaccgaccgtcccctacccgaaccggtaacccgggaccctacggttcccgttccccgttccccggtaccgtaccccgttaccccttacccgtaaccgaacggtacctaccccgtacccgtcccggggtaccgggacccgacggacccggtcccggtaccggtccgggtcctccggtccgtacggtaccgtaaccgtaccttacctacccgtactaccgttcgtcgcggaccggtcggcgngaccggacg

SEQ ID NO: 38501 - DNA, 863 bp, Homo sapiens
  misc_feature: GYAE6OF02G2WXW.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagccgtggggggtccctgaaactctcctgtgcagcctcgtgggttcaccttcagtggctctgctatgcacgtcgggtcccgccgaggtccgttaccggggaaagggtcgtgggtaggttgggggttcggaccgttaagttaaggaacggaccaaaaggcctaaacgacggttacgaccgacgagacaatagtcgccgtaggccggttacgggtaggaaaacggtcgtaacgggttccacccggtacctaccgaaggtaaaagttgtaaacttaaccgaaaaacggaaccggacgggtacgttaactcgtacggaacaaaagtacggaaaccgaacggtaacccgtaaacgggaaaaaccggtcggaaaccgtaccgggtacccgtttagttaacgtttaaccgtacggtaacgtaggtaacggtaggggtacggtaagtttaacgtagggtttagggggtaagtttacggtaccgggtaacggggtaaaccggggggttaacctaacgtacgtacgtacggtacgggtaccggtcggtacggggaccgaacgggtacccgaccgggtaccctacccggttacctcccgtaccgtaccgtcccgtacccgaaccgtaccgggaccctaccggttacccggtcccgttccccggtaccggtacccctaccccgttacccgtacccgaacgtaccgtacccgtacccggtccgggtaccgggaccgtaacccgg

SEQ ID NO: 38502 - DNA, 605 bp, Homo sapiens
  misc_feature: GYAE6OF02GD0D7.18.14.B03.1.454.CMB.1.raw
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (512)..(512): a, c, t, g, unknown or other
  misc_feature (512)..(512): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcacgtgggtccgcaggcttccgggaaggctggagtgggtgccgtattagaagcaaagctaacagttacgcgacagcatatgctgcgtcggtgaaaggcaggttcaccgtctccagaaatgacttcgaaagacacggntaatctgcaaatnaacagctagaaaaccgaggacacggccgtgtaattactgtactagacgaggtggattacgtagtttaggggtagttacgtacggtacggaaacgggggggtactaacgtacgtacgttagtaggacggttcgtagggaccgagggaccgacgtcgaccgtctccncgacgcctaccgaccgacggccacgtccgtccgtccccgtcgtccacccgtcctacccgacgtacgaccgtaccgtcggtcgggtaccaccgg

SEQ ID NO: 38503 - DNA, 606 bp, Homo sapiens
  misc_feature: GYAE6OF02FXMD4.18.14.B03.1.454.CMB.1.raw
  modified_base (208)..(208): a, c, t, g, unknown or other
  misc_feature (208)..(208): n is a, c, g, or t
  modified_base (358)..(358): a, c, t, g, unknown or other
  misc_feature (358)..(358): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccnccaggcttccggggaaagggctggagtgggttggccgtattagaagcaaagctaacagttacgcgacagcatatgctgcgtcggtgaaaggcaggttcaccgtctccagaaatgattacaaagaacacggcgtatcagacaaatgaaacngacctaggaaaaccgaggaaccacggaccgtagtattactagtactagacaggtgtattacgtagtttggggattagtacggacggaaacggggggtactacgtacgacgtagtggtacgtcgtacgggaccgaacgggaccgtacggtacaccgtacctcctacgacgcctaccaccgacggacccacgtccgtccgttccccgcgccctaccctcctaccgacgcgaccaccgtcgtcgggcacgg

SEQ ID NO: 38504 - DNA, 614 bp, Homo sapiens
  misc_feature: GYAE6OF02FI59L.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgacaaatgaacagcctagaaaaccgaggacacggccgtgtaattactgtactagacaggtgattacgtagtttggggagttagtcgacggaaacggggggtactacgtacgcgtagtggtacgtcgtcggggccgaacgggaccgacggtccaccgtcctcctccgacgccctacccgaccgaacgggccctacgtcccggtccgttcccccgcggtccctaccctcccgtacccgaacgaccgaccacccgtccgtcggggaccaaccgg

SEQ ID NO: 38505 - DNA, 615 bp, Homo sapiens
  misc_feature: GYAE6OF02I390W.18.14.B03.1.454.CMB.1.raw
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
  modified_base (532)..(532): a, c, t, g, unknown or other
  misc_feature (532)..(532): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtccctgaaactctcctgtgcagcctctgggttcaccttcagtggctctgctatgcactgggtccgccaggccttaccggggaaagggctggaggtgggttggccgtattagaagcaaaaaaagctaacagttacgacgacagcatatgctgcgtcggtgaaaggcaggttcaccgtctccaagaaactgattacaaagaacacggngtaatctnacaatagaacagcctagaaaacgnggacacggaccgtgtaactagtcgtactagacaggtagattacgtagtttggggtattagtacggaggtaaacggggggtactacgtacgtacttaggtaggacgttcggtcggggacgaacgggaccgtacggtccaccgtctcctcgacncctcaaccgacggaccactccggtccgtccccgtagcctaccctccaaccgacgacgcccgtaccgtcggtacgggcgtacgg

SEQ ID NO: 38506 - DNA, 642 bp, Homo sapiens
  misc_feature: GYAE6OF02F2YY6.18.14.B03.1.454.CMB.1.raw
tcagtacgagtatgcacgaccggtgctcgatttagtgtgagtagtttgggttgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaagcaggttcaccgtctccagaaatgattacaaagaacacggcgtatctgacaaatgaacagcctaagaaaaccgaggaccacggccgtagtaatactgtactacgactaggtgtactactagtttaggggagttagtacgacggtaaacggggggtactacgtacgactagtaggtacgtcgtcgggacgaacgggaccgacggtaccgaccgttcctaccgtacgaccgtccgtacccgaaccgtaacgggaccctacgtccggttcccttcccccggtcggtaccctaccccgtccctacccgaacggacgcccgtacccgtccggtcggggaccctacgaccgg

SEQ ID NO: 38507 - DNA, 811 bp, Homo sapiens
  misc_feature: GYAE6OF02FG839.18.14.B03.1.454.CMB.1.raw
tcagtacgagtatgcacgaccggtgctcgatttagtgtgagtagtttgggctgaggctgggtttccttgttgctatttaaaaggtgtccagtgtgaggtgcagctggtggagtccggggaggcttggtccagccgtgggggtccctgaaactctcctgtgcagcctctgggttcaccttcagtggctctgctagtgccacgtcgggtcccgccagggtccgttaccggggaaagggcctgggacggttgggttcggccgttattaggaagcgaaagtcctaacgacgttacgcgactacgcatactcgctgcgtcggtagaaacggctaggtttccaccggttacctaccgaagtaaacttcggtaacttaaccgaaaaaggtaccgaccgggtcgttaacgtcccgtaaggtacctaaaaggtcgaaaaccgtacggtaacccgtaaacgggaaaaaccccggcggggtaaacccgaccggggtacccgtttaacgggttaaactttaacccgtacggttaaacccgtaacggtaacgtagggttacggttaacgtttaacgtagggtttacgggggtaacgttacgtaccgggtaccgggtaaaccggggggttacctacgtacgtacgttacggtcggtacgtaccggtacgggtaccgaacgggtaccgtaccggtaccgaccgttcctaccgtaccgacgtccctaccgaccgtaccggaccctacgtcccgtcccgttccccgtccgacccctaccccgtacctaccgacgaccgaccgtaccgtcgggtccgggacctaaccgg

SEQ ID NO: 38508 - DNA, 612 bp, Homo sapiens
  misc_feature: GYAE6OF02IYL4W.18.14.B03.1.454.CMB.1.raw
  modified_base (209)..(209): a, c, t, g, unknown or other
  misc_feature (209)..(209): n is a, c, g, or t
  modified_base (376)..(376): a, c, t, g, unknown or other
  misc_feature (376)..(376): n is a, c, g, or t
  modified_base (538)..(538): a, c, t, g, unknown or other
  misc_feature (538)..(538): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcacgtgggtccnccaggcttaccgggaaaggctggagtgggttggccgtattagaagcaaagctaacagttacgcgacagcatatgctgcgtcggtagaaaggcaggttcaccgtctaccagaaatgatacaaaagaacacggctatctgacaaatgaaacagacctaaggaaaaccgnggacacgggcgtagtattacgtgtaactaagacgtagggtggtattacgtagtttaggggtagttagtacggacgggaaacggggggtactaacgtacgtacgtagtggacgtcgtcgggaccgaacgggaccgacggtacgaccgtcctccgtcacgtccnccaaccgacggcctacgtccgtccgtcccgtcgccaccctcctaccacgacaccgtaccgtcgtcgggcaccgg

SEQ ID NO: 38509 - DNA, 609 bp, Homo sapiens
  misc_feature: GYAE6OF02JFWOP.18.14.B03.1.454.CMB.1.raw
  modified_base (434)..(434): a, c, t, g, unknown or other
  misc_feature (434)..(434): n is a, c, g, or t
tcagtacgagtatgcacgaccggtgctcgatttagtgtgagtagtttgggttcgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagacacggcgtatctgcaaatgaacagcctagaaaaccgaggacacggccgtgtattactgtactagacaggtgattacagtttgggggagttatcgacggaaacgggggggtactacgtacgctagtggtacgtcgtggggccaagggaccacggtcaccgtctcctcngcctccaccgaacggcccagtccgtccttccccgtcgcccaccctccctaccacgcgccacctcgtcggggccacgacgccggcccgtcggcctcgtcccgtggtccaacggtaccttaccttacccgattaccgtacgttaccgtcggacggtccgggctcggaccgtaacggg

SEQ ID NO: 38510 - DNA, 785 bp, Homo sapiens
  misc_feature: GYAE6OF02H71VW.18.14.B03.1.454.CMB.1.raw
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
  modified_base (409)..(409): a, c, t, g, unknown or other
  misc_feature (409)..(409): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagccgtgggggtccctgaaactctcctgtgcagcctctgggttcaccttcagtggctctgctatgcacgtgggtcccgccaggccgttaccggggaaagggctgggaggttggggttcggccgttagttagaagcaaaagctaacagttacgcganagcatatgctggacgtcgggtagaaaggccgtaaggttccaccgtctaccgaagtaaatgactacaaagtaaccncggtatatctaggaactaaancgaaacacgtaccaagaaaaccggnggaacacccggtcgtagttatactagtaactagaacgtagggtgtaagttacgtaggtttaggggtagttagtacggaacgggtaaacggggggtaacttaaccgtacggacttaaggtacgggtaccggttaccggtacgggggtacccggaaacgggtaacccggtaaccgggttaaccccgtaccggtaccccgtaccctaccggtaccgtaccccgtaccccgaaaccgaacccggggtaaccccgaccgtttcccggttacccccggttccccccggtaccggtcccccgaaaccccccgttccccgttaaacccggaaccggtacgtaaccccggttaccccgtaccgggttccggggaccctaacccgg

SEQ ID NO: 38511 - DNA, 706 bp, Homo sapiens
  misc_feature: GYAE6OF02ITAYU.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtcccgccaggccgttaccggggaaagggcgtgggtaggtgggttcggccgtagttagaacgacaaagacctaacgaggttacgcgacagcatatgctgcgtcggaggaaagcgtaggtcaccgtctaccaagaaatgattacaaagaacacggcgtatctgacaaatgaacacgacctaagaaaaccggagacgacggaccgtagtacttacgtgtactagacgaggtgaattacgtaggtttaggggtagttacgtacggaacgggaaacggggggttactaacgtacgtaccgttagtcgggaacggttcggtacggggtaccgaacggggtaccgacgggttaccaccggttccctccgtaccaccggtaccctaccgaacccggaaccgggcccgtaccgttcccgtcccgtttaccccccggtagggcccctaaccccgttcccttaaccgaacggaccgtacccgtaccgtcccgggtacggggccctaacccggg

SEQ ID NO: 38512 - DNA, 280 bp, Homo sapiens
  misc_feature: GYAE6OF02FJ3WF.18.14.B03.1.454.CMB.1.raw
  modified_base (264)..(280): a, c, t, g, unknown or other
  misc_feature (264)..(280): n is a, c, g, or t
tcagtacgagtatgcacgaccggtgctcgatttagtgtgagtagtttgggggagttatcgcaaacggggggggtactactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttcccatactcgtactgagcgggctggcaaggcgacatagnnnnnnnnnnnnnnnnn

SEQ ID NO: 38513 - DNA, 658 bp, Homo sapiens
  misc_feature: GYAE6OF02F5XNQ.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgcaggcttccgggaaggctggagtggtgcgtatagagcaagctaacagttacgcgacagcatatgctgcgtcggtgaaaggcaggttcaccgtctccagaatgattcaaagacacggcgtatctagacaatgaacagcctagaaaccgagacacggcgtgtattacgtgtactagacaggtgattacgtagtttaggggtagttagtcggacggtaaacggggggtactacgtacgtacgtagtggtacgtcgtcggggaccgaacgggaccgaccggtactacccggtcctaccgttccgacgtacccgtacccgaacccgtaaccgggtacccgacgttcccggttccccgtttccccccggtccggtacccctacccccttccccgtaacccgtaaccggaccgtacccgtaacccgttccgggtaccgggggtacccgtaacccggg

SEQ ID NO: 38514 - DNA, 981 bp, Homo sapiens
  misc_feature: GYAE6OF02GUGM5.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccggggaggcttggtccagcctgggggtccctgaaactccctcgtgtcgacgccgtccttcggttcggtaccttccgtacgtggtcgtctcgtcgtattagcgaccgtcgggtcccggtcccgaccggtaccggttacccgggtaaacggggaacggtcggtaggtaggggttgggtccggtacgttaagtaagaacgaaacgaacgtaacgaacgttacggtaccgacgacgacgactaagtgcgtgtcgtcggtacggaaaggacgtacggttacgtacccgtccgtacccgtaacggaaaagtacgtaacgttaacgtaaaaggtaaaaccgaaccggtaccggtaacgttacgtcgtaccgaaagtaacgtaacgaacgtaccgtaccggaaaaacccggaaacggtaccgaaccgggtacccgttacgttaacgtttaccgtttaacggttaaccgttaaacggtaacggtaacggtaacgggtaacgttttaacgttaacgggtttagggggttaacggtttaagttaccggaaccggggtaaacgggggggtttaaaccggtaaccgttaccggtacggttaacgttaacgggtaccggttaccggttcggggaaccgggtaaaccgggtaaccggtaaccccgggttaccgggtaaccccgttacccgttccccgtttaccgacccggtaccccttaccccgaaacccggtaacccggacccggtacccgtaccggtttcccccgtttaccccccggtccggttaacccccgccccccgtttacccgtaccccggaaccgtaccggtaccccgtacccggtttaacccgggcggggtacccccggtactacccccgggg

SEQ ID NO: 38515 - DNA, 696 bp, Homo sapiens
  misc_feature: GYAE6OF02I4YJF.18.14.B03.1.454.CMB.1.raw
  modified_base (279)..(279): a, c, t, g, unknown or other
  misc_feature (279)..(279): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
tcagtacgagtatgcacgaccggtgctcgatttagtgtgagtagtttgggctgagcgtggttttcgtgttagctatttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaaggctggagtgggttgccgtattacgagcaaagctaacgagttacgcgacagcatangctgcgtcggtgaaaggccaggttcaccgtctaccgagaaatgattacaaagaacncgacgtatctgacaaatgaacngacctagaaaaccgnggaacacggccgttagtaacttacgtacgtaactagtacgagggtgtattacgtagtttagggggagtttaacgtcggtaacggaaacgggggggtaacttacgtaacgcgttaacgtcgggtaccgttcggacggggtaccgaaacgggtaccgtaaccgggtccgtaacccggtcctccttcgacgtcccgtaccctaacccgaacgggtcccctacgtcccgggttaccctttcccccggtggtacccctaccccgttacccgtaccgtaaaccggacggtacccgtaaccccgtaccggtaccgggggacgtaaccccgg

SEQ ID NO: 38516 - DNA, 572 bp, Homo sapiens
  misc_feature: GYAE6OF02FVVTA.18.14.B03.1.454.CMB.1.raw
  modified_base (498)..(498): a, c, t, g, unknown or other
  misc_feature (498)..(498): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (550)..(550): a, c, t, g, unknown or other
  misc_feature (550)..(550): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctgggggtccctgaaactctcctgtgcagcctctgggttcaccttcagtggctctgctatgcactgggtccgccaggctccgagggaagggctgggagtgggttggccgtattaaaaccaaaactgatgggtgggacaacagactacgctgcacccgtagaaaggcagattcaccatctacaagagatgattacgaaaaagcaacgctgtatctagactaaatagaacagactagaacgaaccgaggacaacgacgcgtagttaacttactacgtaaccacactccctagaaacgcgtacaactactactacgtacgtactcgacctgcgggaccaacgggaccacggtcacccgtctcctcncgcctaccacacggccacgtccgtcctcccgcgccncccgtnccgccaggcnccgacctacgacgacgcaccgg

SEQ ID NO: 38517 - DNA, 621 bp, Homo sapiens
  misc_feature: GYAE6OF02IY1DQ.18.14.B03.1.454.CMB.1.raw
  modified_base (377)..(377): a, c, t, g, unknown or other
  misc_feature (377)..(377): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcgttaccgggaaggctggagtgggttggccgtattagaagcaaagctaacagttacgcgacagcatatgctgcgtcggtagaaaggctaggttcaccgtctacagaatgattacaaagacacggcgtatcgtagacaaatcgaacacgacctaagaaaacccgnggacacggtcgtagtacttacgtgtaactaaggaaggtgtagttacgtaggttaggggtagttagacggtacgggtaaacgggggtactaacgtaccgtacgtagtcggtacgtcggcgggaccgaacgggaccgacggtcctaccgtctccgtacgacgccgtaccaccgacgcctacgtccgtcctccccgtcgccctaccctccgtaccgacgcgacctaccgtcggcgggacacgtccgg

SEQ ID NO: 38518 - DNA, 690 bp, Homo sapiens
  misc_feature: GYAE6OF02H0EWR.18.14.B03.1.454.CMB.1.raw
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
tcagtacgagtatgcacgaccggtgctcgatttagtgtgagtagtttgggtcgtggaagctcgggtttccttgttgctactttaaaaggtgtccagtgtgagtgcagctggtggagtccggggaggcttggtcctagcctgggggtccctggaaactctcctgtgcacgcctctgggttcaccttcagtggctctgctagtgcacgtggtccgcgaggcttcgggaaggctggagtggtgccgtatagagcaaacgctaacngttacgcggtacngcatatgctgcgtcggtgaaaggcgaagggttcaccgtcgtaccgaagaaactgattcgaaacgacgacgggtctaatcgtggaccaaagtgaacgcgacagaaaccgaggtacaacgggcctaggttactactacgtacttaacgacgaggtagtaacgtaccgtagtttacggggtagtagttacggacgtaaacggggggtactacgtacgacgttagtaggtacgtacgtacgggacgtaacgggaaccgtacggttaccgacgtccgtaccttcgacgtcccgttacaacccgttacgggcccgtaacggtccgttaccggtaccccgttaccgggacctaccccgttacccgtacccgttaacggaacgacccgtttaacccggcgtttacccgggggctaaccccggg

SEQ ID NO: 38519 - DNA, 757 bp, Homo sapiens
  misc_feature: GYAE6OF02F9QQ9.18.14.B03.1.454.CMB.1.raw
  modified_base (211)..(211): a, c, t, g, unknown or other
  misc_feature (211)..(211): n is a, c, g, or t
  modified_base (372)..(372): a, c, t, g, unknown or other
  misc_feature (372)..(372): n is a, c, g, or t
  modified_base (751)..(751): a, c, t, g, unknown or other
  misc_feature (751)..(751): n is a, c, g, or t
tcagtacgagtatgcacgaccggtgctcgatttagtgtgagtagtttgggctgagctggtttccttgttgctatttaaaaggtgtccagtgtgaggtgcagctggtggaggtccggggagcttggtccagccgtggggggtccctgaaactctcctgtgcagcctcgtgggttccaccttcagtggctctgctatgctacgtcgggtcccnccgaggtccgttaccgggggaaagggtcctgggtaggttggggttcgggacccgttaattaggaaacgaccgaaaagaccttaaactacggttacgaccgaacctaggacctaatatgctggtcggttcggaggaaacgggtctaggttcccaccgttccnccgaaagtaacgtagtacttaagaaaacggacctaacgggcctattgtacaataaatgaacctacgacctaaacggaaaaccgtaggacgaacggtcggtattaactagtataccgtaagacgaggtagtattacgtagggttggggatttaggcgaaacggggtaacggggttacacgtacgtgtagtcggacgtcgtacggggaccgtaacgggcctacggtaccgtacgtcctccgttaccggacctaccccgtacccgaaccggtaaccggaccctaccggttacccggtttcccccgtaacccccggttcggaccccttacccccgttccgaaccgtaccggaccctacccggtacccggtcggacccgggganacccgg

SEQ ID NO: 38520 - DNA, 894 bp, Homo sapiens
  misc_feature: GYAE6OF02I5BRW.18.14.B03.1.454.CMB.1.raw
tcagtacgagtatgcacgaccggtgctcgatttagtgtgagtagtttgggctgagctgggttttccttgttgctatttaaaaggtgtccagtgtgaggtgcagctggtgggaggtccgggggaggcttggtccagccgtgggggtccctagaactctcctgtgcagcctcgtgggttcaccttcagtggctctgctatgctacgtcgggtccgccgagggtccgttaccggggaaagggcgtgggtagggtgggttacggccgttaagttaaggaaggacaaaagtaccgttaaaccgtaggttaccggacgtacaggactaatacgtgtcgtggtcggtacggtaaggaaacggcgtacgggttcctaacccgttacctacgaagaaacgttctaaagttaacaaaacggaaccgaacggtaccgttaactacgtaacgtaacgtaaagtacgaaactaacggtacccgtaaaacgggaaaaccggaacgaaccgggtaaccggtaccggttagtttaaacgttaacggtacttaacgggtaacggtaacggtaacgggttaaggttaacgtttaaccggttaggggtttaagggggtacgtttaacggtacgggtaaacggggtaaacggggggttacctacgttaaccgtcggttaacggtacgggtacggtaccgggtacggggaaaccgacgggtaacccggtaacggttacccacccggtttcctacccgtaccgtaccggtacctaacccgaccgggttaaaccggccccgttacggttacccggttccccgtaccccggtacccgtaacccctaccccggttaaccctaccggaaaccggtcctaacccggttacccggacgggttacccgggaccctacccgggg

SEQ ID NO: 38521 - DNA, 690 bp, Homo sapiens
  misc_feature: GYAE6OF02JKZCK.18.14.B03.1.454.CMB.1.raw
  modified_base (210)..(210): a, c, t, g, unknown or other
  misc_feature (210)..(210): n is a, c, g, or t
  modified_base (284)..(285): a, c, t, g, unknown or other
  misc_feature (284)..(285): n is a, c, g, or t
  modified_base (309)..(309): a, c, t, g, unknown or other
  misc_feature (309)..(309): n is a, c, g, or t
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
tcagtacgagtatgcacgaccggtgctcgatttagtgtgagtagtttgggtcgtgagctgggttttccttgttgctatttaaaggtagtccagtgtgaggtgcagctggtggaggtccgggggaggcttggtccagccgtgggggtcccgtgaaactctcctgtgcagcctctgggtcaccttcagtggctctgctatgcactgggtccnccaggccttccggggaaagggctgggagtgggtgccgtatagaagcaaagctaacagttacgcgacagcaatannctgcgtcggtgaaggcaggttacnccgtctaccagaaatgacttacgaaagaccaggtcgtataccgngtacaaaatcgaaacagtcccgtagaaaaaccggnggaaccaccgggtccgtagttaacttactacgttacaagcgaaggtggtacgttaacgtaggtttacgggtagttaagtcgggaacgggtaaacggggggtacgtacgtacgacgtaagtcgggtacgtacggtcgggaccgaacgggaccgaacggtcgtaacccgtccttaccgtacgtacgaccctcccgaaccgaacgggaccctacgttaccggtcccgttaccccgtccgtacccgtacccccgtaccgtacccgaacgtaccgcccgtaacccgtcgggtccgggtaccacccgg

SEQ ID NO: 38522 - DNA, 725 bp, Homo sapiens
  misc_feature: GYAE6OF02JGLGX.18.14.B03.1.454.CMB.1.raw
  modified_base (415)..(415): a, c, t, g, unknown or other
  misc_feature (415)..(415): n is a, c, g, or t
tcagtacgagtatgcacgaccggtgctcgatttagtgtgagtagtttgggctggagctgggttttccttgttgctatttaaaaggtgtccagtgtgacggtgcagctggtggagttcccgggggagcttggtccagccgtgggggtccctgaaactctcctgtgcagcctctgggttcaccttcagtgcctctgctatgctacgttcgggtcccgccgaggtccgttaccggggaaaggcctggaggttgggttcggccgttattagaagacaaagtcttaacgagttacgcgacagcatatgctaggcgtcggagaaggcctaggttccaccgtcaccagtaatgaattacgaaacgacgtacggtcgtatcgtacgactaaagtcgaaactcgtaccgtaaggaaaacccggnggaaccgacggtcggtagttaacttacgacgttaacgtaaggaccgtaaggttcgtaattacgtaggttagggtaacgttagtaccggacgggtaaacgggggttactacgtaacgtacgttaggtacggtacgtacggtcgggtacgaacgggtaccgtacggtaccgtaccgttacgtcctacgtaccgtcctaccgaaccgacggtacccgtacgttcccggttacccgtccccggtacgtaccgtaccccgttaccgtaccgaacgtaccgacccgtaccggtccgggtaccgggcccgtaaccgg

SEQ ID NO: 38523 - DNA, 673 bp, Homo sapiens
  misc_feature: GYAE6OF02I3XDZ.18.14.B03.1.454.CMB.1.raw
  modified_base (207)..(207): a, c, t, g, unknown or other
  misc_feature (207)..(207): n is a, c, g, or t
  modified_base (282)..(282): a, c, t, g, unknown or other
  misc_feature (282)..(282): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (452)..(452): a, c, t, g, unknown or other
  misc_feature (452)..(452): n is a, c, g, or t
  modified_base (635)..(635): a, c, t, g, unknown or other
  misc_feature (635)..(635): n is a, c, g, or t
tcagtacgagtatgcacgaccggtgctcgatttagtgtgagtagtttgggctgagctgggttttccttgttgctattttaaaggtgtccagtgtgaggtgcagctggtggaggtccgggggaggcttgggtaaaggccgggggggtccttagactcccctgtacagcctctggattcactttcagtaggcctggatgactgggtccnccagctcgagggagggctggagtgggtcgcgtaattaaaaccgaaagtgagtggtacgggaacacagacctacgntagcaccgtagaaagcagtcttacaacctntacacaaggagtataggaattaagaaaaaggcctaacggtnttagtactcctaggaacctaaatcgaactacggccgtaggacaaccgaggtaccacgacgtccgtagttatacgtcgtaaacactactaccgataacgnttaacctaacgtactaactacgtacgagtccgactacggtaggaccacggcgtactaccgtactccgtctacgaccgtccgaccgacgaacccgggtctaccgtacccgttcccgtcccgcgtccgtacccgtccgaccgttaccgacggtccgtacccgccggtaccgacgtccggtaaccncttaccgggcccgtacccggttacggccggttacccgg

SEQ ID NO: 38524 - DNA, 245 bp, Homo sapiens
  misc_feature: GYAE6OF02F9CZ5.18.14.B03.1.454.CMB.1.raw
  modified_base (244)..(245): a, c, t, g, unknown or other
  misc_feature (244)..(245): n is a, c, g, or t
tcagtacgagtatgcacgaccggtgctcgatttagtgtgagtagtttgggggggtactactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttcccatactcgtactgagcgggctggcaaggcgcatagnn

SEQ ID NO: 38525 - DNA, 774 bp, Homo sapiens
  misc_feature: GYAE6OF02HP77A.18.14.B03.1.454.CMB.1.raw
  modified_base (322)..(322): a, c, t, g, unknown or other
  misc_feature (322)..(322): n is a, c, g, or t
  modified_base (356)..(356): a, c, t, g, unknown or other
  misc_feature (356)..(356): n is a, c, g, or t
  modified_base (471)..(471): a, c, t, g, unknown or other
  misc_feature (471)..(471): n is a, c, g, or t
tcagtacgagtatgcacgaccggtgctcgatttagtgtgagtagttggtcgtgagcgtgggttttccttgttcgcgtatttaaaaggtgtcctagtgtgagtgcagctggtgagtccggggagcgttggcagccgtggggtcccgtagtaaacgtctcctgtgacgtacggtcctcgtggttactaaccgttcgacgtggtctcgtagtctatcgcgtacgtggtccgcgacgtacgtaccgggaagtccgtaggtacggtgggtacgtcgtagtacgagacgaaagtctaacgacgttacgacgatagctaaacgtatgtntacgcgtggtaacgaagcgtaaggtcctaccgtntacctaagtaactgacgttaacaaacgtaacgccggtaattacctcgtagaacctaaggtacaacggacacgtaaacgaaacggacgtacaaggtctagtatagcgtagtaacgntaggtacgtacgtacgtaggtttacgggagtaacgttacgaccgggtaaaacgggttacgttacgaacgtacgtaagtaggtacgttacgacgggtaacgtaaacgaccggaaacccggttacgtaaccgtccgttaaacccgtcgtacccgtaccgtacccccgtaaaccgtaacccgggtaacccgaccgtttacccggttaccccggaccccgtttaccggaccggtaacccccctttaccggtacccgtaaggaacccggttccgtaaccccggtccggtaccgggacccgttaaccgg

SEQ ID NO: 38526 - DNA, 800 bp, Homo sapiens
  misc_feature: GYAE6OF02JTVL0.18.14.B03.1.454.CMB.1.raw
tcagtacgagtatgcacgaccggtgctcgatttagtgtgagtagtttggcgtgagctgggtttccttgttgctattttaaagtgtccagtgtgaggtgcagctggtggagtccggggaggcttggtccagcctgggggtccctgaaactctcctgtgcagcctctgggttcaccttcagtggctctgctatgcacgtggtccgccaggcttccgggaaaggcgtggagtgggttggccgtattagaacgcaaagctaacagttacgcgacacgcatatcgctgccgtggtagaaacggcgtaggttaccaccggtctaccgaagtaaagttgaacgttacgaaaacgaacgtccggtaccggtaatccggtgaactaaaacgtacgaaaccgtacggacccgttaacggaaaaacccggcggttaacccgacgggttaccccgttagttaactttaccgtacggttaacctaaggaacccgggttagggtaaggtaacgtttaaccgtaggttttaacgggggtacggtttaacgttacgggaaccggggttaaaaccgggggggtaccttaaccggtaaccgtacggtttaacgtaccgggttaacgtcgggtaccggggtacgtaaaccgggaccgtaccggtaccgtacccgtacgtcccgtacgtaccgtacccgtacccgaaccgtaaccggcccgtaccgttccggtacccctccccggttacggtcccctaaccccgttcccgaccgtaacgcccgtacccgtacccgacccggttcgggacccgtaacccgg

SEQ ID NO: 38527 - DNA, 250 bp, Homo sapiens
  misc_feature: GYAE6OF02I3EX3.18.14.B03.1.454.CMB.1.raw
  modified_base (242)..(250): a, c, t, g, unknown or other
  misc_feature (242)..(250): n is a, c, g, or t
tcagtacgagtatgcacgaccggtgctcgatttagtgtgagtagtttgggggggtactactacgctatggacgtctggggccaagggaccacggtcaccgtctcctcagcctccaccaagggcccatcggtcttcccctggcgccctgctccaggagcacctccgagagcacagcggcctgggctgcctggtcaaggctacttcccatactcgtactgaggcggctggcaaggcgcagtagnnnnnnnnn

SEQ ID NO: 38528 - DNA, 761 bp, Homo sapiens
  misc_feature: GYAE6OF02H7D1E.18.14.B03.1.454.CMB.1.raw
  modified_base (443)..(443): a, c, t, g, unknown or other
  misc_feature (443)..(443): n is a, c, g, or t
tcagtacgagtatgcacgaccggtgctcgatttagtgtgagtagtttgggctgagctgggtttcttgttgctattttaaaaggtgtccagtgtgaggtgcagctggtggaggtccggggaggcttggtccagccgtcgggggtccctgaaactctcctgtcgcgagtcctcgttgggttacctacctttacgtagtggctctgacttatgctacgtcgggtccgcgacggtcgttaccggggaaaggtcgtaggtagtgggttcggacgtagttagaagacaaagactaaacgtacggttaccgacgaactacggactaagtactcgcgtcggtacgttacgggtaggtaaacggtcctacggttacctaccgtaccgtaccgaaaggtaaacttcgaaacgttacgaaaacgacggtaacggtacgtttacgactacggaanaaacgtagaacacgtaccgtaaagaaaccggtagacgtacggctagtactacgtagtactagacgtaaggtcgtaatacgtagggttagggtacgtagtacgggaacgggtaacggggtactacgacgtaagcgtaggtactcgggtggaccggtacggacgtaccgacgtccgtcctcgtacgccgttaccgacgaaacccggtacggtccgaccgtttcccggtacccgttaaccccggtaccgacccgtacccgttacccaacggtaccacccggtacccgtacccgggttacggtcccgggaaccggtacccgg

SEQ ID NO: 38529 - DNA, 660 bp, Homo sapiens
  misc_feature: GYAE6OF02IP6BC.18.14.B03.1.454.CMB.1.raw
  modified_base (566)..(566): a, c, t, g, unknown or other
  misc_feature (566)..(566): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctgggagtgggttggccgtattagaagcaaagctaacagttacgcgacagcatatgctgcgtcggtgaaaggcaggttcaccgtctacagaatgattacaaagacgacggcgtatctgacaaagtgaaacacgacctaagaaaaaccggaggtaaccgacggtccgttagtaactttacgtacgttaacgtagaacgtagggtaggtaatttaacgtaaggtttacgggggtaagttacgtacggtaccgggtaaacgggggggtactaacgtacgtcgttacgtggtacgtcgtcggggaccgaagggaccgtaccggtaccgaccgtcctccgtacnccgaccctaccgaaccgaccggaccgacgtccggtcccgttccccgtccggcctacccctccgtaccacgacgcctaccgtcggcgggccacgg

SEQ ID NO: 38530 - DNA, 757 bp, Homo sapiens
  misc_feature: GYAE6OF02INIBM.18.14.B03.1.454.CMB.1.raw
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
tcagtacgagtatgcacgaccggtgctcgatttagtgtgagtagtttgggctgagctgggttttccttgttgctattttaaaaggtgtccagtgtgaggtgcagctggtggaggtccgggggaggcttggtccagccgtggggggtccctgaaactctcctgtgcagcctcgtgggttccaccttcaggtggctctgctatgcacgtgggtcccgcgaggtcttaccggggaaaggctgggaggttgggtggccgtattagaagcaaagctaacngtacgcgacagcatangctgcgtcggaggaaggctaggtcaccgtctacgaacgaaatcgtattacaaaacgacgaccggcgtatactggaactaagacaacgctaaccgtaacgaaaacggaggaaccgaccgggacgttagtacttactacgtaacgtagaacgtaggtacgtaacgttacgttagggtttaaggggttcggtttaagacgggtaaccggggtaaaacggggggtacgttaaccggtacgttacgttaaggtacggttacgggtccggtaccggggtacggaaaccgggtcccgtacgggtaccctacccggtaccgttcccgtacgacccgtaccccgtaccgtaaccgggtaaaccggtcccgtaccgttacccgggttcccccgtttcccggacccggtacccgtacccctacccgtacccgaacgccgtaacccgtaccgttaccgggtccgggaccgtacccggg

SEQ ID NO: 38531 - DNA, 892 bp, Homo sapiens
  misc_feature: GYAE6OF02F03ZF.18.14.B03.1.454.CMB.1.raw
  modified_base (207)..(207): a, c, t, g, unknown or other
  misc_feature (207)..(207): n is a, c, g, or t
  modified_base (283)..(283): a, c, t, g, unknown or other
  misc_feature (283)..(283): n is a, c, g, or t
tcagtacgagtatgcacgaccggtgctcgatttagtgtgagtagtttgggctgagctgggttttccttgttgctattttaaaggtgtccagtgtgaggtgcagctggtggaggtccggggagcttggtccagccgtgggggtccctgaaactctcctgtgcagcctctgggttcaccttcagtggctctgctatgccagtgggtccnccgaggcgttaccgggaaggctaggaggttgggttcgccgttattagaagcgaaagcgtaaacaggttacgccganagtacaattatgactggaccggttcggtaggaaaacggtctacgggtttaccaaccggttacctaccaaaggtaaaactcgtaatttaaccgaaaaaggtaaccgacgggtaccgtaaagtttccaggaacctaaaagtacggaaacctacggtaacccctaacggaaaaaacccgggaggaaacccgaccgggtaccgttagtaacgtttaacctacggtaactacggaaccgtagggtacgtaacgtttaacgtaggttttagggggtaacgtttaggtaccgggtaaccggggtaaacgggggggttaactaaccggtaccgtacgttaacggtacgggtaacgttacggtacgggggacccgaaacgggtaacccggtaaccggtaccgtacccggtacccgtacccttaccgtaaccggccccgttaaccccggaaccgtaacccggggtaccctacccgttaacccgggttaccccgtttacccccccgggtcggttaacccccggttaaccccctttaccccggtaaccccgtaaaccggtaaccgggtaaccccttaacccgggtacccgggttaacccgggggaccttaaacccccgggg

SEQ ID NO: 38532 - DNA, 957 bp, Homo sapiens
  misc_feature: GYAE6OF02H4XDT.18.14.B03.1.454.CMB.1.raw
  modified_base (951)..(951): a, c, t, g, unknown or other
  misc_feature (951)..(951): n is a, c, g, or t
tcagtacgagtatgcacgaccggtgctcgatttagtgtgagtagtttgggctgagctgggttttcttgttgctattttaaaaggtgtcagtgtgaggtgcagctggtggaggtccgggggagcttggtccagccgtgggggtccctagaactctcctgtgcacgcctcgtggttaccacctttcgaggtggtccttctcgctatcgccgtacgttcgggtcccgaccgtagggtccgttaaccgggggaaacgggcgtagggtagggttggggtttcggaccgttagttaacgaagaacgaaacgtacttaacgaggttaccgacggaacagtactattacgtgcgttcggccggtagggtaaaggaaacgggtcgttaacggttaccgtaccggttaccctaccgaaaagtaaaagttgaaacgttaaacgaaaacggaaccgggacggtacgttaacgtcgttagaaactaaagtacgaaacgtaccggaacccgaaaacggaaaaaccggacgggaaccgtaacccggggtacgtttacttaagtttaccgtttaaacgtaaccggtaaagtaccgggttaagggttacgggtaacgttttaggttagggggttttagggggttaaacgttaaaccgggtaccggggtaaaacgggggggttaaaccggggttactaaaccgggttaccgtaagggttacggttacggggtaaccgggttcggggtaaccgggaacgggtaacccgggtaaccggtaccggttaccgtacccgtctttaccccggaaccttacccgggtcccctaaacccgggtaaaaccccggtaccggggtacccttacccggttcccccgggtttaccccgttaccccgtccccggtaaacccctaccccgttacccgaggaaaccgtcccgtacccttaccggggttcggccccggggttaaancccggg

SEQ ID NO: 38533 - DNA, 758 bp, Homo sapiens
  misc_feature: GYAE6OF02G6JSA.18.14.B03.1.454.CMB.1.raw
  modified_base (423)..(423): a, c, t, g, unknown or other
  misc_feature (423)..(423): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagccgtgggggtcctagaactctcctgtgcagcctcgtgggttcaccttcaggtggtctctgcttatgcacgtcgggtcccgccgacggtccgttaccggggaaagggcgtgggtaggttggggttacggccgttagttaaggaagaccaaaagacctaacgtacggttaccggaccgacacggacaattagtcgcgtagccggttacggtaaggaaacggcgtacggttcctaccgttccaccgtaagtaactgtaacttacgaaaagaaccgacggtacgtattcgtanaactaaagtacggaactacgacctaaggaaaccgagaccgacggcttaagttactacgtgtaacagacgaggtagtacttagtaggtttggggagttagtacggtacgggtaaacgggggttactaccgtacgtacgttaggtacggtacggtcggacgggacggaaccgggaccgtacggtcccgtaccgttcctaccgtaccgaccgtacctaacccgaccgtaccggtacccgtaccgttcccggtacccgttcccccggtacgtccccttaccccgtacccgtaaccgaaccggtaccgcccgtaccggtcgggtccgggaccctaccggg

SEQ ID NO: 38534 - DNA, 828 bp, Homo sapiens
  misc_feature: GYAE6OF02JCVFT.18.14.B03.1.454.CMB.1.raw
  modified_base (184)..(184): a, c, t, g, unknown or other
  misc_feature (184)..(184): n is a, c, g, or t
tcagtacgagtatgcacgaccggtgctcgatttagtgtgagtagtttgggcgtggagctgggtttccttgttgctattttaaaaggtgtccagtgtgaggtgcagctggtggtaggtccgggggaggcgttggtccagccgtgggggtccctgaaactctcctgtgcacgcctcgtggttaccnccttacaactccctagttcgtcttcgcgtacgtcgggtcccgacgtacgacctccgaggacggaacgggttaccgaaggtggtcgtccgtgtacgtagtttacttactagtagtacgtaacggtaagtaaactagtacctaactacgtacgacgtacgcgtaaccggtaggacggtcgacttacgacgtactaccgacgtaacggtactacgtaaccgacgtacaccggtctacggtactaccgttaacgaacggtagaccgtacgtcgtaaacggacgtacgttaaccgacggtaacgtaccgggtacttacggttaacgttttacgacgtttaggaaccgggttaacgaacggtaagtacccgttaagggttacccggtttaaggttacggtaacggttacggtaaggtacgggttaagtaaccgtccgtacggtaacgtccggttaaccgccgttccgtacgtacggtacccttacccgttactaccgtaccggttcgttaaccgggtaccgttaaccggaccggggtacccggtacccggttcccgtccggtacccgttcccgtaccgtacccgtcccggaaccctaccggtaaccgtccccggtacggtcccgttaccccggtcccgtaacgggtcccc

SEQ ID NO: 38535 - DNA, 887 bp, Homo sapiens
  misc_feature: GYAE6OF02H4L5V.18.14.B03.1.454.CMB.1.raw
  modified_base (209)..(209): a, c, t, g, unknown or other
  misc_feature (209)..(209): n is a, c, g, or t
  modified_base (431)..(431): a, c, t, g, unknown or other
  misc_feature (431)..(431): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccgggggagcttggccagccgtgggggtccctgaaactctcctgtgcagcctctgggttacaccttcagtggctctgctatgctacgtgggtccnccaggcttaccgggggaaaggcttagggaggttgggttggccgttaagttaagaaaggacgaaaacgtaccgtaaaacctaggttaccgacgaaaccaagacccaataacggtgacgttggaccgttacgggtaaagaaaaggcctagggtttaccacccggtacctaccaaggtaaaaactcgtaaacttaccgaaaaaacgaaccgacgggtaccttaanaccggttacggaacctaaaaacgttacgaaaaccttaaccggtaccccttaaaggggaaaaacccggacggaaccgtaaacccgggtccgttaaggtttaacctttaaacgtttaggtaaccctaaagtaaccgggtagggttaagggttaactttaaacggtacggttttaaaggggggttaagttaaccggtacgggaaaccggggtaaaccggggggttaaccgtaaccgttaacggtaacgtaagttacgacggttccgtacggggacgaaccggggtacccacgggtaccaccggtacgttaccgtaccgtactcccgtaccccgaacgaaccgggtcctaacgttcccggttacccgttacccccgttacggacccctaccccgttaaccccgtaccgaacggaccgttaacccgacccggttaccgggtaccgggtaacgtaaccccgg

SEQ ID NO: 38536 - DNA, 689 bp, Homo sapiens
  misc_feature: GYAE6OF02HI86Y.18.14.B03.1.454.CMB.1.raw
  modified_base (353)..(353): a, c, t, g, unknown or other
  misc_feature (353)..(353): n is a, c, g, or t
tcagtacgagtatgcacgaccggtgctcgatttagtgtgagtagtttgtgctgagcgtgggttttccttgttgctattttaaaaggtgtccagtgtgaggtgcagctggtggagtccgggggaggcttggtccagcctggggggtccctgaaactctcctgtgcagcctctgggttccaccttcagtggctctgtctatgcacgtcggtccgcgaggtccgttaccggggaaagggctgggagttcggggttgccgttaatagaagacaaagctaaacgagttacgacgacagcatatgctgcgtggagaaggcaggtcaccgtcaccaagaaatgatacaaagacacgctanctagacaatgaacagacctaaggaaaccgaggacgtacggtcgtagtactttacgagtaactagacgtaggtgtaattagttaggtttggggtattaggtacggacggggtaaacgggggttactacggtacgtacgtacgtacgggtcgtcgggtacgggaaccgaacgggtaccgtaccggtaccgtacccgttcgtcccgtaccgtaccgtccctaacccgaaccgtaccgcccgtacggttcccggttcccgttaccccggtccggtaccctaccccgtacccgtacccgtaaccggaccgttacccgaccggttaccgggcggtaacccgg

SEQ ID NO: 38537 - DNA, 710 bp, Homo sapiens
  misc_feature: GYAE6OF02H84JT.18.14.B03.1.454.CMB.1.raw
  modified_base (363)..(363): a, c, t, g, unknown or other
  misc_feature (363)..(363): n is a, c, g, or t
tcagtacgagtatgcacgaccggtgctcgatttagtgtgagtagtttgggctgagctgggttttccttgttgctattttaaaaggtgtccagtgtgaggtgcagctggtggaggtccgggggaggcttggtccagcctggggggtccctgaaactctcctgtgcagcctctgggttcaccttcagtggctctgctatgcacgtggggtcccgccgaggcgttacccgggggaaagggctgggaggtgggttggccgtattagaagacaaagctaaacagttacgcgacagacatatgctgcgtcggtagaaaggctaggttccaccgtctcaagtaaatgattacaaagaacacggtacgtanctagactaaatgaaacacgaccgtaggaaaaccgaggaccaacggtccgttagtacttaacgtagtaacgtagacgtagggtacgtattacgtaggttaggggtagttagtacggagggtaaacggggggtactacgtacgtacgtaagtcggtacgtcggttacggggaccgaaacgggaccgtaccgggtaccgtaccgtccgttacctaccgaccgtaccctaccgaacccgaaccgggacccgtacgtacccgggttacccgtccccggtaccggtaccctaccccgttaccctacccgaacggtaccgaccgtacccgtacgggtacggggacctaaccggg

SEQ ID NO: 38538 - DNA, 726 bp, Homo sapiens
  misc_feature: GYAE6OF02JH3LE.18.14.B03.1.454.CMB.1.raw
  modified_base (297)..(297): a, c, t, g, unknown or other
  misc_feature (297)..(297): n is a, c, g, or t
tcagtacgagtatgcacgaccggtgctcgatttagtgtgagtagtttgggctgagctgggttttccttgttgctattttaaaaggtgtccagtgtgaggtgcagctggtggagtccggggaggcttggtccagcctgggggtccctgaaactctcctgtgcagcctctgggttcaccttcagtggctctgctatgcacgtgggtccgcaggtcgttccgggaaagggccgtggaggttgggttggccgtattacgaagcaaagctaacagttacgcgacagtacatattcgctacgngttcggtgaaaggcgtaggttaccaccgtaccgccaggtaaactggaactttacgaaagtaccaccgggtacgtattcctacggaactaaagttacggaaacctaacggtaaccctaacgggaaaaccgggtacggaacccgtacgggtacccgtaggtttaacctttaacgtacggttaactaacggaccgttagggtacggttaacttacgtaggtttagggtagttacgtacggtacgggtaaacgggggttactacgtacgtgttacgtcggtacgtcgtagggtaccgaacgggaccgacggttacaccgtccgtaccgtcgtacgtcccgtacgaccgacggcccgtctaccggtcccttcccggtcggtaccctcccgtccgtaccgacgtcccgcgtaccgtacggtcgggaccctaccgg

SEQ ID NO: 38539 - DNA, 700 bp, Homo sapiens
  misc_feature: GYAE6OF02FF9F8.18.14.B03.1.454.CMB.1.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagtacgagtatgcacgaccggtgctcgatttagtgtgagtagtttgggttcgggggaggcttggtccagcctggggggtccctgaactctcctgtgcagcctctgggttcaccttcagtggctctgctatgcactgggtccgccaggcttccgggaaaggctggagtgggttgccgtattagagcaaagcttaacagttacgcgacaggcatatgctagcgtcggtgaaagcaggttcaccgtctcagaatgattcaaagacacggcgtatctgacaaatggaacngcctagaaaccgnggaacacggccgtagtattaactcgtaaccactactaccccgagaaacgccgtacaaccttactaccgtactacggtactcgggacctgtacggggccgaaacggggtccacggggtacctaacccggttcctacccgttacacgtacccttaccgaacccgaacgggtcccacgttaccggttacccgttacccccgtcgggtaccccgtacccgtacgtcccgttacccgacgggtacgacctacccgttaccgacggtaaccgaccgacgtaccggccgggaccccgttacgggtcctacggtcccgtacggtaccgaacgggtacctacgttaccctaacgtaccgtaccgttacgtacggacgtcgggacctcgggacgtacggccgacgtacg

SEQ ID NO: 38540 - DNA, 843 bp, Homo sapiens
  misc_feature: GYAE6OF02IQZJ3.18.14.B03.1.454.CMB.1.raw
tcagtacgagtatgcacgaccggtgctcgatttagtgtgagtagtttgggctgagctgggttttcctgttgctatttaaaaggtgtccagtgtgaggtgcagctggtggaggtccgggggagcttggtccagcctgggggtccctgaaactctcctgtgcagcctctgggttcaccttcagtggctctgctatgctacgtcgggtcccgccgagggtccgttacccgggggaaaacggggtccgtgggtaggttgggggttacggtcccggttaagtttaacggaagtaccgaaaaagccgtaaacgtacggttaaccgccgaaccaggacctaagtacgttgccttcgggtcggttaccgggtaagaaaacgggtctacgggttttacccacccggttacctaccgtaaaggtaaaactggtaattaacgaaaacggtaaacacggggtacgttaactcgtacgtaacaaaagttcgaaaccacgtaacccgtaaaggaaaaaccccggagggtaaccgtacgggtcccgttaagttaacgtttaccgttaagttaactaggtaaccgggtaggttggtaacttaaccggttagggtttagggggttagttaggtaccgggtaaacgggtaaaccgggggggtactaaccggtacgtacgttggtacgggtacggtaccggtcggggaaccgtaacgggaccgtaacgggtacctcccggtctcgtcgccgcctaccaccggtaccggaccgtcgttccggtcccttccccggtcgtaacccttcccgtcccgttaaccgacgtccggtacccgtaccggtccgggtccggaccgtaaccgg

SEQ ID NO: 38541 - DNA, 621 bp, Homo sapiens
  misc_feature: GYAE6OF02G708W.18.14.B03.1.454.CMB.1.raw
tcagtacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctgggagtgggttggccgtattagaagcaaagctaacagttacgcgacagcatatgctgcgtcggtgaaaggcaggttcaccgtctccagaaatgattcaaaagacacggcgtatctgacaaatgaacagcctagaaaaccgaggacacggccgtgtattacctgtactagacaggtggattacgtagtttggggagttagtcgtacggtaaacggggggtactaacgtacgtactagtcggacgtcgtcgggaccgaagggaccgaccggtccgtacccgtctccgtccgacgcctcccaaccgacgggaccctagtaccgtccgttcccccgtcggccctacccgtccctaccgaacgtacgccgtacccgtccggtacggggtccaaccgg

SEQ ID NO: 38542 - DNA, 599 bp, Homo sapiens
  misc_feature: GYAE6OF02FZG0F.18.14.B03.1.454.CMB.1.raw
  modified_base (281)..(281): a, c, t, g, unknown or other
  misc_feature (281)..(281): n is a, c, g, or t
  modified_base (562)..(562): a, c, t, g, unknown or other
  misc_feature (562)..(562): n is a, c, g, or t
tcagtacgagtatgcacgaccggtgctcgatttagtgtgagtagtttgggctgagctgggttttccttgttgctattttaaaaggtgtccagtgtgaggtgcagttggtggagtccggggggaggcttggtccagcctggggggtccctgaaactctcctgtgcagcctctgggttcaccttcagtggctctgctatgcacgtgggtccgccaggcttccgggaaaggctggagtgggttgccgtattagaagcaaagctaacagttacgcgacagcatangctgcgtcgtgaaaggcaggtcaccgtctacagaatgattacaaagaacacggctatctagacaaatacgaacacgacctaggaaaaccgaggacaaccggtcgtagtattacgtagtaactaggaacagggtagtagttaactaggtttaggggtaagttagtacgacggtaaacggggggtactacgtacgacgtagtggacgtcggtacggacgacggacgacggtctaccgtctccacgacgcctccaccgacggaccactcgtcctcccgtcgccnccgtcgtctccgacggcgaccaccgccgagactaccg
